US007582449B2

(12) United States Patent
Doucette-Stamm et al.

(10) Patent No.: US 7,582,449 B2
(45) Date of Patent: *Sep. 1, 2009

(54) **NUCLEIC ACID AND AMINO ACID SEQUENCES RELATING TO *STREPTOCOCCUS PNEUMONIAE* FOR DIAGNOSTICS AND THERAPEUTICS**

(75) Inventors: Lynn Doucette-Stamm, Framingham, MA (US); David Bush, Somerville, MA (US); Qiandong Zeng, Waltham, MA (US); Timothy Opperman, Somerville, MA (US); Chad Eric Houseweart, Waltham, MA (US)

(73) Assignees: Sanofi Pasteur Limited, Toronto, Ontario (CA); Sanofi Pasteur Limitée, Toronto, Ontario (CA)

( * ) Notice: Subject to any disclaimer, the term of this patent is extended or adjusted under 35 U.S.C. 154(b) by 0 days.

This patent is subject to a terminal disclaimer.

(21) Appl. No.: 11/801,963

(22) Filed: May 11, 2007

(65) Prior Publication Data

US 2007/0287172 A1 Dec. 13, 2007

Related U.S. Application Data

(63) Continuation of application No. 11/524,355, filed on Sep. 20, 2006, now Pat. No. 7,405,291, which is a continuation of application No. 11/027,892, filed on Dec. 30, 2004, now Pat. No. 7,378,514, which is a continuation of application No. 10/640,833, filed on Aug. 14, 2003, now abandoned, which is a continuation of application No. 09/583,110, filed on May 26, 2000, now Pat. No. 6,699,703, which is a continuation-in-part of application No. 09/107,433, filed on Jun. 30, 1998, now Pat. No. 6,800,744.

(60) Provisional application No. 60/085,131, filed on May 12, 1998, provisional application No. 60/051,553, filed on Jul. 2, 1997.

(51) Int. Cl.
*C12N 15/56* (2006.01)
*C12N 15/70* (2006.01)
*C12N 15/74* (2006.01)
*C12N 15/79* (2006.01)
*C12N 15/81* (2006.01)
*C12N 15/85* (2006.01)
*C12N 15/866* (2006.01)
*A61K 39/09* (2006.01)

(52) U.S. Cl. ............... 435/69.3; 435/200; 435/252.3; 435/252.33; 435/254.2; 435/348; 435/358; 435/69.1; 536/23.2; 424/282.1

(58) Field of Classification Search ............ None
See application file for complete search history.

(56) References Cited

U.S. PATENT DOCUMENTS 5,302,527 A 4/1994 Birkett et al.
5,994,066 A 11/1999 Bergeron et al.
6,420,135 B1 7/2002 Kunsch et al.
6,573,082 B1 6/2003 Choi et al.
6,582,706 B1 6/2003 Johnson et al.
6,689,369 B2 2/2004 Koenig et al.
6,699,703 B1 3/2004 Doucette-Stamm et al.
6,800,744 B1 10/2004 Doucette-Stamm et al.
6,887,663 B1 5/2005 Choi et al.
6,929,930 B2 8/2005 Choi et al.
6,936,252 B2 8/2005 Gilbert et al.
7,056,510 B1 6/2006 Choi et al.
7,074,914 B1 7/2006 Doucette-Stamm et al.
7,081,530 B1 7/2006 Doucette-Stamm et al.
7,098,023 B1 8/2006 Doucette-Stamm et al.
7,115,731 B1 10/2006 Doucette-Stamm et al.
7,122,194 B2 10/2006 Johnson et al.
7,122,368 B1 10/2006 Doucette-Stamm et al.
7,128,918 B1 10/2006 Hamel et al.
7,129,339 B1 10/2006 Doucette-Stamm et al.
7,129,340 B1 10/2006 Doucette-Stamm et al.
7,135,560 B1 11/2006 Doucette-Stamm et al.
7,141,418 B2 11/2006 Kunsch et al.
7,151,171 B1 12/2006 Doucette-Stamm et al.
7,153,952 B1 12/2006 Doucette-Stamm et al.
7,326,544 B2 2/2008 Doucette-Stamm et al.

(Continued)

FOREIGN PATENT DOCUMENTS

AU 200131407 B2 6/2001
AU 20042105223 B2 10/2004
EP 0942983 10/1997
EP 0893502 1/1999
EP 0942983 B1 9/1999

(Continued)

OTHER PUBLICATIONS

Garcia, P., et al., 1999, "LytB, a novel pneumococcal murein hydrolase essential for cell separation", Molecular Microbiology, vol. 31, No. 4, pp. 1275-1277.*
Buck, M.A, et al., "Single Protein Omission Reconstitution Studies of Tetracycline Binding to the 30S Subunit of *Escherichia coli* Ribosomes," Abstract only, *Biochemistry*, Jun. 1990, 5(22):5374-5379, American Chemical Society Publications, Columbus, Ohio, USA.

(Continued)

*Primary Examiner*—Rebecca E Prouty
*Assistant Examiner*—William W Moore
(74) *Attorney, Agent, or Firm*—Hamilton, Brook, Smith & Reynolds, P.C.

(57) ABSTRACT

The invention provides isolated polypeptide and nucleic acid sequences derived from *Streptococcus pneumoniae* that are useful in diagnosis and therapy of pathological conditions; antibodies against the polypeptides; and methods for the production of the polypeptides. The invention also provides methods for the detection, prevention and treatment of pathological conditions resulting from bacterial infection.

16 Claims, No Drawings

U.S. PATENT DOCUMENTS

| | | |
|---|---|---|
| 7,335,493 B2 | 2/2008 | Doucette-Stamm et al. |
| 7,335,494 B2 | 2/2008 | Doucette-Stamm et al. |
| 7,338,786 B2 | 3/2008 | Doucette-Stamm et al. |
| 7,378,258 B2 | 5/2008 | Doucette-Stamm et al. |
| 7,378,514 B2 | 5/2008 | Doucette-Stamm et al. |
| 7,381,814 B1 | 6/2008 | Doucette-Stamm et al. |
| 7,381,815 B2 | 6/2008 | Doucette-Stamm et al. |
| 7,381,816 B2 | 6/2008 | Doucette-Stamm et al. |
| 7,385,047 B1 | 6/2008 | Doucette-Stamm et al. |
| 7,388,090 B2 | 6/2008 | Doucette-Stamm et al. |
| 7,390,493 B2 | 6/2008 | Doucette-Stamm et al. |
| 7,396,532 B2 | 7/2008 | Doucette-Stamm et al. |
| 7,404,958 B2 | 7/2008 | Doucette-Stamm et al. |
| 7,405,291 B2 | 7/2008 | Doucette-Stamm et al. |
| 7,442,523 B2 | 10/2008 | Doucette-Stamm et al. |
| 2003/0022181 A1 | 1/2003 | Cripps et al. |
| 2003/0134407 A1 | 7/2003 | Le Page et al. |
| 2004/0005331 A1 | 1/2004 | Johnson et al. |
| 2004/0052781 A1 | 3/2004 | Johnson et al. |
| 2004/0219165 A1 | 11/2004 | Cripps et al. |
| 2004/0265933 A1 | 12/2004 | Le Page et al. |
| 2005/0181439 A1 | 8/2005 | Choi et al. |
| 2005/0276814 A1 | 12/2005 | Gilbert et al. |
| 2007/0009901 A1 | 1/2007 | Doucette-Stamm et al. |
| 2007/0009902 A1 | 1/2007 | Doucette-Stamm et al. |
| 2007/0009903 A1 | 1/2007 | Doucette-Stamm et al. |
| 2007/0009904 A1 | 1/2007 | Doucette-Stamm et al. |
| 2007/0009905 A1 | 1/2007 | Doucette-Stamm et al. |
| 2007/0009906 A1 | 1/2007 | Doucette-Stamm et al. |
| 2007/0015255 A1 | 1/2007 | Doucette-Stamm et al. |
| 2007/0015256 A1 | 1/2007 | Doucette-Stamm et al. |
| 2007/0021368 A1 | 1/2007 | Doucette-Stamm et al. |
| 2007/0021369 A1 | 1/2007 | Doucette-Stamm et al. |
| 2007/0021370 A1 | 1/2007 | Doucette-Stamm et al. |
| 2007/0021371 A1 | 1/2007 | Doucette-Stamm et al. |
| 2007/0021372 A1 | 1/2007 | Doucette-Stamm et al. |
| 2007/0021373 A1 | 1/2007 | Doucette-Stamm et al. |
| 2007/0021374 A1 | 1/2007 | Doucette-Stamm et al. |
| 2007/0021601 A1 | 1/2007 | Doucette-Stamm et al. |
| 2007/0031852 A1 | 2/2007 | Doucette-Stamm et al. |
| 2007/0037766 A1 | 2/2007 | Doucette-Stamm et al. |
| 2007/0059801 A1 | 3/2007 | Doucette-Stamm et al. |
| 2007/0059802 A1 | 3/2007 | Doucette-Stamm et al. |
| 2007/0065458 A1 | 3/2007 | Johnson et al. |
| 2007/0082005 A1 | 4/2007 | Doucette-Stamm et al. |
| 2007/0083038 A1 | 4/2007 | Doucette-Stamm et al. |
| 2007/0088150 A1 | 4/2007 | Doucette-Stamm et al. |
| 2007/0092946 A1 | 4/2007 | Doucette-Stamm et al. |
| 2007/0093647 A1 | 4/2007 | Doucette-Stamm et al. |
| 2007/0093648 A1 | 4/2007 | Doucette-Stamm et al. |
| 2007/0099861 A1 | 5/2007 | Doucette-Stamm et al. |
| 2007/0117965 A1 | 5/2007 | Doucette-Stamm et al. |
| 2007/0154986 A1 | 7/2007 | Kunsch et al. |
| 2007/0207976 A1 | 9/2007 | Doucette-Stamm et al. |
| 2007/0243207 A1 | 10/2007 | Doucette-Stamm et al. |
| 2007/0243585 A1 | 10/2007 | Doucette-Stamm et al. |
| 2008/0009035 A1 | 1/2008 | Doucette-Stamm et al. |
| 2008/0020442 A1 | 1/2008 | Doucette-Stamm et al. |
| 2008/0032339 A1 | 2/2008 | Doucette-Stamm et al. |
| 2008/0064083 A1 | 3/2008 | Doucette-Stamm et al. |
| 2008/0089899 A1 | 4/2008 | Gilbert et al. |
| 2008/0113429 A1 | 5/2008 | Doucette-Stamm et al. |
| 2008/0113430 A1 | 5/2008 | Doucette-Stamm et al. |
| 2008/0124794 A1 | 5/2008 | Doucette-Stamm et al. |
| 2008/0131963 A1 | 6/2008 | Doucette-Stamm et al. |
| 2008/0131964 A1 | 6/2008 | Doucette-Stamm et al. |
| 2008/0175857 A1 | 7/2008 | Gilbert et al. |
| 2008/0177026 A1 | 7/2008 | Doucette-Stamm et al. |
| 2008/0187965 A1 | 8/2008 | Doucette-Stamm et al. |
| 2008/0194505 A1 | 8/2008 | Doucette-Stamm et al. |
| 2008/0254070 A1 | 10/2008 | Gilbert et al. |
| 2008/0260768 A1 | 10/2008 | Gilbert et al. |

FOREIGN PATENT DOCUMENTS

| | | |
|---|---|---|
| EP | 1400592 A1 | 3/2004 |
| EP | 1770164 A2 | 4/2007 |
| WO | WO 95/14712 | 6/1995 |
| WO | WO 95/31548 | 11/1995 |
| WO | WO 96/08582 | 3/1996 |
| WO | WO 98/06734 A1 | 2/1998 |
| WO | WO 98/18930 | 5/1998 |
| WO | WO 98/18931 | 5/1998 |
| WO | WO 98/23631 | 6/1998 |
| WO | WO 98/26072 | 6/1998 |
| WO | WO 99/33871 | 7/1999 |
| WO | WO 00/06737 | 2/2000 |
| WO | WO 00/06738 | 2/2000 |
| WO | WO 00/14200 | 3/2000 |
| WO | WO 00/17370 A1 | 3/2000 |
| WO | WO 00/37105 | 6/2000 |
| WO | WO 00/58475 | 10/2000 |
| WO | WO 00/76540 | 12/2000 |
| WO | WO 02/22168 A2 | 3/2002 |
| WO | WO 02/079241 A2 | 10/2002 |

OTHER PUBLICATIONS

Burgess, W.H., et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," *Journal of Cell Biology* 111:2129-2138 (1990).

Crickmore, N., et al., "The *Escherichia coli* Heat Shock Regulatory Gene is Immediately Downstream of a Cell Division Operon: The Fam Mutation is Allelic with rpoH," Abstract only, *Mol Gen Genet*, Dec., 1986, 205(3):535-539, Springer-Verlang, Berlin, Germany.

Fleck, R.A., et al., "Use of HL-60 Cell Line To Measure Opsonic Capacity of Pneumococcal Antibodies," *Clinical and Diagnostic Laboratory Immunology* 12(1): 19-27 (2005).

Gerhold, D., and Caskey, C.T., "It's the genes! EST access to human genome content," *BioEssays* 18(12):973-981 (Dec. 1996).

Gill, D.R., et al., "The Identification of the *Escherichia coli* ftsY Gene Product: An Unusual Protein," Abstract only, *Mol Microbiol*, Apr. 1990, 4(4):575-583, Blackwell Science, Ltd., Boston, MA, USA.

Gosink, K.K., et al., "Role of Novel Choline Binding Proteins in Virulence of *Streptococcus pneumoniae*," *Infection and Immunity* 68(10):5690-5695 (Oct. 2000).

Haasum, Y., et al., "Amino Acid Repetitions in the Dihydropteroate Synthase of *Streptococcus pneumonae* Lead to Sulfonamide Resistance with Limited Effects on Substrate $K_m$," *Antimicrobial Agents and Chemotherapy* 45(3): 805-809 (2001).

Hoffman, J.A., et al., "Streptococcus pneumoniae Infections in the Neonate," *Pediatrics* 112(5): 1095-1102 (2003).

Jobling, M.G. and Holmes, R.K., "Analysis of structure and function of the B subunit of cholera toxin by the use of site-directed mutagenesis," *Molecular Microbiology* 5(7): 1755-1767 (1991).

Klugman, K.P., and Lonks, J.R., "Hidden Epidemic of Macrolide-resistant Pneumococci," *Emerging Infectious Diseases* 11(6): 802-807 (2005).

Lazar, E., et al., "Transforming Growth Factor ÿ: Mutation of Aspartic Acid 47 and Leucine 48 Results in Different Biological Activities," *Molecular and Cellular Biology* (3): 1247-1252 (1998).

López, R., "*Streptococcus pneumoniae* and its bacteriophages: one long argument," *International Microbiology* 7: 163-171 (2004).

Menzies, B.E., and Kernodle, D.S., "Site-Directed Mutagenesis of the Alpha-Toxin Gene of *Staphylococcus aureus*: Role of Histidines in Toxin Activity In Vitro and in a Murine Model," *Infection and Immunity* 62(5): 1843-1847 (1994).

Moelling, K., "DNA for Genetic Vaccination and Therapy," Abstract only, *Cytokines Cell Mol Ther.*, Jun. 1997, 3(2):127-135, Elsevier Science Ltd., New York, New York, USA.

Nishi, K., et al., "DNA Sequence and Complementation Analysis of a Mutation in the rp 1 X Gene from *Escherichia coli* Leading to Loss of Ribosomal Protein L24", Abstract only, *J. Bacteriol* , Sep. 1985, 163(3):890-894, American Society for Microbiology, Washington, DC, USA.

Parikh, S., et al., "Roles of Tyrosine 158 and Lysine 165 in the Catalytic Mechanism in InhA, the Enoyl-ACP Reductase from *Mycobacterium tuberculosis*," *Biochemistry* 38: 13623-13634 (1999).

Revised Interim Utility Guidelines Training Materials, United States Patent and Trademark Office (2001).

Rost, R., "Twilight Zone of Protein Sequence Alignments," *Protein Entineering*, 1999, 12(2):85-94, Oxford University Press, Cary, North Carolina, USA and Oxford, United Kingdom.

Rudinger, J., "Characteristics of the amino acids as components of a peptide hormone sequence." In *Peptide Hormones*, J.A. Parsons, ed. (University Park Press) pp. 1-7 (1976).

Russell, R.B., and Barton, G.J., "Structural Features can be Unconserved in Proteins with Similar Folds: An Analysis of Side-chain to Side-chain Contacts Secondary Structure and Accessibility," *J. Mol. Biol* 244: 332-350 (1994).

Smith, D.R., "Microbial Pathogen Genomes—New Strategies for Identifying Therapeutics and Vaccine Targets," *Tibtech*, Aug. 1996, 14:290-293, Elsevier Science Ltd., New York, New York, USA.

Stephens, C., et al., "Bacterial Protein Secretion—A Target for New Antibiotics?," Abstract only, *Chem Biol*, Sep. 1997, 4(9):637-641, Elsevier Science Ltd., New York, New York, USA.

Wells, T.N.C., and Peitsch, M., "The chemokine information source: identification and characterization of novel chemokines using the WorldWideWeb and Expressed Sequence Tag Databases," *Journal of Leukocyte Biology* 61: 545-551 (1997).

Willison, J.C, et al., "The *Escherichia coli* efg Gene and the *Rhodobacter capsulatus* adgA Gene Code for NH3-Dependent NAD Synthetase," Abstract only, *J. Bacteriol*, Jun. 1994, 176(11):3400-3402, American Society for Microbiology, Washington, DC, USA.

Wower, I.K., et al., "Ribosomal Protein L27 Participates in both 50 S Subunit Assembly and the Peptidyl Transferase Reaction," *J Biol Chem*, Jul. 1998, 273(31):19847-19852, American Society for Biochemistry and Molecular Biology, Bethesda, MD, USA.

AAT28529, Genbank, Apr. 1, 1997.
AAV52227, Genbank, Oct. 23, 1998.
Database sequence, Genbank acc. No. AAV52268, Oct. 23, 1998.
Database sequence, Genbank acc. No. AAV52490, Oct. 23, 1998.
Database sequence, Genbank acc. No. W65693, Jun. 11, 1996.
Database sequence, Genbank acc. No. AA025574, Aug. 14, 1996.
Database sequence, Genbank acc. No. X67663, Jul. 18, 1996.
Database sequence, Genbank acc. No. AAV42980, Nov. 8, 1998.
Database sequence, Genbank acc. No. AAZ96269, Apr. 10, 2000.
Database sequence, Genbank acc. No. AAX30819, May 20, 1999.
Database sequence, Genbank acc. No. AAZ96466, Apr. 10, 2000.
Database sequence, Genbank acc. NO. AAT98768, Nov. 10, 1998.
Database sequence, Genbank acc. No. AAZ96379, Apr. 10, 2000.
Database sequence, Genbank acc. No. AAV52231, Oct. 23, 1998.
Database sequence, Genbank acc. No. AAT98563, Nov. 6, 1998.
Database sequence, Genbank acc. No. AAT98628, Nov. 6, 1998.
L26052, Genbank, Aug. 3, 1994.
M15328, Genbank, Oct. 23, 1995.
M57624, Genbank, Apr. 26, 1993.
M81748, Genbank, Nov. 8, 1995.
T58840, Genbank, Feb. 9, 1995.
U66912, Genbank, Sep. 5, 1996.
X02656, Genbank, Feb. 18, 1992.
X16548, Genbank, Sep. 12, 1993.
X54994, Genbank, Jan. 15, 1993.
Z33011, Genbank, Aug. 18, 1995.

Plotkin, S.A., and Mortimer, E.A., "Vaccines," *New Technologies for Making Vaccines*, W.B. Saunders Company (Harcourt Brace Jovanovich, Inc.) pp. 571 (1988).

Camara et al., "A Neuraminidase from *Streptococcus pneumoniae* Has the Features of a Surface Protein," Infection and Immunity, 62(9), pp. 3688-3695 (1994).

Wizemann, et al., "Use of a Whole Genome Approach to Identify Vaccine Molecules Affording Protection against *Streptococcus pneumoniae* Infection," *Infection and Immunity*, 69(3):1593-1598 (Mar. 2001).

Attwood, Teresa K., "The Babel of Bioinformatics," *Science*, vol. 290, pp. 471-473 Oct. 20, 2000.

Haasum, et al., "Amino Acid Repetitions in the Dihydropteroate Synthase of *Streptococcus pneumoniae* Lead to Sulfonamide Resistance with Limited Effects on Substrate $K_m$," *Antimicrobial Agents and Chemotherapy*, 45(3):805-809 Mar. 2001.

Houghten, et al., "Relative Importance of Position and Individual Amino Acid Residues in Peptide Antigen-Antibody Interactions: implications in the Mechanism of Antigenic Drift and Antigenic Shift," *Vaccines, Edited by Fred Brown*, pp. 21-25 (1986), month of publication not available.

Lederman, et al., "A Single Amino Acid Substitution in a Common African Allele of the CD4 Molecule Ablates Binding of the Monoclonal Antibody, OKT4," *Molecular Immunology*, 28(11):1171-1181 (1991), month of publication not available.

Li, et al., "β-Endorphin Omission Analogs: Dissociation of Immunoreactivity from other Biological Activities," *Proc. Natl. Acad. Sci. USA*, 77(6):3211-3214 (1980), month of publication not available.

Menzies, et al., "Site-Driected Mutagenesis of the Alpha-Toxin Gene of Staphylococcus aureus: Role of Histidines in Toxin Activity in Vitro and in a Murine Model," *Infection and Immunity*, 62(5):1843-1847 May 1994.

Parikh, et al., "Roles of Tyrosine 158 and Lysine 165 in the Catalytic Mechanism of InhA, the Enoyl-ACP Reductase from *Mycobacterium tuberculosis*, " *Biochemistry*,38; 13623-13634 Revised Aug. 16, 1999.

Patentee's Observation in the Opposition against European Patent EP-B-0 942 983 with Exhibits A-D, dated May 5, 2008.

Opposition against European Patent EP-B-0 942 983, dated Sep. 20, 2007.

Sanchez-Beato, Ana R., et al., "Molecular characterization of PepA: a novel choline-binding protein of *Streptococcus pneumoniae*", *FEMS Microbiology Letters*, 164:207-214 (1998), month of publication not available.

Iannelli, Francesco, et al., "Allelic variation in the highly polymorphic locus *pspC* of *Streptococcccus pneumoniae*", *Gene*, 284:63-71 (2002), month of publication not available.

Kharat, Arun S., et al., "Inactivation of the *srtA*Gene Affects Localization of Surface Proteins and Decreases Adhesion of *Streptococcus pneumoniae* to Human Pharyngeal Cells In Vitro", *Infection and Immunity*, 71(5): 2758-2765 May 2003.

Philippsen, P., et al., "The nucleotide sequence of Saccaromyces cerevisiae chromosome XIV and its evolutionary implications", *Nature*, 387:93-8, May 29, 1997.

Pearce, B.J., et al., "Genetic Identification of exported proteins in Streptococcus pneumoniae", *Molecular Microbiol*, vol. 9, No. 5, pp. 1037-1050, XP002060149 Blackwell, Oxford, GB. 1993.

Comparison of SEQ ID No. 65 of the EPO942983 and SEQ ID No. 72 of U.S. Appl No. 60/029,960.

Comparison of SEQ ID No. 65 of EP0942983 and SEQ ID No. 34 of WO-A-96/08582.

Sequence SEQ ID No. 3858118 of WO 98/23631.

Sequence SEQ ID No. 1 of EP-A-0 893 502.

YnL224c—Protein of unknown function localised to cytoplasm and nucleus. Chromosome XIV/Exons: 227100-224797 (C) (2003). http:/mips.gsf.de/genre/proj/yeast/singleGeneReport.html?entry=YNL224c.

US 6,159,469, 12/2000, Choi et al. (withdrawn)

* cited by examiner

NUCLEIC ACID AND AMINO ACID SEQUENCES RELATING TO *STREPTOCOCCUS PNEUMONIAE* FOR DIAGNOSTICS AND THERAPEUTICS

RELATED APPLICATIONS

This application is a continuation of U.S. application Ser. No. 11/524,355 (now U.S. Pat. No. 7,405,291), filed Sep. 20, 2006, which is a continuation of U.S. application Ser. No. 11/027,892 filed Dec. 30, 2004, now U.S. Pat. No. 7,378,514 which is a continuation of U.S. application Ser. No. 10/640, 833, filed Aug. 14, 2003 (now abandoned), which is a continuation of U.S. application Ser. No. 09/583,110 (now U.S. Pat. No. 6,699,703), filed May 26, 2000, which is a continuation-in-part of U.S. application Ser. No. 09/107,433 (now U.S. Pat. No. 6,800,744), filed Jun. 30, 1998, which claims the benefit of U.S. Application No. 60/085,131, filed May 12, 1998 and of U.S. Application No. 60/051,553, filed Jul. 2, 1997. The entire teachings of the above applications are incorporated herein by reference.

INCORPORATION BY REFERENCE OF MATERIAL ON COMPACT DISK

This application incorporates by reference the Sequence Listing contained on the two compact disks (Copy 1 and Copy 2), filed concurrently herewith, containing the following file:

File name: 3687.1000-063 SequenceList.txt; created May 8, 2007, 8,145 KB in size.

This application also incorporates by reference Table 2 contained on the two compact disks (Copy 1 and Copy 2), filed concurrently herewith, containing the following file:

File name: Table2_2.txt; Nov. 30, 2006, 351 KB in size.

FIELD OF THE INVENTION

The invention relates to isolated nucleic acids and polypeptides derived from *Streptococcus pneumoniae* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

*Streptococcus pneumoniae* (*S. pneumoniae*) is a common, spherical, gram-positive bacterium. Worldwide it is a leading cause of illness among children, the elderly, and individuals with debilitating medical conditions (Breiman, R. F. et al., 1994, JAMA 271: 1831). *S. pneumoniae* is estimated to be the causal agent in 3,000 cases of meningitis, 50,000 cases of bacteremia, 500,000 cases of pneumonia, and 7,000,000 cases of otitis media annually in the United States alone (Reichler, M. R. et al., 1992, J. Infect. Dis. 166: 1346; Stool, S. E. and Field, M. J., 1989 Pediatr. Infect. Dis J. 8: S11). In the United States alone, 40,000 deaths result annually from *S. pneumoniae* infections (Williams, W. W. et al., 1988 Ann. Intern. Med. 108: 616) with a death rate approaching 30% from bacteremia (Butler, J. C. et al., 1993, JAMA 270: 1826). Pneumococcal pneumonia is a serious problem among the elderly of industrialized nations (Käyhty, H. and Eskola, J., 1996 Emerg. Infect. Dis. 2: 289) and is a leading cause of death among children in developing nations (Käyhty, H. and Eskola, J., 1996 Emerg. Infect. Dis. 2: 289; Stansfield, S. K., 1987 Pediatr. Infect. Dis. 6: 622).

Vaccines against *S. pneumoniae* have been available for a number of years. There are a large number of serotypes based on the polysaccharide capsule (van Dam, J. E., Fleer, A., and Snippe, H., 1990 Antonie van Leeuwenhoek 58: 1) although only a fraction of the serotypes seem to be associated with infections (Martin, D. R. and Brett, M. S., 1996 N. Z. Med. J. 109: 288). A multivalent vaccine against capsular polysaccharides of 23 serotypes (Smart, L. E., Dougall, A. J. and Gridwood, R. W., 1987 J. Infect. 14: 209) has provided protection for some groups but not for several groups at risk for pneumococcal infections, such as infants and the elderly (Mäkel, P. H. et al., 1980 Lancet 2: 547; Sankilampi, U., 1996 J. Infect. Dis. 173: 387). Conjugated pneumococcal capsular polysaccharide vaccines have somewhat improved efficacy, but are costly and, therefore, are not likely to be in widespread use (Käyhty, H. and Eskola, J., 1996 Emerg. Infect. Dis. 2: 289).

At one time, *S. pneumoniae* strains were uniformly susceptible to penicillin. The report of a penicillin-resistant strain of (Hansman, D. and Bullen, M. M., 1967 Lancet 1: 264) was followed rapidly by many reports indicating the worldwide emergence of penicillin-resistant and penicillin non-susceptible strains (Klugman, K. P., 1990 Clin. Microbiol. Rev. 3: 171). *S. pneumoniae* strains which are resistant to multiple antibiotics (including penicillin) have also been observed recently within the United States (Welby, P. L., 1994 Pediatr. Infect. Dis. J. 13: 281; Ducin, J. S. et al., 1995 Pediatr. Infect. Dis. J. 14: 745; Butler, J. C., 1996 J. Infect. Dis. 174: 986) as well as internationally (Boswell, T. C. et al., 1996; J. Infect. 33: 17; Catchpole, C., Fraise, A., and Wise, R., 1996 Microb. Drug Resist. 2: 431; Tarasi, A. et al., 1997 Microb. Drug Resist. 3: 105).

A high incidence of morbidity is associated with invasive *S. pneumoniae* infections (Williams, W. W. et al., 1988 Ann. Intern. Med. 108: 616). Because of the incomplete effectiveness of currently available vaccines and antibiotics, the identification of new targets for antimicrobial therapies, including, but not limited to, the design of vaccines and antibiotics, which may help prevent infection or that may be useful in fighting existing infections, is highly desirable.

SUMMARY OF THE INVENTION

The present invention fulfills the need for diagnostic tools and therapeutics by providing bacterial-specific compositions and methods for detecting, treating, and preventing bacterial infection, in particular *S. pneumoniae* infection.

The present invention encompasses isolated polypeptides and nucleic acids derived from *S. pneumoniae* that are useful as reagents for diagnosis of bacterial infection, components of effective antibacterial vaccines, and/or as targets for antibacterial drugs, including anti-*S. pneumoniae* drugs. The nucleic acids and peptides of the present invention also have utility for diagnostics and therapeutics for *S. pneumoniae* and other *Streptococcus* species. They can also be used to detect the presence of *S. pneumoniae* and other *Streptococcus* species in a sample; and in screening compounds for the ability to interfere with the *S. pneumoniae* life cycle or to inhibit *S. pneumoniae* infection. More specifically, this invention features compositions of nucleic acids corresponding to entire coding sequences of *S. pneumoniae* proteins, including surface or secreted proteins or parts thereof, nucleic acids capable of binding mRNA from *S. pneumoniae* proteins to block protein translation, and methods for producing *S. pneumoniae* proteins or parts thereof using peptide synthesis and recombinant DNA techniques. This invention also features antibodies and nucleic acids useful as probes to detect *S.*

*pneumoniae* infection. In addition, vaccine compositions and methods for the protection or treatment of infection by *S. pneumoniae* are within the scope of this invention.

The nucleotide sequences provided in SEQ ID NO: 1-SEQ ID NO: 2661 and SEQ ID NO 5325, a fragment thereof, or a nucleotide sequence at least 99.5% identical to a sequence contained within SEQ ID NO: 1-SEQ ID NO: 2661 and SEQ ID NO: 5325 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1-SEQ ID NO: 2661 and SEQ ID NO: 5325, a fragment thereof, or a nucleotide sequence at least 99.5% identical to a sequence contained within SEQ ID NO: 1-SEQ ID NO: 2661 and SEQ ID NO: 5325. Uses for and methods for providing nucleotide sequences in a variety of media is well known in the art (see e.g., EPO Publication No. EP 0 756 006)

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1-SEQ ID NO: 2661 and SEQ ID NO: 5325, a fragment thereof, or a nucleotide sequence at least 99.5% identical to a sequence contained within SEQ ID NO: 1-SEQ ID NO: 2661 and SEQ ID NO: 5325 in computer readable form, a person skilled in the art can routinely access the sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI toolbox" (National Center for Biotechnology Information).

Computer algorithms enable the identification of *S. pneumoniae* open reading frames (ORFs) within SEQ ID NO: 1-SEQ ID NO: 2661 and SEQ ID NO: 5325 which contain homology to ORFs or proteins from other organisms. Examples of such similarity-search algorithms include the BLAST [Altschul et al., J. Mol. Biol. 215:403-410 (1990)] and Smith-Waterman [Smith and Waterman (1981) Advances in Applied Mathematics, 2:482-489] search algorithms. These algorithms are utilized on computer systems as exemplified below. The ORFs so identified represent protein encoding fragments within the *S. pneumoniae* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *S. pneumoniae* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *S. pneumoniae* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software include, but is not limited to, FASTA (GCG Wisconsin Package), Bic_SW (Compugen Bioccelerator, BLASTN2, BLASTP2 and BLASTX2 (NCBI) and Motifs (GCG). BLASTN2, A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *S. pneumoniae* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *S. pneumoniae* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *S. pneumoniae* genome. In the present examples, implementing software which implement the BLASTP2 and bic_SW algorithms (Altschul et al., J. Mol. Biol. 215:403-410 (1990); Compugen Biocellerator) was used to identify open reading frames within the *S. pneumoniae* genome. A person skilled in the art can readily recognize that any one of the publicly available homology search programs can be used as the search means for the computer-based systems of the present invention.

The invention features *S. pneumoniae* polypeptides, preferably a substantially pure preparation of an *S. pneumoniae* polypeptide, or a recombinant *S. pneumoniae* polypeptide. In preferred embodiments: the polypeptide has biological activity; the polypeptide has an amino acid sequence at least 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least 5, 10, 20, 50, 100, or 150 amino acid residues in length; the polypeptide includes at least 5, preferably at least 10, more preferably at least 20, more preferably at least 50, 100, or 150 contiguous amino acid residues of the invention contained in the Sequence Listing. In yet another preferred embodiment, the amino acid sequence which differs in sequence identity by about 7% to about 8% from the *S. pneumoniae* amino acid sequences of the invention contained in the Sequence Listing is also encompassed by the invention.

In preferred embodiments: the *S. pneumoniae* polypeptide is encoded by a nucleic acid of the invention contained in the Sequence Listing, or by a nucleic acid having at least 60%, 70%, 80%, 90%, 95%, 98%, or 99% homology with a nucleic acid of the invention contained in the Sequence Listing.

In a preferred embodiment, the subject *S. pneumoniae* polypeptide differs in amino acid sequence at 1, 2, 3, 5, 10 or more residues from a sequence of the invention contained in the Sequence Listing. The differences, however, are such that the *S. pneumoniae* polypeptide exhibits an *S. pneumoniae* biological activity, e.g., the *S. pneumoniae* polypeptide retains a biological activity of a naturally occurring *S. pneumoniae* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *S. pneumoniae* polypeptide is a recombinant fusion protein having a first *S. pneumoniae* polypeptide portion and a second polypeptide portion, e.g., a second polypeptide portion having an amino acid sequence unrelated to *S. pneumoniae*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *S. pneumoniae* polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the *S. pneumoniae* encoded polypeptide exhibits a *S. pneumoniae* biological activity, e.g., the encoded *S. pneumoniae* enzyme retains a biological activity of a naturally occurring *S. pneumoniae*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *S. pneumoniae* strain, 14453, from which genomic sequences have been sequenced, has been deposited on Jun. 26, 1997 in the American Type Culture Collection, 10801 University Blvd., Manassas, Va. 20110-2209, and assigned the ATCC designation # 55987.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1-6.3.6, hereby incorporated by reference); and, polypeptides specifically bound by antisera to *S. pneumoniae* polypeptides, especially by antisera to an active site or binding domain of *S. pneumoniae* polypeptide. The invention also includes fragments, preferably biologically active fragments. These and other polypeptides are also referred to herein as *S. pneumoniae* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *S. pneumoniae* nucleic acid will include a transcriptional regulatory sequence, e.g. at least one of a transcriptional promoter or transcriptional enhancer sequence, operably linked to the *S. pneumoniae* gene sequence, e.g., to render the *S. pneumoniae* gene sequence suitable for expression in a recombinant host cell.

In yet a further preferred embodiment, the nucleic acid which encodes an *S. pneumoniae* polypeptide of the invention, hybridizes under stringent conditions to a nucleic acid probe corresponding to at least 8 consecutive nucleotides of the invention contained in the Sequence Listing; more preferably to at least 12 consecutive nucleotides of the invention contained in the Sequence Listing; more preferably to at least 20 consecutive nucleotides of the invention contained in the Sequence Listing; more preferably to at least 40 consecutive nucleotides of the invention contained in the Sequence Listing.

In another aspect, the invention provides a substantially pure nucleic acid having a nucleotide sequence which encodes an *S. pneumoniae* polypeptide. In preferred embodiments: the encoded polypeptide has biological activity; the encoded polypeptide has an amino acid sequence at least 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least 5, 10, 20, 50, 100, or 150 amino acids in length; the encoded polypeptide comprises at least 5, preferably at least 10, more preferably at least 20, more preferably at least 50, 100, or 150 contiguous amino acids of the invention contained in the Sequence Listing.

In another aspect, the invention encompasses: a vector including a nucleic acid which encodes an *S. pneumoniae* polypeptide or an *S. pneumoniae* polypeptide variant as described herein; a host cell transfected with the vector; and a method of producing a recombinant *S. pneumoniae* polypeptide or *S. pneumoniae* polypeptide variant; including culturing the cell, e.g., in a cell culture medium, and isolating an *S. pneumoniae* polypeptide or an *S. pneumoniae* polypeptide variant, e.g., from the cell or from the cell culture medium.

In another series of embodiments, the invention provides isolated nucleic acids comprising sequences at least about 8 nucleotides in length, more preferably at least about 12 nucleotides in length, and most preferably at least about 15-20 nucleotides in length, that correspond to a subsequence of any one of SEQ ID NO: 1-SEQ ID NO: 2661 and SEQ ID NO: 5325 or complements thereof. Alternatively, the nucleic acids comprise sequences contained within any ORF (open reading frame), including a complete protein-coding sequence, of which any of SEQ ID NO: 1-SEQ ID NO: 2661 and SEQ ID NO: 5325 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least 50%, 60%, 70%, 80%, 90%, 95%, 98%, or 99% homology with a sequence of the invention contained in the Sequence Listing.

In another aspect, the invention features nucleic acids capable of binding mRNA of *S. pneumoniae*. Such nucleic acid is capable of acting as antisense nucleic acid to control the translation of mRNA of *S. pneumoniae*. A further aspect features a nucleic acid which is capable of binding specifically to an *S. pneumoniae* nucleic acid. These nucleic acids are also referred to herein as complements and have utility as probes and as capture reagents.

In another aspect, the invention features an expression system comprising an open reading frame corresponding to *S. pneumoniae* nucleic acid. The nucleic acid further comprises a control sequence compatible with an intended host. The expression system is useful for making polypeptides corresponding to *S. pneumoniae* nucleic acid.

In another aspect, the invention features a cell transformed with the expression system to produce *S. pneumoniae* polypeptides.

In yet another embodiment, the invention encompasses reagents for detecting bacterial infection, including *S. pneumoniae* infection, which comprise at least one *S. pneumoniae*-derived nucleic acid defined by any one of SEQ ID NO: 1-SEQ ID NO: 2661 and SEQ ID NO: 5325, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1-SEQ ID NO: 2661 and SEQ ID NO: 5325, or polypeptide sequences contained within any of SEQ ID NO: 2662-SEQ ID NO: 5322 and SEQ ID NO: 5326, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *S. pneumoniae*-derived immunogenic component, wherein the immunogenic component comprises one or more of the polypeptides encoded by any one of SEQ ID NO: 1-SEQ ID NO: 2661 and SEQ ID NO: 5325 or sequence-conservative or function-conservative variants thereof; or polypeptides that are contained within any ORFs, including complete protein-coding sequences, of which any of SEQ ID NO: 1-SEQ ID NO: 2661 and SEQ ID NO: 5325 forms a part; or polypeptide sequences contained within any of SEQ ID NO: 2662-SEQ ID NO: 5322 and SEQ ID NO: 5326; or polypeptides of which any of SEQ ID NO: 2662-SEQ ID NO: 5322 and SEQ ID NO: 5326 forms a part. Host animals include any warm blooded animal, including without limitation mammals and birds. Such antibodies have utility as reagents for immunoassays to evaluate the abundance and distribution of *S. pneumoniae*-specific antigens.

In yet another aspect, the invention provides a method for detecting bacterial antigenic components in a sample, which comprises the steps of: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1-SEQ ID NO: 2661 and SEQ ID NO: 5325 or sequence-conservative or function-conservative variants thereof, or against a polypeptide sequence contained in any of SEQ ID NO: 2662-SEQ ID NO: 5322 and SEQ ID NO: 5326 or function-conservative variants thereof.

In yet another aspect, the invention provides a method for detecting antibacterial-specific antibodies in a sample, which comprises: (i) contacting a sample suspected to contain antibacterial-specific antibodies with a *S. pneumoniae* antigenic component, under conditions in which a stable antigen-antibody complex can form between the *S. pneumoniae* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1-SEQ ID NO: 2661 and SEQ ID NO: 5325 or sequence-conservative and function-conservative variants thereof, or is a polypeptide sequence contained in any of SEQ ID NO: 2662-SEQ ID NO: 5322 and SEQ ID NO: 5326 or function-conservative variants thereof.

In another aspect, the invention features a method of generating vaccines for immunizing an individual against *S. pneumoniae*. The method includes: immunizing a subject with an *S. pneumoniae* polypeptide, e.g., a surface or secreted polypeptide, or active portion thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind an *S. pneumoniae* polypeptide. The method includes: contacting the candidate compound with an *S. pneumoniae* polypeptide and determining if the compound binds or otherwise interacts with an *S. pneumoniae* polypeptide. Compounds which bind *S. pneumoniae* are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind an *S. pneumoniae* nucleic acid, e.g., DNA or RNA. The method includes: contacting the candidate compound with an *S. pneumoniae* nucleic acid and determining if the compound binds or otherwise interacts with an *S. pneumoniae* polypeptide. Compounds which bind *S. pneumoniae* are candidates as activators or inhibitors of the bacterial life cycle. These assays can be performed in vitro or in vivo.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1-SEQ ID NO: 5326. Use of the terms "SEQ ID NO: 1-SEQ ID NO: 2661 and SEQ ID NO: 5325", "SEQ ID NO: 2662-SEQ ID NO: 5322 and SEQ ID NO: 5326", "the sequences depicted in Table 2", etc., is intended, for convenience, to refer to each individual SEQ ID NO individually, and is not intended to refer to the genus of these sequences. In other words, it is a shorthand for listing all of these sequences individually. The invention encompasses each sequence individually, as well as any combination thereof.

DEFINITIONS

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "*S. pneumoniae*-derived" nucleic acid or polypeptide sequence may or may not be present in other bacterial species, and may or may not be present in all *S. pneumoniae* strains. This term is intended to refer to the source from which the sequence was originally isolated. Thus, a *S. pneumoniae*-derived polypeptide, as used herein, may be used, e.g., as a target to screen for a broad spectrum antibacterial agent, to search for homologous proteins in other species of bacteria or in eukaryotic organisms such as fungi and humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *S. pneumoniae* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region usually represents the total coding region for the polypeptide and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop codon at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitrocellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.), require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has S. pneumoniae biological activity if it has one, two and preferably more of the following properties: (1) if when expressed in the course of an S. pneumoniae infection, it can promote, or mediate the attachment of S. pneumoniae to a cell; (2) it has an enzymatic activity, structural or regulatory function characteristic of an S. pneumoniae protein; (3) or the gene which encodes it can rescue a lethal mutation in an S. pneumoniae gene. A polypeptide has biological activity if it is an antagonist, agonist, or superagonist of a polypeptide having one of the above-listed properties.

A biologically active fragment or analog is one having an in vivo or in vitro activity which is characteristic of the S. pneumoniae polypeptides of the invention contained in the Sequence Listing, or of other naturally occurring S. pneumoniae polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO cells. Because peptides such as S. pneumoniae polypeptides often exhibit a range of physiological properties and because such properties may be attributable to different portions of the molecule, a useful S. pneumoniae fragment or S. pneumoniae analog is one which exhibits a biological activity in any biological assay for S. pneumoniae activity. Most preferably the fragment or analog possesses 10%, preferably 40%, more preferably 60%, 70%, 80% or 90% or greater of the activity of S. pneumoniae, in any in vivo or in vitro assay.

Analogs can differ from naturally occurring S. pneumoniae polypeptides in amino acid sequence or in ways that do not involve sequence, or both. Non-sequence modifications include changes in acetylation, methylation, phosphorylation, carboxylation, or glycosylation. Preferred analogs include S. pneumoniae polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the S. pneumoniae polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |

TABLE 1-continued

CONSERVATIVE AMINO ACID REPLACEMENTS

| For Amino Acid | Code | Replace with any of |
|---|---|---|
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *S. pneumoniae* analog, will ordinarily be at least about 20 residues, more typically at least about 40 residues, preferably at least about 60 residues in length. Fragments of *S. pneumoniae* polypeptides can be generated by methods known to those skilled in the art. The ability of a candidate fragment to exhibit a biological activity of *S. pneumoniae* polypeptide can be assessed by methods known to those skilled in the art as described herein. Also included are *S. pneumoniae* polypeptides containing residues that are not required for biological activity of the peptide or that result from alternative mRNA splicing or alternative protein processing events.

An "immunogenic component" as used herein is a moiety, such as an *S. pneumoniae* polypeptide, analog or fragment thereof, that is capable of eliciting a humoral and/or cellular immune response in a host animal.

An "antigenic component" as used herein is a moiety, such as an *S. pneumoniae* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *S. pneumoniae* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of decreased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isolated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning*; and *Gene Transfer Vectors for Mammalian Cells*, 1987 (J. H. Miller and M. P. Calos eds., Cold Spring Harbor Laboratory).

Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

S. pneumoniae Genomic Sequence

This invention provides nucleotide sequences of the genome of *S. pneumoniae* which thus comprises a DNA sequence library of *S. pneumoniae* genomic DNA. The detailed description that follows provides nucleotide sequences of *S. pneumoniae*, and also describes how the sequences were obtained and how ORFs and protein-coding sequences were identified. Also described are methods of using the disclosed *S. pneumoniae* sequences in methods including diagnostic and therapeutic applications. Furthermore, the library can be used as a database for identification and comparison of medically important sequences in this and other strains of *S. pneumoniae*.

To determine the genomic sequence of *S. pneumoniae*, DNA was isolated from strain 14453 of *S. pneumoniae* and mechanically sheared by nebulization to a median size of 2 kb. Following size fractionation by gel electrophoresis, the fragments were blunt-ended, ligated to adapter oligonucleotides, and cloned into each of 20 different pMPX vectors (Rice et al., abstracts of Meeting of Genome Mapping and Sequencing, Cold Spring Harbor, N.Y., May 11-15, 1994, p. 225) and the PUC19 vector to construct a series of "shotgun" subclone libraries.

DNA sequencing was achieved using two sequencing methods. The first method used multiplex sequencing procedures essentially as disclosed in Church et al., 1988, *Science* 240:185; U.S. Pat. Nos. 4,942,124 and 5,149,625). DNA was extracted from pooled cultures and subjected to chemical or enzymatic sequencing. Sequencing reactions were resolved by electrophoresis, and the products were transferred and covalently bound to nylon membranes. Finally, the membranes were sequentially hybridized with a series of labelled oligonucleotides complimentary to "tag" sequences present in the different shotgun cloning vectors. In this manner, a large number of sequences could be obtained from a single set of sequencing reactions. The remainder of the sequencing was performed on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3-4 kb.

A variety of approaches are used to order the contigs so as to obtain a continuous sequence representing the entire *S. pneumoniae* genome. Synthetic oligonucleotides are designed that are complementary to sequences at the end of each contig. These oligonucleotides may be hybridized to libaries of *S. pneumoniae* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *S. pneumoniae* sequences were analyzed for the presence of open reading frames (ORFs) comprising at least 180 nucleotides. As a result of the initial analysis of ORFs based on stop-to-stop codon reads, it should be understood that these ORFs may not correspond to the ORF of a naturally-occurring *S. pneumoniae* polypeptide. These ORFs may contain start codons which indicate the initiation of protein synthesis of a naturally-occurring *S. pneumoniae* polypeptide. Such start codons within the ORFs provided herein can be identified by those of ordinary skill in the relevant art, and the resulting ORF and the encoded *S. pneumoniae* polypeptide is within the scope of this invention. For example, within the ORFs a codon such as AUG or GUG (encoding methionine or valine) which is part of the initiation signal for protein synthesis can be identified and the portion of an ORF to corresponding to a naturally-occurring *S. pneumoniae* polypeptide can be recognized.

The second analysis of the ORFs included identifying the start codons and the predicted coding regions. These ORFs provided in this invention were defined by one or more of the following methods: evaluating the coding potential of such sequences with the program GENEMARK™ (Borodovsky and McIninch, 1993, *Comp*. 17:123), distinguishing the coding from noncoding regions using the program Glimmer (Fraser et al, *Nature*, 1997), determining codon usage (Staden et al., *Nucleic Acid Research* 10: 141), and each predicted ORF amino acid sequence was compared with all protein sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403-410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage are likely to encode proteins and are encompassed by the invention.

S. pneumoniae Nucleic Acids

The nucleic acids of this invention may be obtained directly from the DNA of the above referenced *S. pneumoniae* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR can be used to ensure a faithful DNA copy prior to expression. In addition, the authenticity of amplified products can be verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *S. pneumoniae* polypeptides from a cDNA library in accordance with protocols herein described. A cDNA encoding an *S. pneumoniae* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *S. pneumoniae* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *S. pneumoniae*. With the sequence information set forth in the present application, sequences of twenty or more nucleotides are identified which provide the desired inclusivity and exclusivity with respect to *S. pneumoniae*, and extraneous nucleic acids likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Streptococcus* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *S. pneumoniae* nucleic acid from the nucleic acid of each other and other organisms. Nucleic acid having twenty or more nucleotides in a sequence of the invention contained in the Sequence Listing can also have utility to separate other *Streptococcus* species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *S. pneumoniae* nucleic acid. These nucleic acids may also have utility as primers for the amplification of nucleic acids in other *Streptococcus* species. With respect to polymerase chain reaction (PCR) techniques, nucleic acid sequences of ≧10-15 nucleotides of the invention contained in the Sequence Listing have utility in conjunction with suitable enzymes and reagents to create copies of *S. pneumoniae* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *S. pneumoniae* and/or other *Streptococcus* species. The copies can also be incorporated into cloning and expression vectors to generate polypeptides corresponding to the nucleic acid synthesized by PCR, as is described in greater detail herein.

Antisense

Nucleic acid or nucleic acid-hybridizing derivatives isolated or synthesized in accordance with the sequences described herein have utility as antisense agents to prevent the expression of *S. pneumoniae* genes. These sequences also have utility as antisense agents to prevent expression of genes of other *Streptococcus* species.

In one embodiment, nucleic acid or derivatives corresponding to *S. pneumoniae* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *S. pneumoniae* that are useful as reagents for diagnosis of bacterial infection, components of effective antibacterial vaccines, and/or as targets for antibacterial drugs, including anti-*S. pneumoniae* drugs.

Expression of *S. pneumoniae* Nucleic Acids

Table 2 provides a list of open reading frames (ORFs) in both strands. An ORF is a region of nucleic acid which encodes a polypeptide. This region normally represents a complete coding sequence or a total sequence and was determined from an initial analysis of stop to stop codons followed by the prediction of start codons. The first column lists the ORF designation. The second and third columns list the SEQ ID numbers for the nucleic acid and amino acid sequences corresponding to each ORF, respectively. The fourth and fifth columns list the length of the nucleic acid ORF and the length of the amino acid ORF, respectively. Most of the nucleotide sequences corresponding to each ORF begin at the first nucleotide of the start codon and end at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified rapidly and efficiently because only a few codons need be tested. It is recognized that the translational machinery in bacteria initiates most polypeptide chains with the amino acid methionine. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description field. Specifically, the sixth column represents the "Score" for the match (a higher score is a better match), and the seventh column represents the "P-value" for the match (the probability that such a match could have occurred by chance; the lower the value, the more likely the match is valid). If a BLASTP2 score of less than 46 was obtained, no value is reported in the table the "P-value". The description field provides, where available, the accession number (AC) or the Swissprot accession number (SP), the locus name (LN), Superfamily Classification (CL), the Organism (OR), Source of variant (SR), E.C. number (EC), the gene name (GN), the product name (PN), the Function Description (FN), the Map Position (MP), Left End (LE), Right End (RE), Coding Direction (DI), the Database from which the sequence originates (DB), and the description (DE) or notes (NT) for each ORF. This information allows one of ordinary skill in the art to determine a potential use and function for each identified coding sequence and, as a result, allows the use of the polypeptides of the present invention for commercial and industrial purposes.

Using the information provided in SEQ ID NO: 1-SEQ ID NO: 2661 and SEQ ID NO: 5325 and in Table 2 together with routine cloning and sequencing methods, one of ordinary skill in the art will be able to clone and sequence all the nucleic acid fragments of interest including open reading frames (ORFs) encoding a large variety proteins of *S. pneumoniae*.

Nucleic acid isolated or synthesized in accordance with the sequences described herein have utility to generate polypeptides. The nucleic acid of the invention exemplified in SEQ ID NO: 1-SEQ ID NO: 2661 and SEQ ID NO: 5325 and in Table 2 or fragments of said nucleic acid encoding active portions of *S. pneumoniae* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, *Methanobacterium* strains or other Archaea, and Eubacteria such as *E. coli*, *B. subtilis*, *S. aureus*, *S. pneumonia* or *Pseudomonas putida*. In some cases the expression host will utilize the natural *S. pneumoniae* promoter whereas in others, it will be necessary to drive the gene with a promoter sequence derived from the expressing organism (e.g., an *E. coli* beta-galactosidase promoter for expression in *E. coli*).

To express a gene product using the natural *S. pneumoniae* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. For example, an *S. pneumoniae* polypeptide can be expressed in bacterial cells such as *E. coli* or *B. subtilis*, insect cells (baculovirus), yeast, or mammalian cells such as Chinese hamster ovary cell (CHO). Other suitable host cells are known to those skilled in the art.

Expression in eucaryotic cells such as mammalian, yeast, or insect cells can lead to partial or complete glycosylation and/or formation of relevant inter- or intra-chain disulfide bonds of a recombinant peptide product. Examples of vectors for expression in yeast *S. cerivisae* include pYepSec1 (Baldari. et al., (1987) *Embo J.* 6:229-234), pMFa (Kurjan and Herskowitz, (1982) *Cell* 30:933-943), pJRY88 (Schultz et al., (1987) *Gene* 54:113-123), and pYES2 (Invitrogen Corporation, San Diego, Calif.). Baculovirus vectors available for expression of proteins in cultured insect cells (SF 9 cells) include the pAc series (Smith et al., (1983) *Mol. Cell. Biol.* 3:2156-2165) and the pVL series (Lucklow, V. A., and Summers, M. D., (1989) *Virology* 170:31-39). Generally, COS cells (Gluzman, Y., (1981) Cell 23:175-182) are used in conjunction with such vectors as pCDM 8 (Aruffo, A. and Seed, B., (1987) *Proc. Natl. Acad. Sci. USA* 84:8573-8577) for transient amplification/expression in mammalian cells, while CHO (dhfr⁻ Chinese Hamster Ovary) cells are used with vectors such as pMT2PC (Kaufman et al. (1987), *EMBO J.* 6:187-195) for stable amplification/expression in mammalian cells. Vector DNA can be introduced into mammalian cells via conventional techniques such as calcium phosphate or calcium chloride co-precipitation, DEAE-dextran-mediated transfection, or electroporation. Suitable methods for transforming host cells can be found in Sambrook et al. (*Molecular Cloning: A Laboratory Manual,* 2nd Edition, Cold Spring Harbor Laboratory press (1989)), and other laboratory textbooks.

Expression in procaryotes is most often carried out in *E. coli* with either fusion or non-fusion inducible expression vectors. Fusion vectors usually add a number of $NH_2$ terminal amino acids to the expressed target gene. These $NH_2$ terminal amino acids often are referred to as a reporter group or an affinity purification group. Such reporter groups usually serve two purposes: 1) to increase the solubility of the target recombinant protein; and 2) to aid in the purification of the target recombinant protein by acting as a ligand in affinity purification. Often, in fusion expression vectors, a proteolytic cleavage site is introduced at the junction of the reporter group and the target recombinant protein to enable separation of the target recombinant protein from the reporter group subsequent to purification of the fusion protein. Such enzymes, and their cognate recognition sequences, include Factor Xa, thrombin and enterokinase. Typical fusion expression vectors include pGEX (Amrad Corp., Melbourne, Australia), pMAL (New England Biolabs, Beverly, Mass.) and pRIT5 (Pharmacia, Piscataway, N.J.) which fuse glutathione S-transferase, maltose E binding protein, or protein A, respectively, to the target recombinant protein. A preferred reporter group is poly (His), which may be fused to the amino or carboxy terminus of the protein and which renders the recombinant fusion protein easily purifiable by metal chelate chromatography.

Inducible non-fusion expression vectors include pTrc (Amann et al., (1988) Gene 69:301-315) and pET11d (Studier et al., *Gene Expression Technology: Methods in Enzymology* 185, Academic Press, San Diego, Calif. (1990) 60-89). While target gene expression relies on host RNA polymerase transcription from the hybrid trp-lac fusion promoter in pTrc, expression of target genes inserted into pET11d relies on transcription from the T7 gn10-lac 0 fusion promoter mediated by coexpressed viral RNA polymerase (T7 gn1). This viral polymerase is supplied by host strains BL21 (DE3) or HMS174(DE3) from a resident λ prophage harboring a T7 gn1 under the transcriptional control of the lacUV 5 promoter.

For example, a host cell transfected with a nucleic acid vector directing expression of a nucleotide sequence encoding an *S. pneumoniae* polypeptide can be cultured under appropriate conditions to allow expression of the polypeptide to occur. The polypeptide may be secreted and isolated from a mixture of cells and medium containing the peptide. Alternatively, the polypeptide may be retained cytoplasmically and the cells harvested, lysed and the protein isolated. A cell culture includes host cells, media and other byproducts. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Several different criteria are used for choosing a detergent suitable for solubilizing these complexes. For example, one property considered is the ability of the detergent to solubilize the *S. pneumoniae* protein within the membrane fraction at minimal denaturation of the membrane-associated protein allowing for the activity or functionality of the membrane-associated protein to return upon reconstitution of the protein. Another property considered when selecting the detergent is the critical micelle concentration (CMC) of the detergent in that the detergent of choice preferably has a high CMC value allowing for ease of removal after reconstitution. A third property considered when selecting a detergent is the hydrophobicity of the detergent. Typically, membrane-associated proteins are very hydrophobic and therefore detergents which are also hydrophobic, e.g., the triton series, would be useful for solubilizing the hydrophobic proteins. Another property important to a detergent can be the capability of the detergent to remove the *S. pneumoniae* protein with minimal protein-protein interaction facilitating further purification. A fifth property of the detergent which should be considered is the charge of the detergent. For example, if it is desired to use ion exchange resins in the purification process then preferably detergent should be an uncharged detergent. Chromatographic techniques which can be used in the final purification step are known in the art and include hydrophobic interaction, lectin affinity, ion exchange, dye affinity and immunoaffinity.

One strategy to maximize recombinant *S. pneumoniae* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy would be to alter the nucleic acid encoding an *S. pneumoniae* peptide to be inserted into an expression vector so that the individual codons for each amino acid would be those preferentially utilized in highly expressed *E. coli* proteins (Wada et al., (1992) *Nuc. Acids Res.* 20:2111-2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *S. pneumoniae*-derived nucleic acid sequences. The libraries provide probes, primers, and markers which can be used as markers in epidemiological studies. The present invention also provides a library of *S. pneumoniae*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1-SEQ ID NO: 2661 and SEQ ID NO: 5325. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 2662-SEQ ID NO: 5322 and SEQ ID NO: 5326 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

In certain embodiments, the invention encompasses isolated nucleic acid fragments comprising all or part of the individual nucleic acid sequences disclosed herein. The fragments are at least about 8 nucleotides in length, preferably at least about 12 nucleotides in length, and most preferably at least about 15-20 nucleotides in length.

The nucleic acids may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. pneumoniae* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *S. pneumoniae*-derived sequences or derivatives or fragments thereof. A large number of vectors, including plasmid and fungal vectors, have been described for replication and/or expression in a variety of eukaryotic and prokaryotic hosts, and may be used for gene therapy as well as for simple cloning or protein expression.

The encoded *S. pneumoniae* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *S. pneumoniae* coding sequences may be synthesized by standard methods, isolated from natural sources, or prepared as hybrids, etc. Ligation of the *S. pneumoniae* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, fungal infection, microinjection, microprojectile, or other established methods.

Appropriate host cells include bacteria, archebacteria, fungi, especially yeast, and plant and animal cells, especially mammalian cells. Of particular interest are *S. pneumoniae*, *E. coli*, *B. Subtilis*, *Saccharomyces cerevisiae*, *Saccharomyces carlsbergensis*, *Schizosaccharomyces pombi*, SF9 cells, C129 cells, 293 cells, *Neurospora*, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *S. pneumoniae*-derived peptides and polypeptides.

Advantageously, vectors may also include a transcription regulatory element (i.e., a promoter) operably linked to the *S. pneumoniae* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *S. pneumoniae*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *S. pneumoniae*-derived peptides or polypeptides.

Identification and Use of *S. pneumoniae* Nucleic Acid Sequences

The disclosed *S. pneumoniae* polypeptide and nucleic acid sequences, or other sequences that are contained within ORFs, including complete protein-coding sequences, of which any of the disclosed *S. pneumoniae*-specific sequences forms a part, are useful as target components for diagnosis and/or treatment of *S. pneumoniae*-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *S. pneumoniae* DNA as template; this is followed by sequencing the amplified product. The isolated nucleic acid encoding the disclosed sequence, or fragments thereof, can also be hybridized to *S. pneumoniae* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *S. pneumoniae*

The disclosed *S. pneumoniae* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *S. pneumoniae*. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed *S. pneumoniae* sequences with previously reported sequences present in publicly available databases is useful for identifying functional *S. pneumoniae* nucleic acid and polypeptide sequences. It will be understood that protein-coding sequences, for example, may be compared as a whole, and that a high degree of sequence homology between two proteins (such as, for example, >80-90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein:protein interactions, etc. These consensus sequences may be quite short and thus may represent only a fraction of the entire protein-coding sequence. Identification of such a feature in an *S. pneumoniae* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *S. pneumoniae* proteins identified as containing putative signal sequences and/or transmembrane domains are useful as immunogenic components of vaccines.

Targets for therapeutic drugs according to the invention include, but are not limited to, polypeptides of the invention, whether unique to *S. pneumoniae* or not, that are essential for growth and/or viability of *S. pneumoniae* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479-6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different *S. pneumoniae* strains, it is believed that the presently disclosed *S. pneumoniae* sequences are useful for identifying, and/or discriminating between, previously known and new *S. pneumoniae* strains. It is believed that other *S. pneumoniae* strains will exhibit at least 70% sequence homology with the presently disclosed sequence. Systematic and routine analyses of DNA sequences derived from samples containing *S. pneumoniae* strains, and comparison with the present sequence allows for the identification of sequences that can be used to discriminate between strains, as well as those that are common to all *S. pneumoniae* strains. In one embodiment, the invention provides nucleic acids, including probes, and peptide and polypeptide sequences that discriminate between different strains of *S. pneumoniae*. Strain-specific components can also be identified functionally by their ability to elicit or react with antibodies that selectively recognize one or more *S. pneumoniae* strains.

In another embodiment, the invention provides nucleic acids, including probes, and peptide and polypeptide sequences that are common to all *S. pneumoniae* strains but are not found in other bacterial species.

*S. pneumoniae* Polypeptides

This invention encompasses isolated *S. pneumoniae* polypeptides encoded by the disclosed *S. pneumoniae* genomic sequences, including the polypeptides of the invention contained in the Sequence Listing. Polypeptides of the invention are preferably at least 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *S. pneumoniae* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *S. pneumoniae* DNA as template; this is followed by sequencing the amplified product.

The polypeptides of the present invention, including function-conservative variants of the disclosed ORFs, may be isolated from wild-type or mutant *S. pneumoniae* cells, or from heterologous organisms or cells (including, but not limited to, bacteria, fungi, insect, plant, and mammalian cells) including *S. pneumoniae* into which a *S. pneumoniae*-derived protein-coding sequence has been introduced and expressed. Furthermore, the polypeptides may be part of recombinant fusion proteins.

*S. pneumoniae* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

The alpha-amino protecting groups are those known to be useful in the art of stepwise polypeptide synthesis. Included are acyl type protecting groups, e.g., formyl, trifluoroacetyl, acetyl, aromatic urethane type protecting groups, e.g., benzyloxycarbonyl (Cbz), substituted benzyloxycarbonyl and 9-fluorenylmethyloxycarbonyl (Fmoc), aliphatic urethane protecting groups, e.g., t-butyloxycarbonyl (Boc), isopropyloxycarbonyl, cyclohexyloxycarbonyl, and alkyl type protecting groups, e.g., benzyl, triphenylmethyl. The preferred protecting group is Boc. The side-chain protecting groups for Tyr include tetrahydropyranyl, tert-butyl, trityl, benzyl, Cbz, 4-Br—Cbz and 2,6-dichlorobenzyl. The preferred side-chain protecting group for Tyr is 2,6-dichlorobenzyl. The side-chain protecting groups for Asp include benzyl, 2,6-dichlorobenzyl, methyl, ethyl and cyclohexyl. The preferred side-chain protecting group for Asp is cyclohexyl. The side-chain protecting groups for Thr and Ser include acetyl, benzoyl, trityl, tetrahydropyranyl, benzyl, 2,6-dichlorobenzyl and Cbz. The preferred protecting group for Thr and Ser is benzyl. The side-chain protecting groups for Arg include nitro, Tos, Cbz, adamantyloxycarbonyl and Boc. The preferred protecting group for Arg is Tos. The side-chain amino group of Lys may be protected with Cbz, 2-Cl—Cbz, Tos or Boc. The 2-Cl—Cbz group is the preferred protecting group for Lys.

The side-chain protecting groups selected must remain intact during coupling and not be removed during the deprotection of the amino-terminus protecting group or during coupling conditions. The side-chain protecting groups must also be removable upon the completion of synthesis, using reaction conditions that will not alter the finished polypeptide.

Solid phase synthesis is usually carried out from the carboxy-terminus by coupling the alpha-amino protected (side-chain protected) amino acid to a suitable solid support. An ester linkage is formed when the attachment is made to a chloromethyl or hydroxymethyl resin, and the resulting polypeptide will have a free carboxyl group at the C-terminus. Alternatively, when a benzhydrylamine or p-methylbenzhydrylamine resin is used, an amide bond is formed and the resulting polypeptide will have a carboxamide group at the C-terminus. These resins are commercially available, and their preparation was described by Stewart et al., 1984, *Solid Phase Peptide Synthesis* (2nd Edition), Pierce Chemical Co., Rockford, Ill.

The C-terminal amino acid, protected at the side chain if necessary and at the alpha-amino group, is coupled to the benzhydrylamine resin using various activating agents including dicyclohexylcarbodiimide (DCC), N,N'-diisopropyl-carbodiimide and carbonyldiimidazole. Following the attachment to the resin support, the alpha-amino protecting group is removed using trifluoroacetic acid (TFA) or HCl in dioxane at a temperature between 0 and 25° C. Dimethylsulfide is added to the TFA after the introduction of methionine (Met) to suppress possible S-alkylation. After removal of the alpha-amino protecting group, the remaining protected amino acids are coupled stepwise in the required order to obtain the desired sequence.

Various activating agents can be used for the coupling reactions including DCC, N,N'-diisopropyl-carbodiimide, benzotriazol-1-yl-oxy-tris-(dimethylamino)-phosphonium hexa-fluorophosphate (BOP) and DCC-hydroxybenzotriazole (HOBt). Each protected amino acid is used in excess (>2.0 equivalents), and the couplings are usually carried out in N-methylpyrrolidone (NMP) or in DMF, $CH_2Cl_2$ or mixtures thereof. The extent of completion of the coupling reaction is monitored at each stage, e.g., by the ninhydrin reaction as described by Kaiser et al., 1970, *Anal. Biochem.* 34:595. In cases where incomplete coupling is found, the coupling reaction is repeated. The coupling reactions can be performed automatically with commercially available instruments.

After the entire assembly of the desired polypeptide, the polypeptide-resin is cleaved with a reagent such as liquid HF for 1-2 hours at 0° C., which cleaves the polypeptide from the resin and removes all side-chain protecting groups. A scavenger such as anisole is usually used with the liquid HF to prevent cations formed during the cleavage from alkylating the amino acid residues present in the polypeptide. The polypeptide-resin may be deprotected with TFA/dithioethane prior to cleavage if desired.

Side-chain to side-chain cyclization on the solid support requires the use of an orthogonal protection scheme which enables selective cleavage of the side-chain functions of acidic amino acids (e.g., Asp) and the basic amino acids (e.g., Lys). The 9-fluorenylmethyl (Fm) protecting group for the side-chain of Asp and the 9-fluorenylmethyloxycarbonyl (Fmoc) protecting group for the side-chain of Lys can be used for this purpose. In these cases, the side-chain protecting groups of the Boc-protected polypeptide-resin are selectively removed with piperidine in DMF. Cyclization is achieved on the solid support using various activating agents including DCC, DCC/HOBt or BOP. The HF reaction is carried out on the cyclized polypeptide-resin as described above.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the S. pneumoniae protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a S. pneumoniae protein or against peptides derived therefrom can be used as purification reagents. Other purification methods are possible.

The present invention also encompasses derivatives and homologues of S. pneumoniae-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids. The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify S. pneumoniae-derived polypeptides for use in the present invention, essentially the complete genomic sequence of a virulent, methicillin-resistant isolate of Streptococcus pneumoniae isolate was analyzed. While, in very rare instances, a nucleic acid sequencing error may be revealed, resolving a rare sequencing error is well within the art, and such an occurrence will not prevent one skilled in the art from practicing the invention.

Also encompassed are any S. pneumoniae polypeptide sequences that are contained within the open reading frames (ORFs), including complete protein-coding sequences, of which any of SEQ ID NO: 2662-SEQ ID NO: 5322 and SEQ ID NO: 5326 forms a part. Table 2, which is appended herewith and which forms part of the present specification, provides a putative identification of the particular function of a polypeptide which is encoded by each ORF. As a result, one skilled in the art can use the polypeptides of the present invention for commercial and industrial purposes consistent with the type of putative identification of the polypeptide.

The present invention provides a library of S. Pneumoniae-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of S. pneumoniae-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose S. pneumoniae infection, including use as markers in epidemiological studies. Non-limiting examples of such sequences are listed by SEQ ID NO in Table 2, which is appended The present invention also provides a library of S. pneumoniae-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example

Determination of Candidate Protein Antigens for Antibody and Vaccine Development The selection of candidate protein antigens for vaccine development can be derived from the nucleic acids encoding S. pneumoniae polypeptides. First, the ORF's can be analyzed for homology to other known exported or membrane proteins and analyzed using the discriminant analysis described by Klein, et al. (Klein, P., Kanehsia, M., and DeLisi, C. (1985) Biochimica et Biophysica Acta 815, 468-476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to S. pneumoniae genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of S. Pneumoniae Nucleic Acids and Polypeptides Based on the discovery of the S. pneumoniae gene products of the invention provided in the Sequence Listing, one skilled in the art can alter the disclosed structure (of *S. pneumoniae* genes), e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *S. pneumoniae* polypeptides. Such screens are useful for the identification of inhibitors of *S. pneumoniae*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNA's which encode an array of fragments. DNA's which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11-15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp 273-289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386-390; Roberts et al. (1992) *PNAS* 89:2429-2433; Devlin et al. (1990) *Science* 249: 404-406; Cwirla et al. (1990) *PNAS* 87: 6378-6382; as well as U.S. Pat. Nos. 5,223, 409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1-3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081-1085, 1989). In alanine scanning, a residue or group of target residues are identified (e.g., charged residues such as Arg, Asp, H is, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *S. pneumoniae* Nucleic Acids and Polypeptides

It is possible to modify the structure of an *S. pneumoniae* polypeptide for such purposes as increasing solubility, enhancing stability (e.g., shelf life ex vivo and resistance to proteolytic degradation in vivo). A modified *S. pneumoniae* protein or peptide can be produced in which the amino acid sequence has been altered, such as by amino acid substitution, deletion, or addition as described herein.

An *S. pneumoniae* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *S. pneumoniae* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *S. pneumoniae* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *S. pneumoniae* proteins include reduction/alkylation (Tarr, *Methods of protein Microcharacterization*, J. E. Silver ed., Humana Press, Clifton N.J. 155-194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939, 239; or mild formalin treatment (Marsh, (1971) *Int. Arch. of Allergy and Appl. Immunol.*, 41: 199-215).

To facilitate purification and potentially increase solubility of an *S. pneumoniae* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321-1325). In addition, to facilitate isolation of peptides free of irrelevant sequences, specific endoprotease cleavage sites can be introduced between the sequences of the fusion moiety and the peptide.

To potentially aid proper antigen processing of epitopes within an *S. pneumoniae* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *S. pneumoniae* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described above (as with the other screening methods described herein), can be used to identify polypeptides, e.g., fragments or analogs of a naturally-occurring *S. pneumoniae* polypeptide, e.g., of cellular proteins, or of randomly generated polypeptides which bind to an *S. pneumoniae* protein. (The *S. pneumoniae* domain is used as the bait protein and the library of variants are expressed as prey fusion proteins.) In an analogous fashion, a two hybrid assay (as with the other screening methods described herein), can be used to find polypeptides which bind a *S. pneumoniae* polypeptide.

Display Libraries

In one approach to screening assays, the candidate peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370-1371; and Goward et al. (1992) *TIBS* 18:136-140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages M13, fd., and fl are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007-16010; Griffiths et al. (1993) *EMBO J* 12:725-734; Clackson et al. (1991) *Nature* 352:624-628; and Barbas et al. (1992) *PNAS* 89:4457-4461).

A common approach uses the maltose receptor of *E. coli* (the outer membrane protein, LamB) as a peptide fusion partner (Charbit et al. (1986) *EMBO* 5, 3029-3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387-392), PhoE (Agterberg, et al. (1990) *Gene* 88, 37-45), and PAL (Fuchs et al. (1991) *Bio/Tech* 9, 1369-1372), as well as large bacterial surface structures have served as vehicles for peptide display. Peptides can be fused to pilin, a protein which polymerizes to form the pilus—a conduit for interbacterial exchange of genetic information (Thiry et al. (1989) *Appl. Environ. Microbiol.* 55, 984-993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080-1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239-4245 and Klauser et al. (1990) *EMBO J.* 9, 1991-1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865-1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stablely associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89-1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378-6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233-1251). These particular biases are not a factor in the LacI display system.

The number of small peptides available in recombinant random libraries is enormous. Libraries of $10^7$-$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3-6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233-1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204, 357-364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. pneumoniae* Polypeptides

The invention also provides for reduction of the protein binding domains of the subject *S. pneumoniae* polypeptides to generate mimetics, e.g. peptide or non-peptide agents. The peptide mimetics are able to disrupt binding of a polypeptide to its counter ligand, e.g., in the case of an *S. pneumoniae* polypeptide binding to a naturally occurring ligand. The critical residues of a subject *S. pneumoniae* polypeptide which are involved in molecular recognition of a polypeptide can be determined and used to generate *S. pneumoniae*-derived peptidomimetics which competitively or noncompetitively inhibit binding of the *S. pneumoniae* polypeptide with an interacting polypeptide (see, for example, European patent applications EP-412,762A and EP-B31,080A).

For example, scanning mutagenesis can be used to map the amino acid residues of a particular *S. pneumoniae* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *S. pneumoniae* polypeptide to an interacting polypeptide and thereby interfere with the function of *S. pneumoniae* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *S. pneumoniae* Nucleic Acids and Polypeptides

This invention also features vaccine compositions for protection against infection by *S. pneumoniae* or for treatment of *S. pneumoniae* infection, a gram-negative spiral microaerophilic bacterium. In one embodiment, the vaccine compositions contain one or more immunogenic components such as a surface protein from *S. pneumoniae*, or portion thereof, and a pharmaceutically acceptable carrier. Nucleic acids within the scope of the invention are exemplified by the nucleic acids of the invention contained in the Sequence Listing which encode *S. pneumoniae* surface proteins. Any nucleic acid encoding an immunogenic *S. pneumoniae* protein, or portion thereof, which is capable of expression in a cell, can be used in the present invention. These vaccines have therapeutic and prophylactic utilities.

One aspect of the invention provides a vaccine composition for protection against infection by *S. pneumoniae* which contains at least one immunogenic fragment of an *S. pneumoniae* protein and a pharmaceutically acceptable carrier. Preferred fragments include peptides of at least about 10 amino acid residues in length, preferably about 10-20 amino acid residues in length, and more preferably about 12-16 amino acid residues in length.

Immunogenic components of the invention can be obtained, for example, by screening polypeptides recombinantly produced from the corresponding fragment of the nucleic acid encoding the full-length *S. pneumoniae* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic S. pneumoniae peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in Proc. Natl. Acad. Sci. USA, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., S. pneumoniae polypeptide or fragment thereof or nucleic acid encoding an S. pneumoniae polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing S. pneumoniae polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) Science 247: 1465-1468 and by Sedegah et al. (1994) Immunology 91: 9866-9870. Other modes of administration include oral and pulmonary formulations, suppositories, and transdermal applications. Oral immunization is preferred over parenteral methods for inducing protection against infection by S. pneumoniae. Cain et. al. (1993) Vaccine 11: 637-642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the S. pneumoniae polypeptide with cholera toxin or its B subunit, procholeragenoid, fungal polysaccharides, including schizophyllan, muramyl dipeptide, muramyl dipeptide derivatives, phorbol esters, labile toxin of E. coli, non-S. pneumoniae bacterial lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including S. pneumoniae polypeptide in an insoluble form as fusion proteins. Suitable carriers for the vaccines of the invention are enteric coated capsules and polylactide-glycolide microspheres. Suitable diluents are 0.2 N NaHCO3 and/or saline.

Vaccines of the invention can be administered as a primary prophylactic agent in adults or in children, as a secondary prevention, after successful eradication of S. pneumoniae in an infected host, or as a therapeutic agent in the aim to induce an immune response in a susceptible host to prevent infection by S. pneumoniae. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917-921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *S. pneumoniae* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *S. pneumoniae* infection, some are useful only for treating *S. pneumoniae* infection, and some are useful for both preventing and treating *S. pneumoniae* infection. In a preferred embodiment, the vaccine composition of the invention provides protection against *S. pneumoniae* infection by stimulating humoral and/or cell-mediated immunity against *S. pneumoniae*. It should be understood that amelioration of any of the symptoms of *S. pneumoniae* infection is a desirable clinical goal, including a lessening of the dosage of medication used to treat *S. pneumoniae*-caused disease, or an increase in the production of antibodies in the serum or mucous of patients.

Antibodies Reactive With *S. pneumoniae* Polypeptides

The invention also includes antibodies specifically reactive with the subject *S. pneumoniae* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *S. pneumoniae* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *S. pneumoniae* polypeptides of the invention, e.g. antigenic determinants of a polypeptide of the invention contained in the Sequence Listing, or a closely related human or non-human mammalian homolog (e.g., 90% homologous, more preferably at least 95% homologous). In yet a further preferred embodiment of the invention, the anti-*S. pneumoniae* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *S. pneumoniae* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*S. pneumoniae* portion.

Both monoclonal and polyclonal antibodies (Ab) directed against *S. pneumoniae* polypeptides or *S. pneumoniae* polypeptide variants, and antibody fragments such as Fab' and F(ab')$_2$, can be used to block the action of *S. pneumoniae* polypeptide and allow the study of the role of a particular *S. pneumoniae* polypeptide of the invention in aberrant or unwanted intracellular signaling, as well as the normal cellular function of the *S. pneumoniae* and by microinjection of anti-*S. pneumoniae* polypeptide antibodies of the present invention.

Antibodies which specifically bind *S. pneumoniae* epitopes can also be used in immunohistochemical staining of tissue samples in order to evaluate the abundance and pattern of expression of *S. pneumoniae* antigens. Anti *S. pneumoniae* polypeptide antibodies can be used diagnostically in immuno-precipitation and immuno-blotting to detect and evaluate *S. pneumoniae* levels in tissue or bodily fluid as part of a clinical testing procedure. Likewise, the ability to monitor *S. pneumoniae* polypeptide levels in an individual can allow determination of the efficacy of a given treatment regimen for an individual afflicted with such a disorder. The level of an *S. pneumoniae* polypeptide can be measured in cells found in bodily fluid, such as in urine samples or can be measured in tissue, such as produced by gastric biopsy. Diagnostic assays using anti-*S. pneumoniae* antibodies can include, for example, immunoassays designed to aid in early diagnosis of *S. pneumoniae* infections. The present invention can also be used as a method of detecting antibodies contained in samples from individuals infected by this bacterium using specific *S. pneumoniae* antigens.

Another application of anti-*S. pneumoniae* polypeptide antibodies of the invention is in the immunological screening of cDNA libraries constructed in expression vectors such as lgt11, lgt18-23, lZAP, and lORF8. Messenger libraries of this type, having coding sequences inserted in the correct reading frame and orientation, can produce fusion proteins. For instance, lgt11 will produce fusion proteins whose amino termini consist of β-galactosidase amino acid sequences and whose carboxy termini consist of a foreign polypeptide. Antigenic epitopes of a subject *S. pneumoniae* polypeptide can then be detected with antibodies, as, for example, reacting nitrocellulose filters lifted from infected plates with anti-*S. pneumoniae* polypeptide antibodies. Phage, scored by this assay, can then be isolated from the infected plate. Thus, the presence of *S. pneumoniae* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chips and Microarrays

The nucleic acid sequence of the present invention may be used to detect S. pneumoniae or other species of Streptococcus acid sequence using bio chip technology. Bio chips containing arrays of nucleic acid sequence can also be used to measure expression of genes of S. pneumoniae or other species of Streptococcus. For example, to diagnose a patient with a S. pneumoniae or other Streptococcus infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467-470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283: 83-87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45-48. Patents teaching this technology include U.S. Pat. Nos. 5,445,934, 5,744,305, and 5,800,992.

Drug Screening Assays Using *S. pneumoniae* Polypeptides

By making available purified and recombinant *S. pneumoniae* polypeptides, the present invention provides assays which can be used to screen for drugs which are either agonists or antagonists of the normal cellular function, in this case, of the subject *S. pneumoniae* polypeptides, or of their role in intracellular signaling. Such inhibitors or potentiators may be useful as new therapeutic agents to combat *S. pneumoniae* infections in humans. A variety of assay formats will suffice and, in light of the present inventions, will be comprehended by the skilled artisan.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *S. pneumoniae* polypeptide.

Screening assays can be constructed in vitro with a purified *S. pneumoniae* polypeptide or fragment thereof, such as an *S. pneumoniae* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemi-luminescence properties, for example, because detection may be easily automated. A variety of synthetic or naturally occurring compounds can be tested in the assay to identify those which inhibit or potentiate the activity of the *S. pneumoniae* polypeptide. Some of these active compounds may directly, or with chemical alterations to promote membrane permeability or solubility, also inhibit or potentiate the same activity (e.g., enzymatic activity) in whole, live *S. pneumoniae* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061-2068; Eilers and Schatz, *Nature,* 1986, 322:228-231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245-246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767-773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,*

Dekker, New York; Lieberman et al (eds.), 1990, *Pharmaceutical Dosage Forms: Disperse Systems*, Dekker, New York.

The antibacterial agents and compositions of the present invention are useful for preventing or treating *S. pneumoniae* infections. Infection prevention methods incorporate a prophylactically effective amount of an antibacterial agent or composition. A prophylactically effective amount is an amount effective to prevent *S. pneumoniae* infection and will depend upon the specific bacterial strain, the agent, and the host. These amounts can be determined experimentally by methods known in the art and as described above.

*S. pneumoniae* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

I. Cloning and Sequencing of *S. pneumoniae* DNA

*S. pneumoniae* chromosomal DNA was isolated according to a basic DNA protocol outlined in Schleif R. F. and Wensink P. C., Practical Methods in Molecular Biology, p. 98, Springer-Verlag, NY., 1981, with minor modifications. Briefly, cells were pelleted, resuspended in TE (10 mM Tris, 1 mM EDTA, pH 7.6) and GES lysis buffer (5.1 M guanidium thiocyanate, 0.1 M EDTA, pH 8.0, 0.5% N-laurylsarcosine) was added. Suspension was chilled and ammonium acetate (NH4Ac) was added to final concentration of 2.0 M. DNA was extracted, first with chloroform, then with phenol-chloroform, and reextracted with chloroform. DNA was precipitated with isopropanol, washed twice with 70% EtOH, dried and resuspended in TE.

Following isolation whole genomic *S. pneumoniae* DNA was nebulized (Bodenteich et al., Automated DNA Sequencing and Analysis (J. C. Venter, ed.), Academic Press, 1994) to a median size of 2000 bp. After nebulization, the DNA was concentrated and separated on a standard 1% agarose gel. Several fractions, corresponding to approximate sizes 1000-1500 bp, 1500-2000 bp, 2000-2500 bp, 2500-3000 bp, were excised from the gel and purified by the GeneClean procedure (Bio101, Inc.).

The purified DNA fragments were then blunt-ended using T4 DNA polymerase. The healed DNA was then ligated to unique BstXI-linker adapters (5' GTCTTCACCACGGGG (SEQ ID NO: 5323) and 5' GTGGTGAAGAC (SEQ ID NO: 5324) in 100-1000 fold molar excess). These linkers are complimentary to the BstXI-cut pMPX vectors, while the overhang is not self-complimentary. Therefore, the linkers will not concatemerize nor will the cut-vector religate itself easily. The linker-adopted inserts were separated from the unincorporated linkers on a 1% agarose gel and purified using GeneClean. The linker-adopted inserts were then ligated to each of 20 pMPX vectors to construct a series of "shotgun" subclone libraries. Blunt ended vector was used for cloning into the PUC19 vector. The vectors contain an out-of-frame lacZ gene at the cloning site which becomes in-frame in the event that an adapter-dimer is cloned, allowing these to be avoided by their blue-color.

All subsequent steps were based either on the multiplex DNA sequencing protocols outlined in Church G. M. and Kieffer-Higgins S., Science 240:185-188, 1988 or by ABI377 automated DNA sequencing methods. Only major modifications to the protocols are highlighted. Briefly, each of the 20 vectors was then transformed into DH5a competent cells (Gibco/BRL, DH5a transformation protocol). The libraries were assessed by plating onto antibiotic plates containing ampicillin, methicillin and IPTG/Xgal. The plates were incubated overnight at 37° C. Successful transformants were then used for plating of clones and pooling into the multiplex pools. The clones were picked and pooled into 40 ml growth medium cultures. The cultures were grown overnight at 37° C. DNA was purified using the Qiagen Midi-prep kits and Tip-100 columns (Qiagen, Inc.). In this manner, 100 mg of DNA was obtained per pool.

These purified DNA samples were then sequenced either using the multiplex DNA sequencing based on chemical degradation methods (Church G. M. and Kieffer-Higgins S., Science 240:185-188, 1988) or by Sequithrem (Epicenter Technologies) dideoxy sequencing protocols or by ABI dye-terminator chemistry. For the multiplex portion the sequencing reactions were electrophoresed and transferred onto nylon membranes by direct transfer electrophoresis from 40 cm gels (Richterich P. and Church G. M., Methods in Enzymology 218:187-222, 1993). The DNA was covalently bound to the membranes by exposure to ultraviolet light, and hybridized with labeled oligonucleotides complimentary to tag sequences on the vectors (Church, supra). The membranes were washed to rinse off non-specifically bound probe, and exposed to X-ray film to visualize individual sequence ladders. After autoradiography, the hybridized probe was removed by incubation at 65° C., and the hybridization cycle repeated with another tag sequence until the membrane had been probed 41 times. Thus, each gel produced a large number of films, each containing new sequencing information. Whenever a new blot was processed, it was initially probed for an internal standard sequence added to each of the pools. Digital images of the films were generated using a laser-scanning densitometer (Molecular Dynamics, Sunnyvale, Calif.). The digitized images were processed on computer workstations (VaxStation 4000's) using the program REPLICA™ (Church et al., Automated DNA Sequencing and Analysis (J. C. Venter, ed.), Academic Press, 1994). Image processing included lane straightening, contrast adjustment to smooth out intensity differences, and resolution enhancement by iterative gaussian deconvolution. The sequences were then converted to an SCF format so that processing and assembly could proceed on UNIX machines. The ABI dye terminator sequence reads were run on ABI377 machines and the data was directly transferred to UNIX machines following lane tracking of the gels. All multiplex and ABI reads were assembled using PHRAP (P. Green, Abstracts of DOE Human Genome Program Contractor-Grantee Workshop V, January 1996, p. 157) with default parameters and not using quality scores. The initial assembly was done at 7 fold coverage and yielded 511 contigs. Short read length fragments of 200 bp or less found on the ends of contigs facing in the appropriate direction were used to extend off the end of the contigs. These reads were then resequenced with primers using ABI technology to give sequences with a read length of 500 or more bases. This allowed end extensions to be performed without ordering new primers. In addition, missing mates (sequences from clones that only gave one strand reads) were identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps.

To identify S. pneumoniae polypeptides the complete genomic sequence of S. pneumoniae were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the predicted coding regions of the sequences and start codons were evaluated with the programs GENEMARK™ (Borodovsky and Mclninch, 1993, Comp. Chem. 17:123) and Glimmer (Fraser et al, *Nature*, 1997).

Identification, Cloning and Expression of S. pneumoniae Nucleic Acids

Expression and purification of the S. pneumoniae polypeptides of the invention can be performed essentially as outlined below.

To facilitate the cloning, expression and purification of membrane and secreted proteins from S. pneumoniae, a gene expression system, such as the pET System (Novagen), for cloning and expression of recombinant proteins in E. coli, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1-SEQ ID NO: 2661 and SEQ ID NO: 5325) for cloning from the 14453 strain of S. pneumoniae are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native S. pneumoniae DNA sequence. All reverse primers (specific for the 3' end of any S. pneumoniae ORF) include a EcoRI site at the extreme 5' terminus to permit cloning of each S. pneumoniae sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from strain 14453 of S. pneumoniae is used as the source of template DNA for PCR amplification reactions (Current Protocols in Molecular Biology, John Wiley and Sons, Inc., F. Ausubel et al., eds., 1994). To amplify a DNA sequence containing an S. pneumoniae ORF, genomic DNA (50 nanograms) is introduced into a reaction vial containing 2 mM $MgCl_2$, 1 micromolar synthetic oligonucleotide primers (forward and reverse primers) complementary to and flanking a defined S. pneumoniae ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA)(Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of S. pneumoniae Nucleic Acids into an Expression Vector

The pET-28b vector is prepared for cloning by digestion with endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E coli strain BL21 or E. coli strain BL21 (DE3), are transformed with recombinant pET expression plasmids carrying the cloned S. pneumoniae sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with *S. pneumoniae* Nucleic Acids Individual BL21 clones transformed with recombinant pET-28b *S. pneumoniae* ORFs are analyzed by PCR amplification of the cloned inserts using the same forward and reverse primers, specific for each *S. pneumoniae* sequence, that were used in the original PCR amplification cloning reactions. Successful amplification verifies the integration of the *S. pneumoniae* sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned *S. pneumoniae* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant *S. pneumoniae* Sequences in *E. coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21 (DE3) (Studier, F. W., Rosenberg, A. H., Dunn, J. J., and Dubendorff, J. W. (1990) Meth. Enzymol. 185, 60-89).

To express recombinant *S. pneumoniae* sequences, 50 nanograms of plasmid DNA isolated as described above is used to transform competent BL21 (DE3) bacteria as described above (provided by Novagen as part of the pET expression system kit). The lacZ gene (beta-galactosidase) is expressed in the pET-System as described for the *S. pneumoniae* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *S. pneumoniae* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169-180). Protein concentrations are also measured by the method of Bradford, M. M. (1976) Anal. Biochem. 72, 248-254, and Lowry, O. H., Rosebrough, N., Farr, A. L. & Randall, R. J. (1951) J. Biol. Chem. 193, pages 265-275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

While this invention has been particularly shown and described with references to preferred embodiments thereof, it will be understood by those skilled in the art that various changes in form and details may be made therein without departing from the scope of the invention encompassed by the appended claims.

SEQUENCE LISTING (5326 sequences)

SEQ ID NO: 1 - DNA, 333 bp, Streptococcus pneumoniae
ttgaaacaccactatcagatctatcaactcttactttttcactttcagaacaaagaccctgagaaatttttcggactcattgaggacactctgaagcaggttcatcctatttttcagactgtctttaaaacctttctaaagaacaaagaaaaaatcgtcaacgctcttcaattaccttattccaacgcaaaattggaagcgaccaataatctcatcaaacttatcaaacgaaacgcctttggatttcggaactttgaaaacttcaaaaaaaggatttttatcgctctgaacatcaaaaaagaaaggacgaattttgtcctttctcgagcttag

SEQ ID NO: 2 - DNA, 519 bp, Streptococcus pneumoniae
atggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaccttctaaaattccttatcttgaaacgactggtatgcctactagaattctccttagaaagcgtcgtttcaagtgctatcactgttcaaaaatgatggtcgctgaaacttctatcgtcaagaataatcaccaaatccctcgtatcatcaaccaaaagattgctcaaaagttaattgaaaagatttctatgactgatattgcccatcagctttccatctcaacttcaactgttattcgtaagctcaatgattttcactttaaacatgatttttcttgtcttcctgagattatgtcctgggacgttgaaacagtccggggagtgactgtttcaatcgggagatggagatga

SEQ ID NO: 3 - DNA, 327 bp, Streptococcus pneumoniae
aacagtccggggagtgactgtttcaatcgggagatggagatgagcttcattgcgcaagattttaacaatctcaatatcatcactgttcttgagggaagaacacaagctatcattcgaaatcactttcttcgctacgatagagccgtccgatgtcgcgtcaaaatcattactatggatatgtttagcccttactatggcttggctaaacagcttcgctttcaaatttctaggctcaggctgaaacagtctcccagactgtttcactcccgaatgctaaaatcgttcttgatcgctttcacattgtgcaacatcttagccgtgctatga

SEQ ID NO: 4 - DNA, 570 bp, Streptococcus pneumoniae
gttcttgatcgctttcacattgtgcaacatcttagccgtgctatgagtcgtgtgcgtgtccaaatcatgaatcagtttcatcgaaaatcccatgaatacaaggctatcaagcgctactggaaactcattcaacaggatagccgtaaactgagtgataaacgtttttatcgtcctacttttcgtatgcacttaaccaataaagagattttagacaagcttttgagctattcacaagacttgaaacaccactatcagctctatcaactcttgctgtttcactttcagaataaggaaccggagaaatttttcggactcattgaggacaatctaaagcaggttcatcctctttttcagactgtctttaaaacctttctaaaggacaaagagaaaatcgtcaacgcccttcaactacactattctaacgccaaattggaagcgaccaataatctcatcaaacttatcaaacgcaatgcctttggttttcggaactttgaaaacttcaaaaaacggattttcatcgccctgaacatcaaaaaagaaaggacgaaatttgtcctttctcaagcttag

SEQ ID NO: 5 - DNA, 366 bp, Streptococcus pneumoniae
gtgcatttgttgaagtattgccaggtatcgatggacttgttcacgtatcacaaatttcacacaaacggattgaaaatccaaaagaagctcttaaagttggtcaagaagttcaagttaaagttcttgaagttaacgcagatgcagaacgcgtgtcactttctattaaagctcttgaagaacgtccagcccaagaagaaggacaaaaagaagaaaaacgtgctgctcgtccacgtcgtccaagacgtcaagaaaagcgtgatttcgaacttccagaaacacaaacaggattttcaatggctgatttgtttggtgatatcgaactttaatcaaattgaaaattcacaaaatcctttgtttactaaataa

SEQ ID NO: 6 - DNA, 1203 bp, Streptococcus pneumoniae
atgaacgaatttgaagatttgctaaatagcgttagtcaagttgagactggtgatgttgttagtgctgaagtattgacagttgatgcgactcaagctaacgttgcaatctctggaactggtgttgaaggtgtcttgactcttcgcgaattgacaaacgatcgtgatgcagatatcaatgactttgttaaagtaggagaagtattggatgttcttgtacttcgtcaagtagttggtaaagatactgatacagttacataccttgtatctaaaaaacgccttgaagctcgcaaagcatgggacaaacttgttggtcgcgaagaagaagttgttactgttaaaggaacgcgtgccgttaaaggtggactttcagtagaatttgaaggtgttcgtggatttatcccagcttcaatgttggatactcgtttcgtacgtaacgctgagcgttttgtaggtcaagaatttgatactaaaatcaaagaagttaacgctaaagaaaaccgcttcatcctttcacgtcgtgaagttgttgaagcagctactgcagcagctcgcgctgaagtattcggtaaattggctgttggtgatgttgtaactggtaaagttgctcgtatcacaagcttcggcgctttcatcgaccttggtggtgttgacggattggttcacttgactgaattgtcacatgaacgtaacgtatcaccaaaatcagttgtaactgttggtgaagaaattgaagtgaaaatccttgatcttaacgaagaagaaggacgtgtatcactttcacttaaagcaacagtaccaggaccatgggatggcgttgagcaaaaattggctaaaggtgatgtagtagaaggaacagttaaacgtttgactgacttcggtgcatttgttgaagtattgccaggtatcgatggacttgttcacgtatcacaaatttcacacaaacggattgaaaatccaaaagaagctcttaaagttggtcaagaagttcaagttaaagttcttgaagttaacgcagatgcagaacgcgtgtcactttctattaaagctcttgaagaacgtccagcccaagaagaaggacaaaaagaagaaaaacgtgctgctcgtccacgtcgtccaagacgtcaagaaaagcgtgatttcgaacttccagaaacacaaacaggattttcaatggctgatttgtttggtgatatcgaactttaa

SEQ ID NO: 7 - DNA, 237 bp, Streptococcus pneumoniae
aataccctaagatattttgctttttatcttgattattacctaagaactggggtagctggattcgaaccaacgcatgagggagtcaaagtcccttgccttaccgcttggctataccccattaatgaaatggagagagagggattcgaacccccgaacccgaaggagcggatttacagtccgccgcgtttagcctcttcgctatctctcctacaatcaacatggactattatatcatga

SEQ ID NO: 8 - DNA, 231 bp, Streptococcus pneumoniae
atgagcaagaaagataaaaaaatcgaaattcaagtagcggatgccaaagttaatgttggtaaagacagttttgaaggttatacattgactatcggtaaaaaagttatcggagaaattgccgaattagacggacaatttgccattataaagaatgggaatgtcgatagtttttataaaaaattggaaaaagctgtggaaattttgattgaaaattataatttagcaaaataa

SEQ ID NO: 9 - DNA, 645 bp, Streptococcus pneumoniae
atgaaaatattggttacaggttttaatccttttggaggtgaaaagattaatccagctttggaggctgtaaaattattaccatctgagattaatggggctgaagttcgctgggtagaaattccaacggttttttataagtcgtcagaagttttagaggcagaaatattacgatatcaaccagatgctgtactttgtattggacaagcaggcggcaggaccggcttaacacctgaacgagtggctattaatcaagatgatgctcgcatacctgataacgaaggcaatcaaccaattgatacaccgattcgtattgatggagcatcggcctattttagtagtttacctatcaaagcgatggtacaagctatcaaaaaacagggacttccggcagttgtatccaatagtgcaggaacctttgtttgcaatcatttgatgtaccaagctctttatttagtggataaaaaattccctaatatgagagcaggtttcatgcatattccatatatgatggaacaagtagtaaataagccgaatactgcaggaatgagtctatgtgatattgtaagaggcatagaggtagctattgaagctattgtagactacaaagataaggatttgcagttagtaggcggtgagactcactga

SEQ ID NO: 10 - DNA, 924 bp, Streptococcus pneumoniae
atgacagagttggcaaagcaactattagagttgacctatattgtgattggttgtcaatttctccatacagcctattgtagttataaagataaaacaaacccagttcgacttgggacatctgcattttggactctattgtctattacgtttataggtggttcctatatgccaaatatgagtattggtattattgtaatcctattatcgctgttaacattgtttaagcaagtccgtatcggaaccttgccatccttagatgaaatgaaagccaatattgaatctaacaggttgaaaaataaaatttttattccagttatgctgatggcaatacttgcgttggtcttagcgcaaatgattccagaatttagcaagatttcgattagccttgccgccttgtttgctacaatttctgttcttgtgattaccaatagtcaccctaagagtctgttatcagaaaataatcgaatgactcagcaagtttcaacaagtggtattgttcctcaattattaggggctttgggggctatttttactgtagcaggtgttggtgatgttatctctcatctgattagcggtattgttccttcagatagtcgctttataggagttttggcctatgttcttggaatggttctattcacaatgattatgggaaatgcttttgcagcattcaccgttattacagcaggtgttggagttccctttgtatttgctctgggagctaatccaattgtggctggtgctcttgccatgacagcaggttattgtgggaccttattgaccccaatggctgctaattttaacgctctaccagcagcattgatggatatgaaagatcagaatggcgttataaaggctcaagcaggtgttgctctagtaatgattgttattcacatattcttaatgtactttctcgcattttag

SEQ ID NO: 11 - DNA, 711 bp, Streptococcus pneumoniae
ttgaatataaaggagtttgatatggagtggattagattaataggaatagcaatcattgttgtgggttttattttaaaatttgatacaattgcaacagtagtcttagctggtttggttacagctttagtttcaggtgtttctctcgttgaatttttggagattttgggaaaagaatttagcaatcagcgagtgctcacgatttttatggttaccttgcctcttgtggggctgtcagaaacctttggactcaagcaacgatcaatcgatttgattcgaaagattaaaggtctgacagttggaaacttctatacagtttatttctttattcgagagttagctggtttcttttcaattcgtctaggaggacaccctcagtttgtcagacctttggttcagcctatgggagaagcagctgcagagtctcaattaggtagaaagttaacagaggttgaagatgagacaataaaagcgcgtgcggctgcgaatgaaaattttggaaatttctttgctcaaaatacgtttgtaggtgctgggggagtcctcttgatagggggaacattagatcagttaggctatgaaagcaattatgcagggattgcttctacatctattattgttgctgttataacacttattgtagtggggatttacaattatttatttgataaaaaattgatatcaaaaaagactaggggaggagaacaaaaatga

SEQ ID NO: 12 - DNA, 705 bp, Streptococcus pneumoniae
gtggtcctgagcacgtcagctattttagtggcttgtggaaaaactgataaagaagcagatgcaccgacaacattttcttatgtctatgcagtagatccagcatcattgggctacagtatagcgactcgaacatcgaggacagacgttattggaaatgttattgatggtttgatggaaaatgataaatacggcaatgttgctccttctcaaaaagactatgatttgaacagtacaggatgggctccaagctatcaagatccagcgtcttacttgaatattatggatccaaaatctggttctgccatgaaacaccttggcattacgaaaggaaaagataaggatgttgtagctaaacctggtttggataaatataagaaattgttagaagatgctgtttctgagatcactgacctagagaagagatatgaaaaatatgccaaagctcaagcttggtcgacagatagttcattattgatgccaacagcttcatctggtggttttccagttgtaagtaacgtagtaccattctcaaaaccatactcacaagttggtattaagggggaaccatatatctttaaaggaatgaaattgcaaaaagatattgttacaacaaaagaatataacgaggtttttaaaaaatggcaaaaagaaaaattggaatccaatagcaaataccaaaaagaactagaaaaatacattaaataa

SEQ ID NO: 13 - DNA, 1023 bp, Streptococcus pneumoniae
atgacagtaacgattgattgggaaaacctcggtttttcctatatgaaattaccttatcgctatcttgctcatttcaaaaatggacaatgggatcaaggagagcttacagaggatgcaactttgcatatttcagagtcttctccaagtcttcactatggacaacaagcatttgaaggtttgaaagcttatcgtactaaggatggcagtgttcaactgttccgtcctgatgaaaatgctaaacgtctgcaacgtacatgtgaccgtctcttgatgccacaagttccgacagacatgtttgtagaagcttgtaaagcagttgtccgtgcgaatgaagaatacgtaccaccatacggaacaggtggaaccttatatcttcgccctcttttgattggtgtcggagatattatcggggtaaaaccggcagaagagtacattttcaccatctttgctatgccagttggaaattactttaaaggcggtttggtcccaaccaacttcttgattcaggatgagtacgaccgtgcagcaccaaatggtacaggtgcggctaaggttggtggaaactatgctgcaagtctcttaccaggaaaaatggccaagtcacgtcatttctcagatgttatctatctggacccatcaactcatacaaagattgaagaagtcggatcagctaacttctttggaattacagctgataatgaatttgtaacaccattgagtccatctatcttgccatctattaccaagtattccttgctttatttggcagaacatcgcttgggattaactcctattgagggtgatgttccaattgataatcttgaccgttttgtagaggcaggtgcctgtggtacagcagcggttatttctccaattggaggtattcaacatggtgatgatttccatgtattctatagtgaaacagaagtaggtcctgtgacgcgtaaattatataatgaattgacgggtattcagtttggcgatattgaagcgccagaaggttggattgtaaaagtagattaa

SEQ ID NO: 14 - DNA, 2472 bp, Streptococcus pneumoniae
atgtctaacattcaaaacatgtccctggaggacatcatgggagagcgctttggtcgctactccaagtacattattcaagaccgggctttgccagatattcgtgatgggttgaagccggttcagcgccgtattctttattctatgaataaggatagcaatacttttgacaagagctaccgtaagtcggccaagtcagtcgggaacatcatggggaatttccacccacacggggattcttctatctatgatgccatggttcgtatgtcacagaactggaaaaatcgtgagattctagttgaaatgcacggtaataacggttctatggacggagatcctcctgcggctatgcgttatactgaggcacgtttgtctgaaattgcaggctaccttcttcaggatatcgagaaaaagacagttccttttgcatggaactttgacgatacggagaaagaaccaacggtcttgccagcagcctttccaaacctcttggtcaatggttcgactgggatttcggctggttatgccacagacattcctccccataatttagctgaggtcatagatgctgcagtttacatgattgaccacccaactgcaaagattgataaactcatggaattcttgcctggaccagacttccctacaggggctattattcagggtcgtgatgaaatcaagaaagcttatgagactgggaaagggcgcgtggttgttcgttccaagactgaaattgaaaagctaaaaggtggtaaggaacaaatcgttattactgagattccttatgaaatcaataaggccaatctagtcaagaaaatcgatgatgttcgtgttaataacaaggtagctgggattgctgaggttcgtgatgagtctgaccgtgatggtcttcgtatcgctatcgaacttaagaaagacgctaatactgagcttgttctcaactacttatttaagtacaccgacctacaaatcaactacaactttaatatggtggcgattgacaatttcacacctcgtcaggttgggattgttccaatcctgtctagctacatcgctcaccgtcgagaagtgattttggcgcgttcacgctttgacaaagaaaaggctgagaaacgtctccatatcgtcgaaggtttgattcgtgtgatttcgattttggatgaagtcattgctcttatccgtgcttctgagaataaggcggacgccaaggaaaacctcaaagttagctatgattttacggaagaacaggctgaggctatcgtaactttgcaactgtaccgtttgaccaataccgatgtggttgtcttgcaggaagaagaagcagagcttcgtgagaagattgctatgctggcggctattatcggtgatgaaaggactatgtacaatctcatgaagaaagaacttcgtgaggtcaagaagaaatttgcaactcctcgtttgagttctttagaagacactgcgaaagcaattgagattgatacagctagtcttatcgctgaggaagatacctacgtcagcgtgaccaaggcaggttacatcaagcgtaccagtccacgttcctttgcggcttccaccttggaagaaattggcaagcgtgatgatgaccgtttgatttttgttcaatctgccaagacaacccagcacctcttgatgttcacaagtcttggaaatgtcatctacagaccaatccatgagttggcagatattcgttggaaggacatcggagagcatctgagccaaaccatcacaaactttgaaacgaatgaagaaatcctttatgtggaagtactggatcagtttgacgatgcgacaacctactttgcagtgactcgccttggtcaaatcaaacgggtagagcgaaaagaattcactccatggcggacctatagatctaagtctgtcaagtatgctaagctcaaagacgatacagatcagattgtagcagtggctccgattaaactagatgatgttgtcttggttagtcaaaatggttatgccctgcgtttcaatatcgaagaggttccggttgtcggtgctaaggcagcaggtgtcaaggctatgaatttgaaagaagatgatgtcctccaatctggctttatctgtaatacttcgtccttctacctcttgacccagcgtggaagcttgaaacgtgtttctattgaggaaattctagcaaccagccgtgccaaacgaggattacaagtcttgcgtgagttgaaaaacaaaccgcatcgtgtcttcttggcaggagcagttgcagagcaaggatttgttggcgatttcttcagtacggaagtggatgtgaacgaccaaactctgcttgtccaatccaataaaggaacaatctatgaaagccgattgcaagacttgaacttgtcagaacgcactagcaatggaagcttcatttctgacacgatttcagatgaagaagtttttgacgcttatcttcaggaagtagttactgaagataaataa

SEQ ID NO: 15 - DNA, 1944 bp, Streptococcus pneumoniae
gtgtcaaaaaaggaaatcaatattaacaattataatgatgatgctattcaggtgctagaagggttggatgcggtccgaaaacgtccggggatgtatattggatcgaccgatggcgctggtcttcatcacctagtttgggaaatcgttgataatgcagtcgatgaagccttgtctgggtttggtgatcgtattgatgtaactatcaataaagacggtagtctaacggttcaagaccatggacgtgggatgccgacaggtatgcacgctatgggaattccaactgttgaggttatctttaccattcttcatgccggagggaaattcggtcaaggtggctataagacatcaggtggacttcacggagtgggttcttccgttgttaacgccctttctagctggttagaagttgaaattacccgtgatggcgcagtttacaagcaacgtttcgaaaatggtggaaaacctgtcacgactttgaagaaaatcggtacagcacccaagtctaaaacaggcaccaaagttacttttatgcctgacgcgactatattttctacgacagatttcaagtacaataccatttcagagcgccttaatgaatcagcctttctcttgaaaaatgtgaccttgtctttaacggacaagcgaacagatgaagcgattgagttccactatgagaatggagtacaagattttgtttcttatctcaacgaagataaggaaatcttgacgccagttctttactttgaaggggaagacaatggttttcaagtggaagtagccctccagtacaatgacggattctcagataacattctatcctttgtcaataacgttcgcaccaaggacggtggaacgcacgagacaggactcaagtctgccattaccaaggtcatgaatgactatgcacgtaaaacaggtcttctcaaggaaaaagataaaaaccttgaaggttcagactatcgtgagggactagcggccgttctttctatcttagttcctgaagaacacttgcagtttgaaggacagaccaaggataaactaggaagccccctagctcgcccagttgtggatggaatagtggctgataagttgacctttttccttatggaaaatggggaattagcttctaacctcatccgcaaggctatcaaggcccgtgatgctcgtgaagcagcacgtaaggcgcgtgatgagagccgaaatgggaagaaaaacaagaaagataagggcttgttgtctgggaaattgaccccagcccaatctaagaatcctgctaagaatgaactctatctagttgagggggactctgccggtggttctgccaaacaaggtcgtgaccgcaagttccaggctattctacctcttcgtggtaaggttatcaatacagccaaggccaagatggcggatatcctcaaaaatgaagagatcaataccatgatttataccattggtgcgggtgttggagcagacttctctattgaagatgccaactatgataagatcattatcatgaccgatgcggataccgacggtgcccatatccagaccttgctcttgacatttttctaccgttacatgcgtccgctagtcgaggcaggtcatgtctatattgccctcccacctctttacaagatgtccaaaggtaaaggaaagaaagaagaagtggcctacgcttggacggacggagaactagaagaactccgtaaacagttcggtaaaggcgctaccctccaacgatacaaaggacttggtgagatgaatgcggaccagctctgggaaacaaccatgaacccagaaacacgtaccctcatccgtgtcacaattgaagatttagcgcgcgccgaacgccgcgtcaatgttctcatgggagataaggtagaaccacgccgtaaatggattgaagataatgtcaagtttacgctagaagaagcgacagtgttttaa

SEQ ID NO: 16 - DNA, 642 bp, Streptococcus pneumoniae
atgattacaatagttttattaatcctagcctatctgctgggttcgattccatctggtctctggattggacaagtattctttcaaatcaatctacgcgagcatggttctggtaacactggaacgaccaacaccttccgcattttaggtaagaaagctggtatggcaacctttgtgattgactttttcaaaggaaccctagcaacgctgcttccgattatttttcatctacaaggcgtttctcctctcatctttggacttttggctgttatcggccataccttccctatctttgcaggatttaaaggtggtaaggctgtcgcaaccagtgctggagtgattttcggatttgcgcctatcttctgtctctaccttgcgattatcttctttggagctctctatcttggcagtatgatttcactgtctagtgtcacagcatcgattgcggctgttatcggggttctgctctttccactttttggttttatcctgagtaactatgactttctcttcatcgctattatcttagcacttgctagtttgattatcattcgtcataaggacaatatagctcgtatcaaaaataaaactgaaaatttggtcccttggggattgaacctaacccatcaagatcctaaaaaataa

SEQ ID NO: 17 - DNA, 1230 bp, Streptococcus pneumoniae
atgggacaattacattttatcacaaaactactcgatatcaaagacacaaatatccaaattatagatgtcgtcaatagggattcacacaaagaaatcatcgccaaactggactacgacgccccatcttgccctgggtgcggaaaccaattgaagaaatatgactttcaaaaaccgtctaagattccttaccttgagacaactggtatgcctactagaatcctccttagaaagcgtcgctttaagtgctatcagtgctcaaaaatagcggtcgctgagacttccctcgtcaagaaaaatcaccaaatccctcgtatcatcaaccaaaagattgctcaaaagttgattgaaaagatttctatgactgatattgcccatcagctttccatctcaacttcaactgttattcgtaagctcaatgattttcactttaaacatgatttttcttgtcttcctgagattatgtcttgggatgagtatgcttttacaaagggaaagatgagcttcattgcgcaagattttaacaatctcaatatcatcactgttcttgagggtagaacacaagctatcattcgaaatcactttcttcgctacgatagagttgtccgatgtcgcgtcaaaattattactatggatatgtttagcccttactatggcttggctaaacagcttcgctttcacattgtacaacatcttagctgtgctatgagtcgtgtgcgtgttcaaatcatgaatcagtttcatcgaaaatcccatgaatacaaggctatcaagcgctactggaagctcatacaacaggatagccgtaaactgagtgataagcgattttatcgtcctacttttcgtatacatttaaccaataaagagattttagacaagcttttgagctattcacaagacttgaaacatcactatcagctctatcaactcttgctgtttcactttcagaataaggaaccggagaaatttttcggactcattgaggacaatcttaagcaggttcatcctatttttcagactgtctttaaaaccttcctcaaagataaagaaaagattgtcaacgcccttcaactacactattctaatgtcaaactggaagcgaccaataatctcatcaaacttatcaagcgcaatgcctttggttttcgaaactttgaaaacttcaaaaaacggattttcatcgctctgaatatcaaaaaagaaaggacaaaatttgtcctttctcgagcttag

SEQ ID NO: 18 - DNA, 834 bp, Streptococcus pneumoniae
atgactgagtttttgttagttcttcttctaaaatccattaaactagctcgttggacctactactatcacttgaaacagctagacaaaacagataaggaccaagagcttaaagctgaaattcaatccatttttatcgaacacaaaggaaattatgcttatcgccgggttcatttagaactaagaaatcgtgcttatctggtaaatcataaaagagttcaaggcttgataaaagtactcaatttacaagctaaaatgcgacagaaacgaaaatattcttctcataaaggagacgttggcaagaaggcagagaatctcattcaaggccaatttgaaggctctaaaacaatggaaaagtgctacacagatgtgacagaatttgccattccagcaagtactcaaaagctttacttatcaccagttttagatggctttaacagtgaaattattgcttttaatctttcttgttcgcctaatttagaacaagtacaaacaatgttggaacaggcattcaaagagaagcactacgagaatacgattctccatagtgaccaaggctggcaatatcaacacgattcttatcatcggttcctagagagtaagggaattcaagcatccatgtcacgtaagggtaacagcccagacaatggtatgatggagtccttctttgggattctgaaatcggaaatgttttacggttatgagaagtcgtttcagtcgtttaagcaattggaacaagctattatagactatattgattactacaacaataaacgaattaaggtaaaactaaaaggacttatccctgtgcaatacagaactaaatccttcggataa

SEQ ID NO: 19 - DNA, 573 bp, Streptococcus pneumoniae
atgaactgcaccccaaaagttagacagaaaaaatctaacttttggggtgtttttattatgaaattaacttatgatgataaagttcagatctatgaacttagaaaacaaggatatagcttagagaagctttcaaataaatttgggataaataattctaatattaggtacatgattaaattgattgatcgttacggaatagagttcgtcaaaaaaggaaaaaatcgttactattctcctgatttaaaacaagaaatgattcataaagtcttacatgaaggctggactaaagatagagtttctcttgaatacggtctcccaagtcgtacgatacttcttaactggctagcacaatacagaaaaaacgggtatactattgttgagaaaacaagagggagagtacctaaaatgggacgtaagccaaaaacgagacctgaagagagaacagaattagaacgtcttcaagcagaaaatgagtacctgagagcggagaaggccatcctaaaaaagttaagagaactccgattgaaggaggaaaaagagaaagaagaaagacagaaattgttcaagaattaa

SEQ ID NO: 20 - DNA, 102 bp, Streptococcus pneumoniae
atgattaaattgattgatcgttacggaatagagttcggcaaaaaaggaaaaaatcgttactattctcctgatttaaaacaagaaatgatttataaagtctga

SEQ ID NO: 21 - DNA, 957 bp, Streptococcus pneumoniae
atgtctattataaccttgctccccctcttggtgtcttctatgctgatttactcagcacctctcatctttacaagtatcggtggtgttttctctgaacgtggtggtgtggtaaacgttggccttgaaggaattatggttatgggtgccttttctggagttgtctttaaccttgaatttgcagaacaatttggagcagcaactccatggctatccttgcttgtagcaggattggttggtagtgttttctctatcatccacgcagcagcgacggttcatttccgtgcagaccatgttgtcagcggtacggtattgaacttgatggcgcctgccttggctgttttcttagttaaagttctttataacaaaggacaaaccgacaacctaagtcaaacttttggacgctttgatttcccagtcttggcaaatatcccagtgattggtgatatcttcttcaagtcaactagtctacttggttatctggcgattgccttctcattccttgcttggtttattctctttaagactcaatttggtcttcgtcttcgctctgtcggtgaacatcctcaagcagcggataccttgggaatcaacgtctacaagatgagatatttagggattattatttcaggttttctaggtggaattggcggagcgatttatgcgcaatcaatctcagttaacttctcagtgacaactattgttggacctggatttatcgcccttgctgcgatgatctttgggaaatggaatccaatcggtgctatgctttctagtctcttctttggactttcacaaagtttggctgttatcggttctcaattgccgttcctacaaggagtgccagcggtttatcttcaaattgcaccttatgttttgacaattcttgtcttagcagccttctttggaaaagcagtcgcaccaaaagcagatggtatcaactacatcaaatcaaaataa

SEQ ID NO: 22 - DNA, 1086 bp, Streptococcus pneumoniae
gtggaaacttgggaaaggagaagagtgatgtctaaaaaattacaacaaatttcggttcccttgatttctgtattcctaggaattttactcggagccattgtcatgtggatcttcggttatgatgctatttggggctacgaagaattgttctatacagcctttggcagtctgcgtgggattggagaaatcttccgtgctatgggtcctctggtcttgattggtcttggttttgcggttgccagtcgagctggtttctttaacgtcggacttcctggtcaggctttggcaggttggattctcagtggttggtttgccctgtcgcatccagatatgccccgtcccttgatgattctagcaaccatcgtgattgccttgattgctggtgggattgtcggagcgattccaggtattcttagggcctatctagggacgtcagaggttattgtaaccatcatgatgaactacattgtcttgtatgtagggaatgcctttatccatgctttccctaaagacttcatgcaaagtacagattcgaccattcgtgttggggctaatgcaacctatcagacaccttggttggctgagttgactggtaactcacggatgaatattggtattttctttgccatcattgccgttgcagttatttggttcatgctcaagaaaacaactcttggttttgaaatccgtgcagttggtcttaatccacatgcttcagaatatgctggtatttctgccaagcggactattatcctatctatgattatttcaggtgccttggcaggtcttggtggatctgttgaaggtttgggaaccttccagaacgtctatgttcaaggttcgtcattagctatcggatttaacggaatggcggttagtttgcttgcggccaactcaccaattggtatactctttgcagccttcctatttggcgttctccaagttggggctcctggtatgaatgcggcgcaggtaccatctgagcttgtcagcattgtaacagcgtctattatcttctttgtcagtgttcattaccttatcgaacgctttgtcaaaccgaaaaaacaagttaaaggaggtaagtaa

SEQ ID NO: 23 - DNA, 1536 bp, Streptococcus pneumoniae
atggcacacgaaaatgtcattgagatgcgtgatattaccaaggtgtttggtggatttgttgctaacgacaaaatcaacttgcacctacgaaaaggtgaaattcatgcacttttaggagaaaatggggctggtaagtccacgctaatgaacatgttagcaggccttcttgaaccaactagtggtgaaatcgcggtcaacggtcaagttgtcaatctcgactccccatctaaagcagctagcttgggaatcgggatggttcaccagcactttatgttggttgaagccttcacagtggctgaaaacatcattttaggtagtgaattgactaaaaatggtgtgctagatatcgctggagctagcaaagaaatcaaggctctttctgaacgttatggcttagctgttgacccttctgccaaggtagcagatatctcagttggagcccaacaacgtgtagaaattttaaaaacactttataggggggctgatatccttatctttgacgaaccaacggctgttttgactccatcagaaattgatgagttgatggctattatgaaaaatcttgtcaaagaaggaaaatcaattatcttgattacccacaaattggatgaaattcgcgcagtttctgaccgtgttacagttatccgtcgtgggaaatcaattgaaaccgttgaaattgcaggggctaccaatgctgatttggcggaaatgatggtaggacgttctgtttcctttaaaacagagaagcaagcctctaaaccaaaagaagtggttttgtctatcaaagatttggtggtcaatgaaaaccgtggtgttccagctgttaaaaatctgtccttggatgttcgtgctggagagattgttggtattgcggggattgatggaaatggtcagtctgaactgattcaagccattacaggtcttcgtaaggttgaatctggtagcattgagctaaaaggagattcaattgtaggcttgcacccacgtcagattacagaactaagtgttgggcacgttccagaagaccgtcaccgtgatggcttgattttggaaatgatgatatctgaaaatattgcccttcaaacctactataaagaaccacatagtaaaaatggaattttgaattattcaaatattacttcttatgctaaaaagctgatggaagagtttgatgttcgcgctgccagtgaattagttcctgcagctgcactctcaggaggaaatcaacaaaaagcaattattgctcgtgaaattgatcgagatcctgatctccttatcgttagtcagccaactcgtgggttggatgtcggtgccattgagtatatccacaaacgcttgattgaagagcgtgataatggcaaggctgtccttgttgtcagctttgaattggatgagattttaaacgtctcagaccgtattgccgttatccacgatggtaagattcaaggtattgtatcaccagaaacaaccaataaacaaggacttggtgtcttgatggctggtggaaacttgggaaaggagaagagtgatgtctaa

SEQ ID NO: 24 - DNA, 420 bp, Streptococcus pneumoniae
ccatttccatcaatccccgcaataccaacaatctctccagcacgaacatccaaggacagatttttaacagctggaacaccacggttttcattgaccaccaaatctttgatagacaaaaccacttcttttggtttagaggcttgcttctctgttttaaaggaaacagaacgtcctaccatcatttccgccaaatcagcattggtagcccctgcaatttcaacggtttcaattgatttcccacgacggataactgtaacacggtcagaaactgcgcgaatttcatccaatttgtgggtaatcaagataattgattttccttctttgacaagatttttcataatagccatcaactcatcaatttctgatggagtcaaaacagccgttggttcgtcaaagataaggatatcagcccccctataa

SEQ ID NO: 25 - DNA, 1092 bp, Streptococcus pneumoniae
ttgcaacatcgttgcacatcttatttaggaggttcagtaatgaacaagaaacaatggctaggtcttggcctagttgcagtggcagcagttggacttgctgcatgtggtaaccgctcttctcgtaacgcagcttcatcttctgatgtgaagacaaaagcagcaatcgtcactgatactggtggtgttgatgacaaatcattcaaccaatcagcttgggaaggtttgcaggcttggggtaaagaacacaatctttcaaaagataacggtttcacttacttccaatcaacaagtgaagctgactacgctaacaacttgcaacaagcggctggaagttacaacctaatctttggtgttggttttgcccttcataatgcagttgaagaagcagctaaagaacacactgacttgaactatgtcttgattgatgatgtgattaaagaccaaaagaatgttgcgagcgtaactttcgctgataatgagtcaggttaccttgcaggtgtggctgcagcaaaaacaactaagacaaaacaagttggttttgtaggtggtatcgaatctgaagttatctctcgttttgaagcaggattcaaggctggtgttgcgtcagtagacccatctatcaaagtccaagttgactacgctggttcatttggtgatgcagctaaaggtaaaacaattgcagccgcacaatacgcagccggtgcagatattgtttaccaagtagctggtggtacaggtgcaggtgtctttgcagaggcaaaatctctcaacgaaagccgtcctgaaaatgaaaaagtttgggttatcggtgttgatcgtgaccaagaagcagaaggtaaatacacttctaaagatggcaaagaatcaaactttgttcttgtatctactttgaaacaagttggtacaactgtaaaagatatttctaacaaggcagaaaaaggagaattccctggcggtcaagtgatcgtttactcattgaaggataaaggggttgacttggcagtaacaaacctttcagaagaaggtaaaaaagctgtcgaagatgcaaaagctaaaatccttgatggaagcgtaaaagttcctgaaaaataa

SEQ ID NO: 26 - DNA, 390 bp, Streptococcus pneumoniae
atggcgactactgagttgattgaactggcaattgaaaccagcaaacatgcctatgtcccctattctcactttcctatcggagcagttttagtagccaaagacggaaatgtttacacgggagtgaatatcgaaaatgttagctatcctttgaccaattgcggtgagagaacagctatttttaaggctatatctgaaggccaaagagaattttcagaattgattgtctatggtcaaactgaaaaaccgatttcaccatgtggtgcttgtcgccaagtaatggtcgaattttttgaacaagatttaaaagtgaccttagtcgcaaaagataaatcgacggtcgagatgacggtcggggagttacttccatattcttttacagacttaaattag

SEQ ID NO: 27 - DNA, 300 bp, Streptococcus pneumoniae
aagtcattattgcaagcttgccttctgacagaccaagaaaaaattgttgtttgccaattggcccaaaaagctggggctgactttgttaacacatctactggcttttcaactggtggtgctacgatagcagatgttagattaatgcgtgaaacagttggatctgatatgggagtcaaggctgctggtggagctcgttcttatgcagatgctcttgcctttgtcgaagcaggtgcgacccgtatcggaacgtcagctggggtagctattttaaaaggagaattggcagatggcgactactga

SEQ ID NO: 28 - DNA, 183 bp, Streptococcus pneumoniae
ttgactcccatatcagatccaactgtttcacgcattaatctaacatctgctatcgtagcaccaccagttgaaaagccagtagatgtgttaacaaagtcagccccagctttttgggccaattggcaaacaacaattttttcttggtctgtcagaaggcaagcttgcaataatgactttcactaa

SEQ ID NO: 29 - DNA, 351 bp, Streptococcus pneumoniae
atgaaattaaataaatatatagatcatacgcttttagaacaagatgcaaagaaagaacaaattgatagtttgttgtctgaggctagagagtatgactttgccagtgtctgcgttaatccgacctgggttgaacatgctaaaaaaggacttgaaggcacagatgttaaggtttgcacagtagtaggtttccctttgggagcaacaacttcagccgtgaaagcatttgagacaaaagaagctatccaaaatggtgcagatgagattgatatggtgatcaatgttggagctctcaaatcaggtaatttagccttggttgagtcagatattcgcgcagtagtggaagcaagtggt

SEQ ID NO: 30 - DNA, 1278 bp, Streptococcus pneumoniae
atgagagcagttgatttaatacaaaaaaaacgagacggtcaagaactgacttcaagtgaaattgaatggctggtagaaggctatgtgtcaggaactgttcctgattatcagatgtctgcctttgctatggctgtttattttaaaggaatgacgactcgagaaatctctgatttaacgatgaatatggttaagactgggcaagagtttgacctgtcagccattgatggtgtgaaagttgacaagcattctactggtggtgtcggcgataaggtaaccttgattttagctcctcttgttgctagcttcggtgtgcctgtagcaaaaatgagtggtcgtggtcttggccatacaggcggaacaattgataaattggagtccattaagggctatcaagtagaacgtagtcaagaggattttattcgtcaggttcaggatattggagtatctgtcattgggcaatcagaccagctggtcaaagcagataagcttctctatgcccttcgtgatgtgaccgcaactgtcgacacgattcctttgattgcgagttcggtgatgagcaagaaaattgcggcaggggcggatgctattttgctagacgtgactgtcggtgagggtgccttcatgaagacggttgatgaggcgcgtgagttggctcaaactatggtagatcttggtaaggttgttggacggaagacagtagcagtgattacggatatgagccagcctttgggacgagcgattggaaatcgtctggaaatccttgaagcattggagattttgcaaggtcaaggacgtcaggatattacccactttatttgtgaattggctcaaattatgcttggtttggcaaatgttaacaagactgttgaagaagttcaccaacatcttgaaaatggtcaagcactggctaagtttgaggaaatggtgcaagcccaaggtggagacttggaagacctctatcgtcctgtaaatgtagctcatgtggtggaaatccctgctcaggaaacgggtgtcatttcagctcttccagctatggactttggtctttatgccatgaggctgggtgctggtcgtgcagttaagtctgatgtcttggactatgaaacaggaattgtttttgaaaagaagattggagactccgttcaaaagggtgaaattgttgcaaaagtatacacaaatgaaaaaattccacctcaactagttacagatttccaaaaatgtgttaaaataagtgatgaagtgaaaaaaatccgtgaaattgtagaaatcatctcctaa

SEQ ID NO: 31 - DNA, 591 bp, Streptococcus pneumoniae
atgagtaaaatgtattatgcagaaaatcctgacgctgctcacgacattcatgagttgagagtggacttgttgggacaaaaaatgacctttttaacggatgcgggtgtttttagcaagaaaatagttgactttggaagtcaactattgctcaagtgtcttgaggtcaaccaaggagaaactgtccttgatgtaggctgtggttacggacctttgggtttgtccttagctaaggcttatggagttcaggctactatggttgatatcaacactcgtgccttggatttagctcggagaaatgctgaaaaaaataatgcaaaagcgacgattttccagtccaacatctatgaacaagttgaaggacattttgatcatgtcatttccaatcctcctatccgtgcgggcaagcaagtcgttcatgaaatcattgagaaaagtaaagatttcttggaaactggtggggatttgacaatcgtcatccagaaaaaacaaggggctccaagtgctaagtccaagatggaggatgtgtttggtaattgtgaaatccttaaaaaagacaaaggatactatatccttagaagtgtgaaagaatga

SEQ ID NO: 32 - DNA, 219 bp, Streptococcus pneumoniae
atgacactattttaccataatttgactcaaattgtaaatcgtttacaaattgataataaaacgaaaaagaccgaagaaagcgagtcacgaagccattttcttcaatctctttcaacacttataaataataaaccatttagaactataaatatcacagtccagataaaaacaaaaagtttatcatctataatcaggcagattattatttctattgcttaa

SEQ ID NO: 33 - DNA, 300 bp, Streptococcus pneumoniae
attctactgatttataagcttataaagggggctttttggttcacaacttataggaggtgtactatgaaaatcttaaaatgttacatattggaactctgttttattttaagttttgctttaccttttataaaaggagccaatgcagataatggtagatgctttgtggaaacctattacggttttacttttttgatggaacatgctattgtaacagctgtctttatctgttcgttcttaattgctttcttactaaaaaacgatgggcgaaatggattgctgcgggtagttattgctttttag

SEQ ID NO: 34 - DNA, 951 bp, Streptococcus pneumoniae
atgatagataaaatacctaggggaaaacaaatgaccaacgaatttttacattttgaaaaaatcagccgccagacttggcaatctttacatcgaaagacaacacctcctttgacagaagaagaattggaatctatcaagagttttaatgaccaaatcagtctccaagacgttacagatatctatctccccttggctcatctgattcagatttacaagcgaactaaggaagatttagccttttcaaaaggaattttcctccaacgtgaaagtaaatctcaaccttttattattggggtttctgggagtgttgccgttggaaaatccacaaccagtcgcctacttcaaatcctactgtcccgtacgtttacagatgctacggttgagttggttacaactgatggttttctctatcccaatcaaaccttgattgagcagggaattttaaatcgtaaaggatttcctgaaagctatgatatggaagctcttctcaacttcttggaccgcatcaaaaatggacaagatgtagatattcctgtctattctcatgaagtttacgacatcgtacccaaaaagaaacaaagtgtcaaagctgctgattttgtaatcgttgagggaattaatgtctttcaaaatccacaaaacgatcgtctctatatcactgacttctttgacttttccatctatgtagatgctggagtggatgatattgaaagttggtatctggaccgtttcttgaaaatgctgagtctagcccaaaacgaccctgatagctactattatcgttttactcagatgccgattggggaagtggagtcctttgcccatcaggtctggaccagtatcaatctcacaaatctgcaaaattatattgaaccaaccagaaatcgtgcagaagtgattcttcataaaagcaagaaccatgaaatcgatgaaatttacttaaaaaagtaa

SEQ ID NO: 35 - DNA, 237 bp, Streptococcus pneumoniae
ttggcaaacattaaatcagctatcaaacgcgctgaattgaacgttaaacaaaacgaaaagaactcagctcaaaaatcagctatgcgtactgctataaaagctttcgaagcaaacccatctgaagaacttttccgtgctgctagctcagctatcgataaagcagaaactaaaggtttgattcacaaaaacaaagcaagccgcgataaagctcgtctttcagctaaacttgctaaataa

SEQ ID NO: 36 - DNA, 525 bp, Streptococcus pneumoniae
atgaaaatcgcaattatcggatattctggttctggtaagtcaactctagcagaaaagttatctaactactactccattccaaaactgcacatggacacactccaatttcaacctggttggcaagacagtgaccacgaatggatgttaaccgagataaaaaactttctcaccaagcataaagcttgggtcatcgatggtaattattcttggtgctactaccaagaacgaatgcaagaagctgaccaaatcatctttctcaatttttcgccattgacctgtctctttagagcctttaagcgttatcttaaataccgtggaaaagtcagagaaagtatggcggcagattgccctgaacgctttgactgggagtttatcagatggattctttgggatggacgtagcaaaactcaaaaagaaaattaccaaaaactttgccaagaatattcacataaagtcactattcttcgaaatcagagagagctagatcaatttctggataagaaaaggaagtcctacaattcataa

SEQ ID NO: 37 - DNA, 711 bp, Streptococcus pneumoniae
atgtctatccatattgctgctcagcagggtgaaattgctgataaaattcttcttcctggggatcctcttcgtgctaagtttattgcggagaatttccttggtgatgctgtttgttttaacgaagtgcgtaacatgtttggttacactggtacttacaagggtcaccgtgtatctgtcatgggaactgggatgggaatgccatctatttcgatttatgcgcgtgagttaatcgtagactacggtgtgaagaaattgattcgtgtgggaactgcaggttctttgaatgaagaggttcatgttcgtgaattagttttggcgcaggcggctgcaaccaactcaaacatcgttcgtaatgactggccacagtacgattttccacaaattgctagctttgatttgcttgataaagcctaccatatcgccaaagaacttggtatgactactcacgttgggaacgttttgtcatctgatgtcttttactcaaattactttgaaaagaatatcgagcttggtaaatggggagtcaaggctgtggaaatggaagcagcagctctttactatcttgctgcccaataccatgttgatgcgctagctatcatgaccatctctgatagcttggtcaatccagacgaagacacaactgcagaagaacgtcaaaataccttcactgatatgatgaaggttggtttggaaaccttgattgcagaataa

SEQ ID NO: 38 - DNA, 513 bp, Streptococcus pneumoniae
gtgtcagcacaaattacgattaaccataaaaaagcgcgctatgttcggattgagctagaaggctataatgccctcagtcttgcagaagttgaagttttccgctttatagctacgaatggtgaaacggcgatacaagtttctaagccagttcaaccaatcagtcagactcctgtgaaggataaaacattgacaattcaacacagtggagcttacattgcccgctactccataacttgggaagaagttccagtagataaagatggaaaccaagttgttcgtagtcattcttgggaaggaaacggtcgcaaccagactgcaggttttgtcctcaacctcccaatcaaagaaaatatgagaaatctgcgagttaagattgagaaaaagacaggtctactatggaatagatggcaaacaatctatgaaaacagaccaattttagctcaacctcaccgtaaaattacccattggggtacgatattgaattccaaggtgagtgacgatgatgtcttgtaa

SEQ ID NO: 39 - DNA, 576 bp, Streptococcus pneumoniae
ttggaaagtcgtaaattagctgttagtggaaaaattaagcattatgtggttgataatgacaatgttgtgactcccttgattcataataatcgtgatattgttacatttacaggtaattcacgctttaaacaccgttctcgtggctattttgaaagtccaatgaatgatattcctaactttaatattggtaaacaagctatcttggataaacatggttatcgtgatccgaaattggataaagtgcgattctttaagaaacaggctctgcctcgatcttctagtcaaccaagcgctgaaccaatggaaaatattgccttaggaaaacaggttactcaaagttcgacagttttcggaggagatgctagaagagctgtggatggcaaagtcgatggtaactatggtcacaattctgtcactcatacaaacttccaatctaagccttggtggcaagtagatttggctaaagaagaaaccattcgccaaatcaatatttacaaccgaacagacactgcccaggatagattggcaaactttgatgtcattcttttagacagttctggtaaagaaattgagtga

SEQ ID NO: 40 - DNA, 408 bp, Streptococcus pneumoniae
gtggtaataggtgtgctagattctaaggaggaattgaaagagtcagaaaatgatgctccaaaactagaaactcctcttagagaggagccaagactagctcctcaaacgcttccggaagcaagtgaagttcttgaaaacaaaagggaagagtcaaaagtagagataacagagccagctcaagcggatgatatccgcaaggttgttggggaattagccaaggatataagtattactaagttgtatatgacaggtcattctcttggaggctacctagctcagattgcagcggttgaagattaccaaaaatatcctgatttttataaccatgtattgaggaaagtgacaactttcagtgctcctaaagtcattacttccagaactgtttgggatgctaagaatggtttctga

SEQ ID NO: 41 - DNA, 810 bp, Streptococcus pneumoniae
atgacatttttaaacaaaatccatgaaactgctactttcctgaaagaaaagggaattgcagcccctgagttcggtctaatccttggatcaggacttggagaattggcagaagaaatcgaaaatccagttgtagtagactatgctgagattccaaactggggccgttcaacagtagtcggtcatgctggtaaattggtatatggtgaactggcaggtcgcaaggtcttggctcttcaaggtcgtttccatttctatgaagggaatcctctggaagtggtgactttcccagttcgtgtgatgaaagttcttggatgtgaaggtgttattgtaaccaatgcagctggcggtatcagatttggtcctggtaccttgatggctatctcagaccatatcaacatgacggggcaaaatccattgatgggtgaaaacttggatgactttggcccacgtttcccagatatgtctagggcctacacaccagaataccgtgccactgcccatgaagtggctaaaaaacttaatatcaagcttgatgaaggtgtctatatcggagttactggtccgacttatgaaacaccagcagaaattcgttcctataagacactgggagcagatgcagttggtatgtctacggttcctgaagttatcgtggcagcccactctggcttgaaagttctgggaatttcatgtatcactaactttgcggctggtttccaagaagaactcaatcacgaagaagttgtagaagtgactgaacgtgttaaaggtgatttcaaaggcttgcttaaagcgattcttgctgaattgtaa

SEQ ID NO: 42 - DNA, 543 bp, Streptococcus pneumoniae
atgacgcgctatgctttgctggtgagaggtatcaatgttggtggtaagaataaggtcgtcatggcggagcttcgtcaagaattgacaaacttgggactggaaaaggttgagagctacatcaacagtggcaatattttctttacttcgatagattccaaagcccaattggttgaaaagctagagactttctttgcagtccattatccatttattcagagcttttctttactgagtctagaggactttgaggcggaacttgaaaatctaccagcttggtggagcagagacttggcacgaaaagattttctcttttacactgagggtttggatgtggaccaagtcatcgcgacagttgaaagtttagagctgaaagatgaagtgctttattttggaaaacttgggattttctgggggaaattttctgaagaatcctattctaagactgcctatcagaagtacttgctgaaggtgcctttctaccgccacattactattcgtaatgctaaaacctttgacaaaattggtcaaatgctaaaaaaataa

SEQ ID NO: 43 - DNA, 1212 bp, Streptococcus pneumoniae
atgtctaaatttaatcgtattcatttggtggtactggattctgtaggaatcggtgcagcaccagatgctaataactttgtcaatgcaggggttccagatggagcttctgacacactgggacacatttcaaaaacagttggtttgaatgtcccaaacatggctaaaataggtcttggaaatattcctcgtgaaactcctcttaagactgtagcagctgaaagcaatccaactggatatgcaacaaaattagaggaagtatctcttggtaaggatactatgactggacactgggaaatcatgggactcaacattactgagcctttcgatactttctggaacggattcccagaagaaatcctgacaaaaatcgaagaattctcaggacgcaaggttattcgtgaagccaacaaaccttattcaggaacggctgttatcgatgattttggaccacgtcagatggaaactggagagttgattatctatacttcagctgaccctgttttgcagattgctgcccacgaagacattattcctttggatgaattgtaccgtatctgtgaatacgctcgttcgattacccttgagcgtcctgcccttcttggtcgcatcattgctcgcccttatgtaggtgaaccaggtaacttcactcgtacggcaaaccgtcgtgacttggctgtatctccattttccccaactgttttggataaattgaatgaggctggtatcgatacttatgctgtgggtaaaatcaacgatatctttaacggtgctggtatcaaccatgacatgggtcacaacaagtcaaatagtcatggaattgatacactattgaagactatgggacttgctgagtttgaaaaaggattctcattcacaaacctagttgactttgatgccctttacggccatcgtcgtaatgctcacggttaccgtgattgcttgcatgagtttgatgaacgcttacctgaaattatcgcagctatgagagagaatgaccttctcttgattactgcggaccatggaaatgacccaacgtatgcaggaacggatcacactcgggaatatattccattgttggcctatagccctgcctttaaaggaaatggtctcattccagtaggacattttgcggatatttcagcgactgttgccgataactttggtgtggaaactgctatgattggggaaagtttcttagataaattggtataa

SEQ ID NO: 44 - DNA, 741 bp, Streptococcus pneumoniae
ttgaataaaaagcggtttcatagtaaaataagaactgagaatgatggaggtaaatcggtggaaaatctgaagaaaatggcaggtatcaaggctgctgagttcgtgagcgatggaatggtcgttggacttggaacaggctcgactgcctattattttgtcgaagaaatcggtcgtcgtatcaaggaagaaggattgcagattacagctataacaacttctagtgtgaccactaaacaggcagaaggccttaatatcccgctcaagtctattgaccaagtagactttgtcgatgtgacggttgatggcgcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaagtctttcgtcattttgaacgagctggctacaaaccaagtttccgtgaaaaagacggccaacgttttgtgacggatatgcagaattttatcattgacctcgccttggatgttattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 45 - DNA, 186 bp, Streptococcus pneumoniae
aaatatgcattttatttttaccaaacgaataaaaatgagtttatctttgatgtatttgacttgttcatctctttccagctacgaaaacaaactcttaactttgatacgtctagtttagccttaaagcaggcgcatttcaagaatcataaattaagagaaggaagtagatgtatctgtctattttaa

SEQ ID NO: 46 - DNA, 873 bp, Streptococcus pneumoniae
atgaaagtgattaatcaaaccttattagaaaaagttattattgaacgttctcgttcaagtcataaaggagattatggtcgtctgctgctgcttggtggtacttatccttatggtggtgctatcatcgtggctgctttggcagctgtgaaaagtggggcaggattggtgactgttggaacggatagggaaaatatccctgctctgcacagtcatttacctgaggctatggcctttgctcttcaagacaagcaattgttaaaagagcagttggagaaggcagaagttgttttgctgggacctggtttaggagacgatgcttctggagaagatttagttaaacaggtctttgctggcttaaaacagaatcagattttgattgtagacggaggtgccttgactattcttgctaggacaagtctgtcatttccttctagccagcttatcctaactccccaccaaaaggagtgggaaaaactgtctggaattacgattgaaaagcaaaaggaagatacaacggctagtgccctgacttctttccctaaaggaacaattttggtggagaaaggtccggctactcgtgtttggcaagctggccagtctgattattaccagttacaggttggcggtccctatcaggcaactgggggaatgggagatactctggctgggatgatcgcaggatttgtaggccaattccgacaggccagtctctacgagcgtgtagcagtagcgacccatcttcattcagccatagcccaagaactatctcaagaaaattatgtggtcttaccgacggaaatcagcaggtatcttcccaaaataatgaaaattatttgtcaacaagagagggtaagcaaagataaacttgtttaa

SEQ ID NO: 47 - DNA, 921 bp, Streptococcus pneumoniae
gtgttagagggcacttgcagtttttggtataatggaagatatttgaaagaaaagagaagtgatatgacacagattattgatgggaaagctttagcggccaaattgcaggggcagttggctgaaaagactgcaaaattaaaggaagaaacaggtctagtgcctggtttggtagtgattttggttggggataatccagccagccaagtctacgttcgcaacaaggagaggtcagctcttgcggctggttcccgtagcgaagtagtgcgagttccagagactattactcaagaggaattgttagacctgattgctaaatataatcaggatccagcttggcatgggattttggtccagttgccattaccaaaacatatcgatgaagaggcggttttattagccattgacccagaaaaggatgtggatggtttccatcccctaaacatgggacgtctttggtctggacatccagtcatgattccctcgacacctgcaggaattatggaaatgtttcatgaatatgggattgacttggaaggtaaaaatgcggtcgtaatcggtcgttcaaatatcgttggaaaacctatggctcagcttcttttggctaaaaatgcgacagtaaccttggcccactcacgaactcataatcttgccaaggtggctgctaaagcagatattcttgtagtcgcaatcggccgcgccaagtttgtgactgctgactttgtcaaaccaggtgcggttgtcattgacgttgggatgaatcgagatgaaaatgggaagctctgtggagatgttgattatgaggcagttgcaccacttgctagccatatcacgccagtccctggaggtgtcggtcctatgaccattaccatgctgatggagcaaacttatcaagcagcacttcggacattggatagaaaataa

SEQ ID NO: 48 - DNA, 216 bp, Streptococcus pneumoniae
tctgccacctcacgggcaaatcccatctcatgtgttacgataaccatagtcatccctgacttggcaaggtcttgcataacagccaatacctcacctaccatttcaggatccaaggctgaagttggttcgtcaaagagcaaaacatctggttccatagccaacccacgcgcgatggcaatccgttgttgttgcccacccgacagactctgtggataa

SEQ ID NO: 49 - DNA, 735 bp, Streptococcus pneumoniae
atgacagaaaccttgataaaaattgaaaatttacataaatcttttggaaagaatgaagtattgaagggcatcaacctcgagattaaaagaggagaagttgtcgttatcatcggtccttcagggagtgggaaatctaccttgcttcgctctatgaatttgttggaggaagcaaccaaggggaagcttatctttgagggagtcgatattacggacaagaagaatgacctgtttgccatgcgtgagaagatgggcatggttttccaacaatttaacctctttcctaatatgactgtgatggaaaatattaccttgtcacctatcaagactaaaggtgaaagcagggaagttgctgagaagagagcccaagagcttttggaaaaagttggtttgccagataaggcagacgcttatccacagagtctgtcgggtgggcaacaacaacggattgccatcgcgcgtgggttggctatggaaccagatgttttgctctttgacgaaccaacttcagccttggatcctgaaatggtaggtgaggtattggctgttatgcaagaccttgccaagtcagggatgactatggttatcgtaacacatgagatgggatttgcccgtgaggtggcagatcgtgttatctttatggcagacggtgtggttgttgaagatgggacacctgagcagatttttgaacaaacccaagaacaacggactaaagatttcttgagtaaggttttataa

SEQ ID NO: 50 - DNA, 384 bp, Streptococcus pneumoniae
ttgataggtgacaaggtaatattttccatcacagtcatattaggaaagaggttaaattgttggaaaaccatgcccatcttctcacgcatggcaaacaggtcattcttcttgtccgtaatatcgactccctcaaagataagcttccccttggttgcttcctccaacaaattcatagagcgaagcaaggtagatttcccactccctgaaggaccgatgataacgacaacttctcctcttttaatctcgaggttgatgcccttcaatacttcattctttccaaaagatttatgtaaattttcaatttttatcaaggtttctgtcattatttcttatctccttgtcccatatgtttttcaaaagctttcaaggctactgtcagaatag

SEQ ID NO: 51 - DNA, 684 bp, Streptococcus pneumoniae
atgaatttttcttttttacctaagtatttaccttattttaactatggggctgttgtgacgattcttatttctatctgtgttatctttttgggaactattttgggtgttgtcttggcttttgggcaacgttcaaagtttaaaccgcttgtttggttggccaacttgaacgtttggattttccgtgggacaccgatgatggttccaattatgattgcctttgctcttatgcatatcaatgctccgactattcagattggaattttaggtgttgatttttcgcgtctgattccagggattttgattatctctatgaatagtggtgcttatgtttcggagactgttcgtgccggaatcaatgcggttccaaaaggtcagctagaggcggcttattcgctagggattcgtcctaaaaatgcgatgcgttatgtgattttgccacaagcagtcaaaaatatcttgccagcattggggaacgaatttatcaccattatcaaggacagctccctcttatcagctattggggtcatggagttgtggaatggggctacaacagtttctacaacaacctatctacctttaacaccacttttatttgcagcattttactacttgattatgacctctattctgacagtagccttgaaagcttttgaaaaacatatgggacaaggagataagaaataa

SEQ ID NO: 52 - DNA, 231 bp, Streptococcus pneumoniae
atggaatcacatttggttagaatcatcaaccgccttgaagcaatggcaaacgatggcggaaatttaaaacgtaattttgaacgcgaaggagttgttgttgcagaagttgcgtacagccacgacgaagaaaacggcccaatctttacccttcgtgacgtagaagatcgcgaaacgtatacgtttgatagcattgacttaatcgcaatggaaatttacgaacttctctactaa

SEQ ID NO: 53 - DNA, 2259 bp, Streptococcus pneumoniae
atgctttgtcaaaactgtaaaattaacgactcaacaattcatctttacaccaatctcaatggaaaacaaaaacaaattgacctctgtcaaaactgctataagattatcaaaacagatcctaacaatagcctcttcaaaggtatgacggatctgaacaatcgtgacttcgatccctttggtgatttcttcaatgatctaaacaatttcagaccttctagcaatactcctcctattcccccaacccaatcaggtggaggttacggtggaaacggcggttatggttcccaaaatcgtggatctgctcaaactccgccacctagccaagaaaaaggcctgctgaaagaatttggtattaatgtaactgaaattgcccgtcgtggagacattgaccccgttattgggcgcgacgatgagattatccgtgtcatcgagattctcaatcgtagaaccaagaataatcctgtccttatcggtgaacctggtgtcggaaaaacggccgttgtcgaaggtctagctcagaaaattgtcgatggcgatgtgccacataaactccaaggtaaacaagtcatccgtctggatgtggttagcttagttcaaggaacggggattcgaggacaatttgaagaacgcatgcaaaaactcatggaagaaattcgcaaacgtgaagacatcatcctctttatcgatgaaatccatgaaattgttggtgctggttctgcgagtgatggtaatatggacgcaggaaatatcctcaagccagcccttgctcgtggagaactgcaactagtcggtgctactaccctcaatgaataccgtatcattgaaaaggatgctgccctcgagcgtcgtatgcagcctgttaaagtcgatgaaccaacggtggatgaaacaatcactattctcaaagggattcaaaagaaatacgaagattaccaccacgttcaatataccgatgctgcgattgaagcagctgcaactctttccaatcgctacatccaagatcgcttcttgcctgacaaggccattgacctcctagatgaagctggttctaagatgaacttgaccttgaattttgtggatcctaaagtaattgatcagcgcttgattgaggctgaaaatctcaagtctcaagctacacgagaagaagattttgagaaggcggcctacttccgcgaccagattgccaagtataaggaaatgcaaaagaaaaagatcacagaccaggatactcctatcatcagcgagaaaactattgagcacattatcgagcagaaaaccaatatccctgttggtgatttgaaagagaaagaacaatctcaactcatccatctagccgaagatctcaagtctcatgttattggccaagatgatgcagtcgataagattgccaaggctattcgccgtaatcgtgtcggacttggtacccctaaccgcccaatcggaagcttcctcttcgttgggccaactggtgtcggtaagacagaactttccaaacaactggctatcgaactttttggttctgctgatagtatgattcgctttgatatgagtgaatacatggaaaaacatagtgtagctaagttggtcggcgctcctccaggttatgttggctatgatgaggctggtcaattaactgaaaaagttcgccacaatccatattctctcatccttctcgatgaagtggaaaaagctcacccagatgttatgcacatgtttcttcaagtcttggacgatggtcgtttgacagacgggcaaggacgcaccgttagcttcaaggatgccatcattatcatgacctcaaatgcaggtacaggaaagaccgaagctagcgttggatttggtgctactagagaaggacgtaccaattctgtcctcggtgaactcggtaacttctttagcccagagtttatgaaccgttttgatggcattatcgaatttaaggctctcagcaaggataacctccttcagattgtcgagctcatgctagcagatgttaacaagcgcctctctagcaacaacattcgtttggatgtaactgacaaggtcaaggaaaagttggttgacctaggttatgatccaaaaatgggagcacgcccacttcgtcggactattcaagactatattgaggacacaatcactgactactaccttgaaaatccaagcgaaaaagatctcaaagcagttatgactagcaagggaaacattcagattaaatctgccaaaaaagctgaagttaaaagttctgaaaaagaaaaataa

SEQ ID NO: 54 - DNA, 249 bp, Streptococcus pneumoniae
gaggtcaatggccttgtcaggcaagaagcgatcttggatgtagcgattggaaagagttgcagctgcttcaatcgcagcatcggtatattgaacgtggtggtaatcttcgtatttcttttgaatccctttgagaatagtgattgtttcatccaccgttggttcatcgactttaacaggctgcatacgacgctcgagggcagcatccttttcaatgatacggtattcattgagggtagtagcaccgactag

SEQ ID NO: 55 - DNA, 183 bp, Streptococcus pneumoniae
atgttattggccaagatgatgcagtcgataagattgccaaggctattcgccgtaatcgtgtcggacttggtacccctaaccgcccaatcggaagcttcctcttcgttgggccaactggtgtcggtaagacagaactttccaaacaactggctatcgaactttttggttctgctgatagtatga

SEQ ID NO: 56 - DNA, 210 bp, Streptococcus pneumoniae
atgtattcactcatatcaaagcgaatcatactatcagcagaaccaaaaagttcgatagccagttgtttggaaagttctgtcttaccgacaccagttggcccaacgaagaggaagcttccgattgggcggttaggggtaccaagtccgacacgattacggcgaatagccttggcaatcttatcgactgcatcatcttggccaataacatga

SEQ ID NO: 57 - DNA, 342 bp, Streptococcus pneumoniae
ttggttgcaggtctaacaaatggtgagttaatcgctccaataacttacgaagagatgatgacgagcgacttttttgaagcttggtttcagaagtttctcttaccaacattaaccacaccatcggttattattatggataatgcaagattccatagaatggggaagctagaacttttatgcgaagagtttgggcataaacttttacctcttcctccctactcacctgagtacaatcctattgagaaaacatgggcccatatcaaaaagcacctcaaaaaggtattaccaagttgttgcaataccttttacgaggctcttttgtcctgctcttgtttcaattga

SEQ ID NO: 58 - DNA, 348 bp, Streptococcus pneumoniae
atgtggtataatctttttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaagttgatagagatagacttaaaaactatcttactgacaatccagacgcttatttgactgaaatagcttctgaatttggctgtcatccaactaccatccactatgcgctcaaagctatgggctacactcgaaaaaaagaaccacagctactatga

SEQ ID NO: 59 - DNA, 423 bp, Streptococcus pneumoniae
gtgaatacagactatattgctcgctatggcgtatatgcagttatccctaatcctgaacaaaaacaaattgttcttgttcaagaaccaaatggtgcttggttcctaccatgtggaaaaattgaagcaggtgaaaatcatcaggaagccctaaagcgtgagttgattgaagagcttggtttcacagcagaaattggtacctattacggacaagctgacgaatatttctattctcgtcatcgtgatgcctactactacaatcctgcctacctctatgaagcaactcctttcaaagaagtacaaaagccactagaaaactttaatcatattgcctggttccctattgacgaggctatcaaaaaccttaaacgtggtagccataaatgggccattgaatcttggaaaaaacagcataagattgactaa

SEQ ID NO: 60 - DNA, 300 bp, Streptococcus pneumoniae
atgaagcttatcaatacgacaaactcacactcgcaacttgtaaaaagtcaactagaaagtaccgatgcaacccttgttgaggtttattctgcagggaatacagatgttatttttacccaagctccgcttcactatgaaatcctcatctcaaacaaacaccgtgctattcgtgagcctgaaatcgaaaccattcaagaatttttcttgaaacgtaaaattgataaggcctctgttgatgaagccaatatcaagacactctactcagagaaattaattggaatttcaatcccaatcaagtaa

SEQ ID NO: 61 - DNA, 594 bp, Streptococcus pneumoniae
aagtactcaatttacaagctaaaatgcgacagaaacgaaaataaaggagacgttggtaagaaggcagagaatctcattcaaggccaatttgaaggctctaaaacaatggaacagtgctacatagatgtgactgaatttgccattccagcaagtactcaaaagctttacttatcaccagttttagatggctttaatagcgaaattatcgcctataatctttcaacttcacccaacttagaacaagtacaaacaatgttggaacaggcattcaaagagaagcactacgagaatacgattctccatagtgaccaaggctggcaataccgacacgattcttatcatcggttcctagagagtaagggaattcaagcatctatgtcacgtaagggtaacagcccagacaatggtatgatggagtccttctttgggattctgaaatcggaaatgttttacggttatgagaagtcgtttcagtcgcttaagcaattggaacaagccattgtagactatattgattactacaacaataagagaattaaggtaaaactaaaaggacttagccctgtgcaatacagaactaaatccttcggataa

SEQ ID NO: 62 - DNA, 264 bp, Streptococcus pneumoniae
ttttcgttagatcttcttctaaaagccattaaactagctcgttcgacctactactatcacttgaaacagctagataaaacagataaggaccaagagcttaaagctgaaattcaatccatttttatcgaacacaagggaaattatgcttatcgtcggatttatttagaactaagaaatcgtgcttatctggtaaattataaaagagttcaaggcttgatgaaagtactcaatttacaagctaaaatgcgacagaaacgaaaataa

SEQ ID NO: 63 - DNA, 102 bp, Streptococcus pneumoniae
atgattaaattgattgatcgttacggaatagagttcggcaaaaaaggaaaaaatcgttactattctcctgatttaaaacaagaaatgattcataaagtctga

SEQ ID NO: 64 - DNA, 351 bp, Streptococcus pneumoniae
atgataattcaactaagtgatttaggtcaagttcaccttgtttgtagcaagatagatatgaggcagggaatagactcattagcctatgtagttaaaacccactttgaattggatcctttctccggtcaagtctttctcttttgtggtggacgtaaagaccgctttaaagccctttactgggatggtcaaggattttggctactatataaacgctttgagaacggcagactgacttggcccagtacagaaaaggatgtcaaagctctcacacctgaacaagtagactggcttatgaagggcttttctatcactccaaaaataaatccatcagaaagtcgtgatttctattga

SEQ ID NO: 65 - DNA, 306 bp, Streptococcus pneumoniae
ttgttatggacccatacaggcgaatcatttttcttaatagctggtggatgtaatactgagtggatgaacgtctttttagaagagctttcacaagcttatccagatgattaccttttattcgttatggacaatgctatatggcataaatcaagtaccttaaagattccgactaatattggctttgcatttattcctccgtacacaccagagatgaaccccattgaacaagtgtggaaagagattcgtaaacgtggatttaaaaataaagcctttcaaactttggaagatgtcatgaatcaactttaa

SEQ ID NO: 66 - DNA, 267 bp, Streptococcus pneumoniae
atgacggttggggaagagaaagcctttcttgcccgccatttgaaggctacagaggcaggagaatttgttacaattgatgccttatttcaggcttataaaaaggagttaggtcgttcctacacacgtgatgccttctatcaactgttgaagcgccatggttggcgaaatattatgccacgtccagaacatcctaggaaaacagacgctcaaaccattgtcgcgtctaaaaataaaatctcaattcaagaagaaaagaaagcgctttaa

SEQ ID NO: 67 - DNA, 1728 bp, Streptococcus pneumoniae
atgtctaatggacaactaatttatttaatggttgcaattgcagtcattttagttctggcttatgtagtggcaatctttctacgtaagcgaaacgaggggagattagaggcgctagaagaaagaaaagaagaactatacaatcttccagtaaatgatgaagtagaagctgtaaaaaatatgcacttgattggacaaagtcaagtggctttccgtgaatggaatcaaaaatgggtcgatttatctctcaactcttttgccgatattgaaaataatctctttgaagcagaaggttataaccattcatttcgttttctcaaggccagtcatcaaattgaccaaattgagagtcaaattactttgattgaagaagatattgcggcaattcgcaatgctttggcagacttagagaagcaagaatctaaaaatagtggtcgtgttcttcatgctttggatttatttgaggaacttcagcatagagttgctgaaaattcagaacagtatggtcaagccttggatgaaattgaaaaacaattagaaaatatccaatctgaattttcacaatttgtaaccttgaattcatcgggtgaccctgtggaagccgcagtgattttggataatacagaaaatcacattttggccttaagtcatattgtggatcgtgttccagccttggttacgacgctttctacagaattgccagatcaattacaggatttggaagccggttatcgtaaactaattgatgctaattatcattttgttgaaacggatattgaagcgcgtttccacttgctttatgaagcattcaagaaaaaccaagagaatattcgtcagttggaattggataatgccgaatatgagaatggacaggcacaagaggaaatcaatgccttgtatgatatttttactcgagaaattgctgctcagaaagtagtggaaaatctacttgcaactcttccaacttaccttcaacatatgaaagagaataatactttattgggagaagatattgcacgtttgaacaagacctatttacttcctgagacagctgcaagccatgttcgtcgtattcagacagaattagagagttttgaggcagctattgttgaggtaacttcaaatcaagaagaaccaacccaagcttattcagttcttgaagaaaatcttgaggatttacaaactcaactaaaagatattgaagatgagcaaatttcagttagtgagcgcctgacacaaattgagaaagatgatattaatgcacgtcaaaaggccaatgtttatgtcaatcgtctccatactatcaagcgatacatggaaaaacgcaatctgccaggtattccacaaactttcttgaagttattctttacggcaagcaataataccgaggatttaatggttgagttagaacaaaaaatgattaacattgaatctgttacccgagttcttgaaattgcaacgaatgatatggaagctttagaaacggaaacttataatattgtacaatatgcaactttgacagagcaactcttgcaatattctaaccgctatcgctcatttgatgaacgcattcaagaagcatttaacgaagctttagatatttttgaaaaagaatttgattatcacgcttcatttgataagatttctcaagcattggaagtggcagagcctggtgtaaccaatcgctttgttacctcatatgagaaaacacgtgaaacgattcgtttttaa

SEQ ID NO: 68 - DNA, 1947 bp, Streptococcus pneumoniae
atgacagaagaaatcaaaaatctgcaggcacaggattatgatgccagtcaaattcaagttttagagggcttagaggctgttcgtatgcgtccagggatgtacattggatcaacctcaaaagaaggtcttcaccatctagtctgggaaattgttgataactcaattgacgaggccttggcaggatttgccagccatattcaagtttttattgagccagatgattcgattactgttgtggatgatgggcgtggtatcccagtcgatattcaggaaaaaacaggccgtcctgctgttgagaccgtctttacagtccttcacgctggaggaaagttcggcggtggtggatacaaggtttcaggtggtcttcacggggtggggtcgtcagtagttaatgccctttccactcaattagacgttcatgttcacaaaaatggtaagattcattaccaagaataccgtcgtggtcatgttgtcgcagatcttgaaatagttggagatacggataaaacaggaacaactgttcacttcacaccggacccaaaaatcttcactgaaacaacaatctttgattttgataaattaaataaacggattcaagagttggcctttctaaatcgcggtcttcaaatttcaattacagataagcgccaaggtttggaacaaaccaagcattatcattatgaaggtgggattgctagttacgttgaatatatcaacgagaacaaggatgtaatctttgatacaccaatctatacagacggtgagatggatgatatcacagttgaggtagccatgcagtacacaactggttaccatgaaaatgtcatgagtttcgccaataatattcatacacatgaaggtggaacgcatgaacaaggtttccgtacagccttgacacgtgttatcaatgattatgctcgtaaaaataagttactgaaagacaatgaagacaacctaacaggggaagatgttcgcgaaggcttaactgcagttatctcagttaaacacccaaatccacagtttgaaggacaaaccaagaccaaattgggaaatagcgaagtggtcaagattaccaatcgcctcttcagtgaagccttctccgatttcctcatggaaaatccacagattgccaaacgtatcgtggaaaaagggattttagctgccaaggctcgtgtggctgccaagcgtgcgcgtgaagtcacacgtaaaaaatctggtttggaaatttccaaccttccagggaaactagcagactgttcttctaataaccctgctgaaacagaactcttcatcgtcgaaggagactcagctggtggatcagccaaatctggtcgtaaccgtgagtttcaggctatccttccaattcgcggtaagattttgaacgttgaaaaagcaagtatggataagattctagctaacgaagaaattcgtagtcttttcacagccatgggaacaggatttggcgcagaatttgatgtttcgaaagcccgttaccaaaaactcgttttgatgaccgatgccgatgtcgatggagcccacattcgtacccttcttttaaccttgatttatcgttatatgaaaccaatcctagaagctggttatgtttatattgcccaaccaccaatctatggtgtcaaggttggaagcgagattaaagaatatatccagccgggtgcagatcaagaaatcaaactccaagaagctttagcccgttatagtgaaggtcgtaccaaaccgactattcagcgttataaggggctaggtgaaatggacgatcatcagctgtgggaaacaaccatggatcccgaacatcgcttgatggctagagtttctgtagatgatgctgcagaagcagataaaatctttgatatgttgatgggggatcgagtagagcctcgtcgtgagtttatcgaagaaaatgctgtctatagtacacttgatgtctaa

SEQ ID NO: 69 - DNA, 573 bp, Streptococcus pneumoniae
atgaagggtatgaaatatcacgattacatctgggatttaggtggaactttactggataattatgaaacttcaacagctgcatttgttgaaacattggcactgtatggtatcacacaagaccatgacagtgtctatcaagctttaaaggtttctactccttttgcgattgagacattcgctcccaatttagagaattttttagaaaagtacaaggaaaatgaagccagagagcttgaacacccgattttatttgaaggagtttctgacctattggaagtcatttcaaatcaaggtggccgtcattttttggtctctcatcgaaatgatcaggttttggaaattttagaaaaaacctctatagcagcttattttacagaagtggtgacttctagctcaggctttaagagaaagccaaatcccgaatccatgctttatttaagagaaaagtatcagattagctctggtcttgtcattggtgatcggccgattgatatcgaagcaggtcaagctgcaggacttgatacccacttgtttaccagtatcgtgaatttaagacaagtattagacatataa

SEQ ID NO: 70 - DNA, 555 bp, Streptococcus pneumoniae
atggtaaaagtagcagttatattagctcagggctttgaagaaattgaagccttgacagttgtagatgtcttgcgtcgagccaatatcacatgtgatatggttggttttgaagagcaagtaacgggttcgcatgcaatccaagtaagagcagatcatgtctttgatggagatttatcagactatgatatgattgttcttcctggaggtatgcctggttctgcacatttacgtgataatcagaccttgattcaagaattgcaaagcttcgagcaagaagggaagaaactagcagccatttgtgcggcaccaattgccctcaatcaagcagagatattgaaaaataagcgatacacttgttatgacggcgttcaagagcaaatccttgatggtcactatgtcaaggaaacagtagtggtagatggtcagttgacaaccagtcggggtccttcaacagcccttgcctttgcctacgagttggtggagcaactaggaggggacgcagagagtttacgaacaggaatgctctatcaagatgtctttggtaaaaatcagtaa

SEQ ID NO: 71 - DNA, 1251 bp, Streptococcus pneumoniae
ttgtatgaaagtataaggttagtatatatgaaacgttctctcgactcaagagtcgattacagtttgctcttgccagtattttttctactggtcatcggtgtggtggctatctatatagccgttagtcatgattaccccaataatattctgcccattttagggcagcaggtcgcctggattgccttggggcttgtgattggttttgtggtcatgctctttaatacagaatttctttggaaggtgaccccctttctatatattttaggcttgggacttatgatcttgccgattgtattttataatccaagcttagttgcatcaacgggtgccaaaaactgggtatcaataaatggaattaccctattccaaccgtcagaatttatgaagatatcctatatcctcatgttggctcgtgtcattgtccaatttacaaagaaacataaggaatggagacgcacggttccgctggactttttgttaattttctggatgattctctttaccattccagtcctagttcttttagcacttcaaagtgacttggggacggctttggtttttgtagccattttctcaggaatcgttttattatcaggggtttcttggaaaattattatcccagtatttgtgactgctgtaacaggagttgctggtttcttagctatctttattagcaaggacggacgagcttttcttcaccagattggaatgccgacctaccaaatcaatcggattttggcttggctcaatccctttgagtttgcccaaacaacgacttaccagcaggctcaagggcagattgccattgggagtggtggcttatttggtcagggatttaatgcttcgaatctgcttatcccagttcgagagtcagatatgatttttacggttattgcagaagattttggctttattggctctgtcctggttattgccctctatctcatgttgatttaccgtatgttgaagattactcttaaatcaaataaccagttctacacttatatttccacaggtttgattatgatgttgctcttccacatctttgagaatatcggtgctgtgactggactacttcctttgacggggattcccttgcctttcatttcgcaagggggatcagctattatcagtaatctgattggtgttggtttgcttttatcgatgagttaccagactaatctagctgaagaaaagagcggaaaagttccattcaaacggaaaaaggttgtattaaaacaaattaaataa

SEQ ID NO: 72 - DNA, 2451 bp, Streptococcus pneumoniae
atgaaaacgattggtaatcgctatgttgtggtggatttagaggcaactagcacaggtagtaaggctaaaattatccaagtgggaattgtcgtgattgaggacggagaaatcgtcgatcactatacgacggatgtcaatccacatgaacccttggatgctcatatcaaagaactgacaggattgacagaccaacgtctggcgcaagcacctgatttttcgcaagttgccagaaaaatatttgacttggtggaggatgggatttttgtagcccataatgttcagtttgatgctaatctcttggcggaaaatttattttttgaaggctatgagctaagaaaccctcgtgttgatacggtcgaattggcccaggtctttttccctgaactggaaaaatatagcttgccgattttgtgtcgagaattaggaattcctcttaaacacgcacacacagccctttcagatgcccaagctacagcagaattacttctttttttacgggaaaagatgacccagcttcctaaaggtctcttggaacgcttgctggaaatggctgacgctctcctatatgagtcctacctggttattgaggaaacttatcgcaaccaatctatcctgagttctccagacttggtccaagttcaaggtctgtattttaagaaaacggcagcttctctggagctacgaaaactatctcaagacttttctaaaaatatttctctgttgaaccttgaagtgagggaggaacaagaaagttttgctaaagaggttggcttgctattgaaagatgaacctgtctttctgattcaagcgccgacagggattgggaaaacctatggctatctcttacccgctttatctcaatccaaagagcgacaaattgttcttagtgttccgacaaagattcttcaaaatcaaatcatggaagaagaaggtaaacgtctcaaggaagtgttccatacagatattcatagcttaaagggaccacaaaattatctgaagttggatgccttttatcattccttgcaggaaaatgatgaaaatcgcttatttagacgctttaaaatgcaagtcttggtctggcttactgagacagagacaggagatttggatgaaatcgggcaactctaccgttaccaacattttctagcagaccttcgtcatgatgggaatttatcatcccagagcttatttgtgacggaagatttttggaaacgtagtcaagaaagggcagagacttgcaagcttttagtgactaatcatgcctatctcgtgaccagacttgaagataatcctgaatttgtcagtgaccgtttactgattattgatgaagtccaaaagattttgttagctctagaaaatctgcttcaagagacctacgatatacaatctattatcgatttaattgataaggctttagtaggagaagaaaacagggttcaacaacggatactagaaagtattcgctttgagtgtctctacttgatagaacaatttcagtctggtaaatctaggaaaaatatcttagattctctggacaatctccatcagtatttttcagaattagaagtagaaggctttgatgagctggttcgctattttacagctgaaggtgattactggcttgaagtaactgaaacgagtcaaaagaaaattcagatttcttctacaaaatcaggccgtactcttctgtcctctttacttcctgagagttgccaagtcctgggagtatcggctactcttgagattagtcagagggtttctttggcagaccttttaggctatcctgaagctaaatttgtcaagattgaatctcggggaaaacaggaacaagaagtggtcatggtcaaagatttccctctggtaacagaaacctccttagaagtctatgccagagaggtagctgctttactagtggaaattcaagctttccagcaaccgattttggttctctttaccgctaaagacatgcttctagcagtatcggatttacttacagttagccacttggcccagtataaaaatggggatgttcatcagctaaagaaacgctttgaaaaaggtgaacaacaaatcttgcttggtgcagcaagtttctgggagggagttgatttttcaagccatccttttgtgattcaagttgtaccgaggcttcctttccaaaatcctcaagaacccttgacgaaaaagattaatcaagaactgaatcaagaagggaaaaatgccttttatgattatcaattgccaatggccattattcgtttaaaacaggctttgggaagaagtatgagacgtgaataccaacgttccttaactcttattttggataggagaatcgtcggaaaacgatacggcaaacaaatagtagcatctctagcagaagaagcgactgttaaaaccatctctcgatccgaagttgacgaggctattgatagattttttaatgaactttga

SEQ ID NO: 73 - DNA, 930 bp, Streptococcus pneumoniae
atggaaaagattgtcattacagcaactgctgaaagtattgaacaagttgaacaactactcgaagctggcgtagaccgtatctatgtcggtgagaaagattttggccttcgtctgccaacgacctttagttatgaccaattacgtgaaatcgctaagttggttcatgatgctggtaaggaattgatcgttgcggtcaatgctctcatgcaccaagatatgatggaccgtatcaagcctttcttagacttcttggaagaaatcaagacagactatattacgattggggatgcaggcgtcttttacgtagttaaccgcgatggttattcatttaagaccatctacgatgcttcaaccatggtaactagcagtcgtcagattaacttctggggacaaaaggctggcgcatctgaggctgttttggcgcgtgaaattccatcagctgaacttttcaaaatgccagaaattttggaaattcctgctgaagttttggtttacggtgctagtgtcatccatcattctaaacgtccgctcttgcaaaactactataactttacacatatcgatgatgaaaagacgcataaacgtgacctcttcttggctgagccaagtgatccagagagccactattccatttttgaagataatcatgggacccatatctttgccaacaatgaccttgatttgatgatcaaattaacagaattggtggagcatggctttactcgctggaaactagaagggctctacactcctggtcagaactttgttgagattgcaaaactctttatccaagcgcgtaacttgattcaagagggcaactttagccatgatcaagtcttcttgctggatgaagaagttcgtaaacttcaccctaaaaaccgtttccttgatacaggattttatgactacgatcctgacatggttagataa

SEQ ID NO: 74 - DNA, 288 bp, Streptococcus pneumoniae
atgcccgtaagaaaattacaatcctatgaggtagactatcaagaagaattaaaccagcagcttcctcattaccaagcttatacacctgaagcgcaatctgatgccaatctcaaggaaatcctattttttattaatatcgctgttttttgtatctgtattgctatctttagttttatctttttagcattaaaattatcaactgctcttgcctttgccgcagcaatcggattcagcttacttgttttaaaagttcaacggtctattatcaaacgaaaacgtagaagataa

SEQ ID NO: 75 - DNA, 1335 bp, Streptococcus pneumoniae
atgttcagtaaacttaaaaaaacatggtatgcggatgactttagttattttatccgcaacttcggtgtcttcaccctgattttttctacaatgactctgattattttacaagtcatgcattcgagtctttatacttcggtggacgataagcttcatggactgagtgaaaatcctcaagcagttattcagctggctataaatagggcaacagaagagattaaagatttagaaaatgctagggcggacgctagtaaagtagaaataaaacctaatgtcagttccaatacggaagtcattctctttgataaagactttactcaacttctttctggaaatcgatttttgggcttggataagattaagttagaaaagaaagaactaggacatatctaccagattcaggtttttaatagctatgggcaggaagaaatctatcgtgtgattttgatggagaccaatattagttcggtttcaaccaatatcaagtatgctgctgtcttgattaataccagtcagttggagcaggctagtcaaaagcatgagcaattgattgtggtcgtgatggctagtttctggattttgtctttacttgccagtctctatctagctagggtcagtgttaggcccctgcttgagagtatgcagaagcaacagtcttttgtggaaaatgccagtcatgagttacgaactccactcgcagttttgcaaaatcgcttagagaccctttttcgtaagccagaagctaccattatggatgtgagcgaaagcattgcatcgagtttggaagaagtccgaaatatgcgttttttaacgacaagcttgctgaacttagctcggagagatgatgggattaagccggagcttgcagaagttccaactagcttttttaatacaactttcacaaactacgagatgattgcttcggaaaataatcgtgtcttccgttttgaaaatcgtatccatcgaacaattgtcacagatcagcttcttctgaaacaactgatgaccattcttttcgataatgccgtcaagtatactgaggaggatggtgaaattgattttcttatctcggcgaccgatcgcaatctttatttacttgtttctgataatggaatcggtatttcgacagaagataaaaagaaaatttttgaccgtttttatcgagtagacaaagctagaacccggcaaaaaggtggttttggtttaggattatccctagccaagcaaattgtagatgctctaaaaggaactgttactgtcaaagataataaacccaagggaacaatctttgaagtgaagattgccattcagacaccatctaaaaagaaaaaataa

SEQ ID NO: 76 - DNA, 675 bp, Streptococcus pneumoniae
atgataaaaatcttattggttgaggatgacctaggtctgtcaaattcagtatttgactttttagacgattttgcggatgttatgcaggtatttgatggagaagaaggtctctacgaagctgagagtggtgtctatgacttgattttgctggatttgatgttgccagaaaaaaatggtttccaagtcttaaaagaattgcgtgaaaagggaattacgacaccagttctgattatgactgccaaggaaagtttggatgacaagggacatggatttgaactgggagcggatgattatctgaccaaacctttctacctagaagaacttaaaatgcggattcaggcccttctcaaacgttcagggaagtttaatgaaaacaccttgacttatgggaatatcgtggttaatttatcaaccaataccgttaaagttgaagatactcctgtcgaattgctggggaaagagttcgatttactagtttatttccttcaaaatcaaaatgtgattttgcctaagacgcagatttttgaccgtctatggggatttgatagtgatacaacgatttcggttgtcgaagtctatgtttcaaaagtccgtaagaaattaaagggaaccacttttgcagagaatttgcaaaccttgcgtagtgttgggtatcttttaaaagatgttcagtaa

SEQ ID NO: 77 - DNA, 2547 bp, Streptococcus pneumoniae
atgcaagcagttgaacattttattaagcaatttgttcctgaacattatgatttatttttagatttgagtcgtgagaccaagactttttctgggaaagtgaccatcactggtcaagcacagagtgaccgcatctccctccaccaaaaagacttggaaatcacctctgtagaagttgcaggtcaagctcgtccatttacagttgaccatgacaatgaagcccttcatatcgaattggctgaggctggtcaagttgaattggttcttgccttttctggtaaaattacagacaacatgacagggatttacccttcttattatacagttgatggagtcaagaaggaggtcttgtctactcagttcgagagccattttgcgcgcgaagctttcccatgtgtggatgagcctgaagccaaagcaacttttgacctctctcttcgctttgaccaagcagaaggtgaattggccttgtcaaacatgccagaaatcgatgttgaaaaccgtaaggaaacaggtatctggaagtttgagacaacacctcgcatgtcttcttacttgttggcctttgttgctggtgatttgcaaggggtgaccgctaaaactaaaaatggtaccctggtaggtgtctactcaaccaaagcacatccactttcaaatcttgatttctcactggatatcgctgttcgctctatcgagttttacgaagattactatggagttaagtatccaattcctcaatctctccacatcgcccttcctgacttctcagctggtgctatggaaaactggggtcttgtgacctaccgtgaagtttacttggttgtcgatgagaactctacatttgctagccgtcaacaagttgcccttgttgtggcccatgaattggctcaccaatggtttgggaacctcgtgactatgaaatggtgggatgacctttggctcaatgaaagtttcgctaatatgatggaatacgtctgtgtggataccatcgaaccaagctggaatatctttgaagatttccaaacaggtggagtacctcttgctcttgaacgtgacgctactgatggcgttcagtctgtccacgtcgaagttaaacatccagatgaaatcaatacactctttgacggcgctatcgtctatgccaaaggaagccgtctcatgcacatgcttcgccgttggctaggagatgctgattttgctaaaggtttgcatgcctactttgaaaaacaccaatacagcaacaccattggtagtgacctttgggatgcccttggtcaagcgtcaggacgtgatgtcgcagccttcatggattcttggttggaacagcctggttacccagttcttactgtcaaagttgaaaatgatgtcttgaagatttcacaaaaacaattcttcatcggtgagaacgaagacaagaaccgtctctgggtggtgcccctcaatagcaactggaaaggcttgcctgatacactcgaaactgaaagtatcgaaatccctggctacgcagctcttcttgctgaaaatgaaggagctcttcgtctcaacactgaaaatactgcccactatattaccgactatcaaggagacttgttagaagctgttcttgctgagctagagacacttgataacacaagcaaactgcaaattgttcaagaacgtcgtttgttggctgaggcagggcacatttcttatgcagacttgcttccagttcttgataaacttgctaaggaagagtcttatctggtggtttcagctgtttctcaagtgatttcagcccttgagcgctttattgatgaaggaacggatgctgaaacagccttcaaaggactggttgctaaattggctcgtcataactatgaccgtcttggttttgaagctaaagacggagaatcagatgaggatgaattggttcgtcagctggctgtttcgatgatgattcgctcaaatgatgcagaagctcgtcaagtcgctagccaaatcttcgcaacacacaaggagaatcttgcagaactcccagcagctattcgttcacaagttctgattaatgagatgaaacatcatgagactaaagacttgttagcactttatcttgatacttatactcacgcaacagatgctgtctttaaacgccagttgacagcagctcttgcatacagtacagatgcggataatatccaaaacttgattacttcttggaaggacaaatttgtggtcaaaccacaggacttgtctgcttggtattaccaattcctagctcatcaagcaactcagaaaacagcttggtcttgggcgcgtgaaaactgggcttggattaaggcagcccttggaggagatatgagctttgatagctttgttatccttcctgctcatgtatttaagactcagcaacgcttggcggaatacaaggagttctttgaaccgcaactttctgaccttgctcttagccgtaacatcggtatgggaatcaaggaaattgcagcgcgtgttgacttgattagccgtgaaaaagctgcagtcgaagcagttgttcttcaatacggaaatgcataa

SEQ ID NO: 78 - DNA, 441 bp, Streptococcus pneumoniae
atgataccgcaagaaatgtggaataaatacaagcaaatcaatcctttgatcggagatgaaatcgatgcttgggcttttggagttgaaccagaccttttagcggatttggtgtttaaaggagaaaagacagcaacagcatcagcctatgacctctatgtactagaagacgaaccacttccccaagtagggaccttcgatatcattttagatagtcaaaatcagtctgtctgcattgtcgaaattacaaaggtttctgttgaactcttcaatcaagtttctgcgcaacatgcctttaaggaaggtgagggagacaaatcacttgcctattggcgccaggttcatgaggactttttcacagactgtttgggtgaagtagggctgacttttacatctgaaagcaaggttgttttagaagaatttcgcaaggtctacccactgtag

SEQ ID NO: 79 - DNA, 876 bp, Streptococcus pneumoniae
atggctatgagaaatcaacttgcccttagtggcgaaaaaattcttgaaaaaatttatcctcaactatttcaccacgtcggcatgattcgtggggaatatttgttgagagagcttaatcaaaacatcatattagcaagttgtcagcaatttgtaaaagattatctagagactatctgctccctgtactcagatgaagaagtttggtatcgtttttctgaattaacgaatacagaagccaattgtttagtggggactagagagttttttgacgaagggcatcccttgtttggctatagaggaaccaggcgtttactggcgtgtttggatgaatttcaggctgaagcacatgtcgttacagaagtttatcaaaccaaccccaatctatctgttatctttccttttgtcaatgatgacgaccaattaaaacaagctattacagtattgcgtcagcagggttttactgggaaagtcggaacgatgattgaattaccgtcagcgtattttgacttatctagtatactggaaacgggcatttcaaagattgtagttggaatgaatgatttgacttcctttgtttttgcgactatgagaaacagtcaatggcatgatatggaaagtccaataatgttagatatgctaagagatatgcaggataaagcaagaaagaacaagattgattttgctgtagcaggctatctgaatacttctttcatacaaaaaatgaatcagttgggtatcaagtgcattatccactacagttctattccagagatttttgatttagagattgaccatccagatcatcttaaacacataaaagaagaaagtaaaaaattacaaaggagtacccatgataccgcaagaaatgtggaataa

SEQ ID NO: 80 - DNA, 729 bp, Streptococcus pneumoniae
atggaactatttaaaacatggaagaaaaatatggttctctatggtcttaaatctcaaattggaactgtctaccgaaacaatgataggacaacaagcttttatgatgttgggaattttctatacctagcaggggagttggattccagattttgggaagattttgttagaaaatatggtttagattataagattattatttcagaaaatactaattggcaagattttctgcatcgaaaagtggggctaaattcttttactcgctattcttttaaagataaggcaaattttcaagttgaatttttaaataatctagttactcatttagaggaaggttacaatattgtgcctattgataatcatatttataactgcttttctacggaagaatggtcacaggatttacagggggattttgagtcctatcaggattttgttttaaaaggtggatttggctttgtgattcttaaaaataatgaactgattgctgggatttcctcagggttagtttaccgtaaagcagttgaagtggaagttgcaactagaccaaacgaacaaggaaatggatttgctaaaaagcttggtgctgcaatgattctagagagtttaaatagagatatgtttccactttgggatgctcataatgaggcttccaaaaaagtagcagaatttttaggatatgagttatctgaaccttatgaagcttttgaactagaggaaattttgatataa

SEQ ID NO: 81 - DNA, 480 bp, Streptococcus pneumoniae
atggaaatcaaaaatcactttggggtctactgtgtttgctttgaaaatggaaagttactttgtattgaaaaaacgagaggcccttatcaacatcggtatgatctacctggaggcagtcagcaacttggtgaaggactgacggaaacgctgactagagaagttatggaagagacgggatttactgttagaagctactctaatcctcgaatctacgatgttttcgtcagagaagagttaaaaaattttatggttcaccatgtcatggccttgtatgatgttgaaatgaatgagagtgcacctcaagttacgatttcggaagctgtgtctgatggtgcgaatgattcacttggatatatttggatggatattcaagagattacagaagaaaatgcatcgccattagtcttgaaggttaagtctgaattattaggatttccagaactggacaagacttcttacatgaattggaaggtgaagtag

SEQ ID NO: 82 - DNA, 228 bp, Streptococcus pneumoniae
tctttttttagcaagtggaaaagcgagcgccatgcaaggacaaatcttgacaatagatggtggctggtctttgaagtaggaggagttggatggaaatcaaaaatcactttggggtctactgtgtttgctttgaaaatggaaagttactttgtattgaaaaaacgagaggcccttatcaacatcggtatgatctacctggaggcagtcagcaacttggtgaaggactga

SEQ ID NO: 83 - DNA, 699 bp, Streptococcus pneumoniae
atgactaaacgtgtactcattacaggagtgagttcaggtattggattggctcaggctcgcctctttttagagaagggctatcaagtttatggagttgaccaaggtgaaaagccactcttagagggtgattttcactttttacagagagatttgaccttggacttggaacctatttttgactggtgccctcaggtggatgttttgtgtaatactgccggagttttggatgattacaaaccactgttggaacaaacggcgcaggacattcaagagatttttgaaatcaactacattattccagtagagttgactcggtattatttgacacaaatgctggaaaataaaaagggaatcatcatcaatatgtgttccattgcttctagcctagcaggtggaggtggtcacgcctatacttcatccaagcatgccttggctggcttcaccaagcagttggctctagactatgctgaagctgggattcaggtctttggtatcgctccaggagcagtcaagacagctatgaccgctgcggattttgaaccaggtggtttagctgactgggtggctagtgaaacaccaatcaagcgctggattgaaccagaggaaatagcagagcttagtctttttttagcaagtggaaaagcgagcgccatgcaaggacaaatcttgacaatagatggtggctggtctttgaagtag

SEQ ID NO: 84 - DNA, 267 bp, Streptococcus pneumoniae
atgaagaatgtagaattaaaggagaaaaacatgacatttgaagagatcctgcctgggttaaaggctaagagaaaatatgtacgaactggttggggaggtgcggaaaactatgtccaactctttgataccatcgagcaaaatgggcttgcacttgaaatgacaccttatttcctaatcaacgtttctggcgaaggagaaggtttttccatgtggagcccgacagtttgtgatgttttggcaacggattgggtagaagtgcatgactaa

SEQ ID NO: 85 - DNA, 927 bp, Streptococcus pneumoniae
atgagatacataactcttggtcaagatgacaaagaattatcagaaattgttctcggaatgatgagaataaaagataagtctgtaaaagaagttgaagagcttgtagaaacagcactttctgttggaatcaatgccttcgacttggctgatatttatggtcgtggtcgttgtgaagaactgttaggtcttgtcctaaaaaatcgtccagatttaagagaaaagatgtggattcagtccaaatgtggcattcgtattgaagaatttacctattttgatttttctaaggactatattataaaatcagtagacggtattttgcaaagattgaagattgatcatctagatagcttgctccttcatcgaccagatgctttgatggaatctgaccaagtagcagaagcctttgatctcctttataaacaaggtaaagttcgagattttggagtttctaatcaaaatcctatgatgatggagttacttaaaaaagatgtcaagcagccgttagctgttaatcagctacaattgagtgcggcttttactccaggatttgaatcagcttttcatgttaatatggaagatagtcaagcagctatgcgagatggcagcatttttgaatattgcaaattacacgatgtggtcattcaagcatggtctgtcttacaattcgggtattttaaagggaattttgttggaaatgagaaatttcaagctttaaatcaagtacttgatcgtttagctattaaatatggagtaacctcttcaactattgccatttcttggatattgcgttatccagcaaaaatgcaggcagttgtaggtaccacaaatcctaagcacttgagagaagttagccaagcggcaaactttagcttaacaagaaaagaatggtatgaaatttatcttgctgcagggaataatttgccgtaa

SEQ ID NO: 86 - DNA, 816 bp, Streptococcus pneumoniae
atgaagaaaatgaagtattacgaagaaacaagcgctttgctacatgagttttctgaggagaatcaaaagtattttgaggagttgtgggaaagttttaatcttgctggatttctctatgatgaagactatctcagagagcagatctatttgatgatgctagatttctcagaagcagaacgagatggcatgagtgcagaggattatctaggtaagaatcctaaaaaaataatgaaagagattctcaagggagcacctcgcagttctatcaaagagtcccttttgacgccaattcttgtcctggtggtattacgttattatcaactactaagtgatttttctaaaggtcctctcttaacagtcaatttgctcacatttttagggcaacttcttatttttctgattggatttggacttgtggccacaattttacgaagaagtttagtccaagattctcctaaaatgaaaattggcacttacattgttgttgggactatagttcttctagttgttttaggatatgtaggaatggcaagcttcatacaagaaggagccttttatattccggctccctgggatagtttgtctgtctttacgatttcgctagttatcggtatttggaattggaaagaagcggtctttcgtccatttgtcagtatgattattgcccatcttgtggtgggttctctgctccgttattatgagtggatgggaatttcaaatgttttccttacaaaagttattcctttagctgtcctctttattggaatctttgtcttgttccgtgggtttaagaagataaaatggagtgaagtatag

SEQ ID NO: 87 - DNA, 216 bp, Streptococcus pneumoniae
gtgatgaaagaaactcagctattaaaaggtgttcttgaaggttgtgtcttggatatgattggtcaaaaagagcggtatggttatgagttggttcagactttgcgagaggctggatttgatactatcgttccaggaactatttatcctttgttgcaaaagttagaaaaaaatcaatggataagaggcgacatgcgccgtcgcagatggtccagatag

SEQ ID NO: 88 - DNA, 237 bp, Streptococcus pneumoniae
atgaaaatcaaagagcaaactaggaagctagccgcgggttgctcaaagcactgctttgaggttgtagatagaactgacgaagtcagctcaaaacatgtttttgaggttgtagatgaaactgacgaagtcagctcaaagcactgctttgaggttgtagatgaaactgacgaagtcagtaaccatacatacggtagggcgacgctgacgtggtttgaagagattttcgaagagtattaa

SEQ ID NO: 89 - DNA, 246 bp, Streptococcus pneumoniae
tactcttcgaaaatctcttcaaaccacgtcagcgtcgccctaccgtatgtatggttactgacttcgtcagtttcatctacaacctcaaagcagtgctttgagctgacttcgtcagtttcatctacaacctcaaaaacatgttttgagctgacttcgtcagttctatctacaacctcaaagcagtgctttgagcaacccgcggctagcttcctagtttgctctttgattttcattgagtataaataa

SEQ ID NO: 90 - DNA, 2040 bp, Streptococcus pneumoniae
gtgttagaaaaacaggtttcatttgcctggaaaggaaaaattatgtctgaaaaaaatttttatattacaacgccgatttactatccatctgggaaacttcatatcggttctgcctacacaactatcgcatgtgatgtcctagcacgttacaaacgcctgatgggctacgatgtattttatctgacaggtcttgatgaacatggtcagaaaatccagcagaaagcggaagaagctggtattacacctcaagcctatgttgatggaatggcggttggagttaaagaactctggcaattactagatatctcatacgataaatttatccgtacaactgatgactaccatgaaaaagttgtcgcacaggtctttgaacgcttacttgctcaagatgatatttacttgggtgaatactctggttggtattcagtatcagacgaagaattctttacagaaagccagctggcagaagttttccgtgatgaagctggaaatgtgactggtggtattgctccatcaggtcatgaggttgaatgggtttctgaagaatcatactttcttcgccttagcaaataccaagaccgtttggtcgaatttttcaaagctcatcctgaatttatcacgccagatggtcgccttaatgaaatgctacgcaacttcatcgagccaggtttggaagatttggcggtatctcgtacaacctttacatggggagtgcctgtcccatcaaatccaaaacacgttgtctacgtttggattgatgcccttcttaactatgcgacagctcttggctacgctcaagacgaacatggtaactttgacaagttctggaatggaacagtcttccatatggtaggaaaagatatccttcgcttccactctatctactggccaatccttcttatgatgttggatgttaaattacctgatcgtttgattgcccatggttggtttgtcatgaaagacggaaaaatgtctaagtcaaaagggaatgtcgtttaccctgaaatgttggtagagcgttatggactagatccacttcgttactacctcatgcgtaaccttccagttggttcagacggaacctttactcctgaagactatgttggccgtatcaactatgaattggctaatgactttgggaacctccttaaccgtacgttttccatgattaataagtactttgatggacaaatccctgcctatgtagaaggtgtgactgaatttgatcatgttcttgctgaggttgcagaacaatcaatcgcagacttccatacacacatggaagcagttgactatccacgtgcgcttgaagcagtctggactctgatctctcgtaccaataaatacatcgatgagaccgcaccatgggtcttggccaaggatgaagctcttcgtgaccaattggcaagtgtcatgagccacttggcagccagcattcgtgtagttgctcacttgattgaaccatttatgatggaaactagtcgtgcagttttgactcaacttggtttggaagaagtttctagtcttgaaaacttgagtttggctgacttcccagcagatgtgactgtagttgccaaaggaacacctatctttccacgtctaaatatggaagaagaaatcgcctatatcaaggaacaaatggaaggcaataaaccagcagtcgaaaaagaatggaatccggacgaagttgagctcaaactaaacaaggatgaaatcaagtttgaagactttgacaaggttgaaatccgtgtggcagaagtcaaagaagtgtctaaagtagaaggttcagataagttgcttcaattctgcttggatgctggtgatggagaagatcgtcagattctttcaggaattgccaaatactatccaaatgaacaagaattggtcggcaagaaagttcaaatcgttgctaacctcaaaccacgtaaaatgatgaaaaaatatgtcagccagggtatgattctctcagctgaacatgatggcaaattaacccttctcacagttgatccagctgtaccaaatggaagtgtgattgggtaa

SEQ ID NO: 91 - DNA, 1260 bp, Streptococcus pneumoniae
atgcagaatctgaaatttgccttttcatctatcatggctcacaagatgcgttctttgcttactatgattgggattattatcggtgtttcatcagttgttgtgattatggctttgggtgattccctatctcgtcaagtcaataaagatatgactaaatctcagaaaaatattagcgtctttttctctcctaaaaaaagtaaagatgggtcttttactcagaaacaatcagcttttacggtttctggaaaggaagaggaagttcctgttgaaccgccaaaaccgcaagaatcctgggtccaagaggcagctaaactgaagggagtggatagttactatgtaaccaattcaacgaatgccatcttgacctatcaagataaaaaggttgagaatgctaatttgacaggtggaaacagaacttacatggacgctgttaagaatgaaattattgcaggtcgtagtctgagagagcaagatttcaaagagtttgcaagtgtcattttgctagatgaggaattgtccattagtttatttgaatctcctcaagaggctattaacaaggttgtagaagtcaatggatttagttaccgggtcattggggtttatactagtccggaggctaaaaggtcaaaaatatatgggtttggtggcttgcctattactaccaatatctcccttgctgcgaattttaatgtagatgaaatagctaatattgtctttcgagtgaatgataccagtttaaccccaactctgggtccagaactggcacgaaaaatgacagagcttgcaggcttacaacagggagaataccaggtggcagatgagtccgttgtatttgcagaaattcaacaatcgtttagttttatgacgacgattattagttccatcgcagggatttctctctttgttggaggaactggtgtcatgaacatcatgctggtttcggtgacagagcgcactcgtgagattggtcttcgtaaggctttgggtgcacaacgtgccaatattttaattcagtttttgattgaatccatgattttgaccttgttaggtggcttaattggcttgacaattgcaagtggtttaactgccttagcaggtttgttactgcaaggtttaatagaaggtatagaagttggagtatcaatcccagttgccctatttagtcttgcagtttcggctagtgttggtatgatttttggagtcttgccagccaacaaggcatcgaaacttgatccaattgaagcccttcgttatgaatga

SEQ ID NO: 92 - DNA, 702 bp, Streptococcus pneumoniae
atgaagcaactaattagtctaaaaaatatcttcagaagttaccgtaatggtgaccaagaactgcaggttctcaaaaatatcaatctagaagtgaatgagggtgaatttgtagccatcatgggaccatctgggtctggtaagtccactctgatgaatacgattggcatgttggatacaccaaccagtggagaatattatcttgaaggtcaagaagtggctgggcttggtgaaaaacaactagctaaggtccgtaaccaacaaatcggttttgtctttcagcagttctttcttctatcgaagctcaatgctctgcaaaatgtagaattgcccttgatttacgcaggagtttcgtcttcaaaacgtcgcaagttggctgaggaatatttagacaaggttgaattgacagaacgtagtcaccatttaccttcagaattatctggtggtcaaaagcaacgtgtagccattgcgcgtgccttggtaaacaatccttctattatcctagcggatgaaccgacaggagccttggataccaaaacaggtaaccaaattatgcaattattggttgatttgaataaagaaggaaaaaccattatcatggtaacgcatgagcctgagattgctgcctatgccaaacgtcagattgtcattcgggatggggtcatttcgtctgacagtgctcagttaggaaaggaggaaaactaa

SEQ ID NO: 93 - DNA, 1200 bp, Streptococcus pneumoniae
atgaagaaaaagaatggtaaagctaaaaagtggcaactgtatgcagcaatcggtgctgcgagtgtagttgtattgggtgccggggggattttactctttagacaaccttctcagactgctctaaaagatgagcctactcatcttgttgttgccaatgaaggaagcgtggcatcctctgttttattgtcagggacagtaacagcaaaaaatgaacaatatgtttattttgatgctagtaagggtgatttagatgaaatccttgtttctgtgggcgataaggtcagcgaagggcaggctttagtcaagtacagtagttcagaagcgcaggcggcctatgattcagctagtcgagcagtagctaaggcagatcgtcatatcaatgaactcaatcaagcacgaaatgaagccgcttcagctcaggctccacagttaccagcgccagtaggaggagaagatgcaacggtgcaaagcccaactccagtggctggaaattctgttgcttctattgatgctcaattgggtgatgcccgtgatgcgcgtgcagatgctgcagcgcaattaagcaaggctcaaagtcaattggatgcaacaactgttctcagtaccctagagggaactgtagtcgaagtcaatagcaatgtttctaaatctccaacaggggcgagtcaagttatggttcatattgtcagcaatgaaaatttacaagtcaagggagaattgtctgagtacaatctagccaacctttctgtaggtcaagaagtaagctttacttctaaagtgtatcctgataaaaaatggactgggaaattaagctatatttctgactatcctaaaaacaatggtgaagcagctagtccagcagccgggaataatacaggttctaaatacccttatactattgatgtgacaggcgaggttggtgatttgaaacaaggtttttctgtcaacattgaggttaaaagcaaaactaaggctattcttgttcctgttagcagtctagtaatggatgatagtaaaaattatgtctggattgtggatgaacaacaaaaggctaaaaaagttgaggtttcattgggaaatgctgacgcagaaaatcaagaaatcacttctggtttaacgaacggtgctaaggtcatcagtaatccaacatcttccttggaagaaggaaaagaggtgaaggctgatgaagcaactaattag

SEQ ID NO: 94 - DNA, 1347 bp, Streptococcus pneumoniae
atgagagaatatgatatcattgctatcggtggaggtagcggaggaatcgctaccatgaaccgtgctggtgaacatggagccaaagcagccgttattgaggaaaagaaattaggtggaacctgtgtcaacgtcggttgtgttcctaaaaaaatcatgtggtacggggcgcaaatcgctgagactttccatcaatttggagaagactacggctttaagactactgatcttaactttaactttgcaaccctacgtcgcaatcgtgaagcctacattgatcgcgctcgttcttcttatgatggtagttttaaacgcaacggtgtagacttgattgaaggtcatgctgaatttgtagattctcatactgtaagcgtaaatggtgaactgattcgtgctaaacatatcgtgattgctacaggtgcccatccaagtattcctaatattcctggtgctgagctaggtggctcttctgatgatgtatttgcctgggaagaacttccagagtcagttgccattctaggcgctggttatatcgccgttgaattagctggcgtactccacacttttggtgtcaagacagatctctttgttcgccgcgatcgtcctttacgtggttttgattcctacatcgttgaaggtttggtcaaggaaatggaaagaacaaacttaccacttcacactcacaaagtccctgccaagttagaaaaaactactgacggcattaccattcatttcgaagatggtactagtcacacagctagccaagttatctgggctacaggccgccgtccaaacgttaagggcttgcaacttgaaaaagctggagtgactctgaacgaacgtggctttatccaagtggatgaataccaaaatactgttgttgagggaatctatgctctaggtgatgtaacgggcgagaaagaactgactccagttgcaatcaaggccggacgtaccctatctgaacgtctctttaacggaaaaactactgcaaaaatggattactcaactattccaactgttgtcttttcacaccctgctatcggaactgttggtttgacagaagagcaagctattaaagaatacggtcaagaccaaatcaaggtttacaaatcaagctttgcatctatgtactctgcttgcactcgcaaccgtcaagaatcccgtttcaaactcataacagctggttcagaagaaaaagttgtcggacttcatggaattggctacggcgttgatgaaatgattcagggatttgccgttgctatcaaaatgggagcaaccaaggctgactttgacgcaactgtagcgattcacccaacttcatctgaagaatttgtaaccatgcgttaa

SEQ ID NO: 95 - DNA, 537 bp, Streptococcus pneumoniae
ttgaaaaaagctcacgtttatgctatccctgctattggggctgctctcattgctgttttggcacaaatcagtcttccaattggacctgttcccttcactctgcaaaactttgcaatcggcttgattgctactgtctttagaccgagagaggctgtactttctgctggactctatcttcttctaggtgctatcggtcttcctgtctttgcaggaggtggagctggttttcaggctttagttggccctactgcaggctatctttggttttatctcgtttactctggacttacttcctctctaaccaacagcaagagtggtgttgttaagatttttcttgcaaacctcttgggtgatgcccttgtctttgtcggcgggattctcagcttgcatttcctagctggaatggcatttgaaaaagctcttgttgtgggggttcttccctttatcattccagaccttggcaaacttctggctattagttttattagccgtcccctacttcaacgccttaaaaatcagacttactttactaactaa

SEQ ID NO: 96 - DNA, 336 bp, Streptococcus pneumoniae
ttgaaaaagctcttgttgtgggggttcttccctttatcattccagaccttggcaaacttctggctattagttttattagccgtcccctacttcaacgccttaaaaatcagacttactttactaactaaaaaaggataccgagttatcatgactcaatatccttttttttattttgaaaacttatactcaatgaaaatcaaagagcaaactaggaagctagccgcaggctgctcaaaacactgttttgaggttgtagatgaaactgacgaagtcagtaaccatacatacggcaaggcaaagctgatgcggtttgaagagattttcgaagagtattag

SEQ ID NO: 97 - DNA, 240 bp, Streptococcus pneumoniae
atgaaactaaaaaaggagaagaaaatggcagaatttacatttgaaatcgaagagcacttgttgactctttctgaaaacgaaaaaggttggaccaaggaaattaaccgtgtgagctttaatggtgcccctgcaaagtttgatattcgtgcttggagtccagaccatactaaaatgggcaaagggattactctctcaaatgaagaatttcaaacgatggtggatgcctttaaaggcaactaa

SEQ ID NO: 98 - DNA, 321 bp, Streptococcus pneumoniae
atgagacataaattccagcaagttctagataaaatacatgattttttaaatggacatgaccaacctgaccagactgaaaccaactcccttacagccactattgaagaggctatccagaaacaaaccgctgttcaccttatcttgtctgagacaagctttacaggtgatatcatcaaatatgatcagcaaggccagcaaattatcgtgaaaaatttttccaaaaatgtgagccggattatccgtataagcgatattcaacgcctgcgatttgtcccctcaactgtccaaacagcccaaaaaaatagatttaagaaagagtga

SEQ ID NO: 99 - DNA, 339 bp, Streptococcus pneumoniae
atgcaagtaatcaaacgtaatggcgaaattgctgaatttaatccagataagatttaccaagccatcttgaaggcagcccaaactgtttatgttttgacagatgatttgcgtcaaaatcttgctcaagtcactaagaaggtagttttggatttacaagaagccaaggtggaacgtgcgactatcagtatgattcaatctatggttgaacatcgtttattgggcgcaggttacattaccattgcagaacactatatttcctatcgtttacaacgtgacttggaaagaagtggttatggagatcatatcgcagttcatttacattttgaacaaattcgctaa

SEQ ID NO: 100 - DNA, 720 bp, Streptococcus pneumoniae
atgaagattgatattttaaccctctttccagagatgttttctccactggagcactcaatcgttggaaaggctcgagaaaaagggctcttggatatccagtatcataattttcgagaaaatgctgaaaaggcccgtcatgtagatgatgagccctacggaggcggtcagggcatgttgctcagagcacaacctattttcgattcctttgatgctattgaaaagaaaaatccgcgcgttattctcctcgatcctgctggaaagcagtttgatcaggcttatgctgaagatttggctcaagaggaagagctaatctttatctgtgggcactatgagggttatgatgagcgcattaagaccttggtaacagatgagatttccctaggcgactatgtcctcactggtggagaattggcagctatgaccatgattgatgctacagttcgcctgattccagaagtgattggcaaggagtctagccaccaagatgatagtttttcttcaggtcttttagaatatcatcagtacacacgtccctatgattatcgaggcatggtcgtgccagatgtattgatgagtggccatcatgaaaagattcgtcagtggcgattgtacgagagtttaaagaaaacctacgagcgcagaccggatttacttgaacattatcaactgacagtagaagaagaaaaaatgctggcagaaatcaaagaaaacaaagaataa

SEQ ID NO: 101 - DNA, 519 bp, Streptococcus pneumoniae
atgaactactttaatgttgggaaaatcgttaatacgcagggattacagggtgagatgcgagtcttgtctgtgacggattttgcagaagaacggtttaaaaaaggagctgagctggctttgtttgatgaaaaagatcagtttgtccaaacagtgaccatcgctagccaccgtaaacagaagaactttgacattattaaattcaaagatatgtaccatatcaatactatcgaaaagtacaagggatacagtctcaaggtcgctgaggaagatttgaatgacctagacgatggtgaattttactatcacgagattatcggtttggaagtctatgagggtgatagcttggttggaaccatcaaggaaatcctgcaaccaggtgctaatgatgtctgggtggtcaaacgaaaaggcaaacgtgatttgcttttaccttatatcccaccagtggttctcaatgttgatattccaaataaacgggtcgatgtggaaatcttagaagggttagacgatgaagattga

SEQ ID NO: 102 - DNA, 801 bp, Streptococcus pneumoniae
gtggatttctttatgaagaggtttgaagtatctacagaaattggtagtctctctgttgcttatcaaaagcaaaagaaagtgctagtttgtctaaatggagcaggtttgctaccaagttatgaaaatttttcacttatacttgaaaaacctcctcctacaattggttatttgacaattgattttccgaacacaggtaggagtccgatttatgaccaagctggaaaaaatctagataatcttgcagatgtggtttatgaagcacttgaagaattagggatttctgaatatatactttgtgtacatagttggagtggaattttagcttgcaaattactcgagaaaccaattaagtgtcagactttagtagtaattgaaccgacaactaaaaaagtcatgtttgctgatttttcagaaaatccttatccagaaatggaagagcagatgaggctgattgacgagtgtggtcctgaactttattttaagaacttaactcaagcaacatttagtcctgaaacgaataaaaaaatctgggaattaatgcaagaaaaaggcttagagttggaaaatcaagatccagaatttcagatatctggagagattactgaggaagattttgagaatttgtcgatagaatctcatgtccctgtatttattttttgtcagacttatagagaaaaagagtacagagaatcagaatattggacttccaatactaaactcattttaggagggaatcaccattatttacaatggtcagaatcggaaaaaattgcggctattattcgagaattgtcagaataa

SEQ ID NO: 103 - DNA, 240 bp, Streptococcus pneumoniae
atggatacgattgaaaatctcattattgcgattgtgaaacccttaatttcacaaccagatgccttaactatcaagattgaggatacaccagaatttttggaatatcatttgaatcttgatcaaagcgatgtgggtcgtgtaatcggtcgtaagggtcgcactatttctgcgataagaacgattgtctactctgtcccaactgaatacaaaaaagtaagaatcgttattgacgaaaaataa

SEQ ID NO: 104 - DNA, 273 bp, Streptococcus pneumoniae
atggcagttaaaatccgtttgactcgtatgggttctaagaaaaaacctttctaccgtatcaacgtagcagattcacgttcaccacgtgacggacgtttcatcgaaacagttggaacttacaacccacttgttgctgaaaaccaagtaactttgaaagaagaccgcgttcttgcatggttggctaatggagctcaaccttcagacacagtacgtaacatcctttcaaaagaaggcgtattgaaaaaattccacgattctaaattttcaaaataa

SEQ ID NO: 105 - DNA, 210 bp, Streptococcus pneumoniae
atgctatccgtgaatactattttagaaaaattttataaagaacaccaagtcaaacccttcatatcgcctgaacgagagttggatacttggcttctaagtcccaagcccgttcccaagcgaaatatggacttattagtagatgattcactagcaggagatatcattttactatggagaatccagtttggtacttttaccactgaaacatga

SEQ ID NO: 106 - DNA, 405 bp, Streptococcus pneumoniae
ttcttagcgtttagagaactggctagctttacgagctttcttaagatctggtttccaaaatactttgagtacacttatggtattgatgcccctaaacatctaaaaactctggtagaaaaagggtatgctcttgtcgaaacttcttttgactcacttgaccatctaaatactaccatgaaaaagaatatcctgaagaagaagggagttactggactttctaaaatgaaatcttgcgacctggatcaagcccttcatgagcatttttcagaagaagaattagctggtcactttcatgtccttctatggacttttttacaatggcattgctatcacacccaatacctatctaagcgcctggttcgtaaactttattgcagctcttcctctaaatttcctaattgttga

SEQ ID NO: 107 - DNA, 213 bp, Streptococcus pneumoniae
atgtccttctatggacttttttacaatggcattgctatcacacccaatacctatctaagcgcctggttcgtaaactttattgcagctcttcctctaaatttcctaattgttgaaccaattgcccgttttatactaagttcttttcagaaaccatttactggggaagaagttgaagattttcaagatgatgatgaaatcccaactattatctaa

SEQ ID NO: 108 - DNA, 804 bp, Streptococcus pneumoniae
atgaaaaaactagcaacccttcttttactgtctactgtagccctagctgggtgtagcagcgtccaacgcagtctgcgtggtgatgattatgttgattccagtcttgctgctgaagaaagttccaaagtagctgcccaatctgccaaggagttaaacgatgctttaacaaacgaaaacgccaatttcccacaactatctaaggaagttgctgaagatgaagccgaagtgattctccacacaagccaaggtgatattcgcattaaactcttccctaaactcgctcctctagcggttgaaaatttcctcactcacgccaaagaaggctactataacggtattaccttccaccgtgtcatcgatggctttatggtccaaactggagatccaaaaggggacggtacaggtggtcagtccatctggcatgacaaggataagactaaagacaaaggaactggtttcaagaacgagattactccttatttgtataacatccgcggtgctcttgctatggctaatactggtcaaccaaacaccaatggcagccagttcttcatcaaccaaaactctacagatacctcttctaaactccctacaagcaagtatccacagaaaattatcgaagcctacaaagaaggtggaaaccctagtctagatggcaaacacccagtctttggtcaagtgattggcggtatggatgttgtggataagattgctaaagccgaaaaagatgaaaaagacaagccaactactgctatcacaatcgacagcatcgaagtggtgaaagactacgattttaaatcttaa

SEQ ID NO: 109 - DNA, 360 bp, Streptococcus pneumoniae
actagggtttccaccttctttgtaggcttcgataattttctgtggatacttgcttgtagggagtttagaagaggtatctgtagagttttggttgatgaagaactggctgccattggtgtttggttgaccagtattagccatagcaagagcaccgcggatgttatacaaataaggagtaatctcgttcttgaaaccagttcctttgtctttagtcttatccttgtcatgccagatggactgaccacctgtaccgtccccttttggatctccagtttggaccataaagccatcgatgacacggtggaaggtaataccgttatagtagccttctttggcgtgagtgaggaaattttcaaccgc

SEQ ID NO: 110 - DNA, 1542 bp, Streptococcus pneumoniae
atgagtattttagaagttaaaaatctgagtcacggttttggtgaccgtgcaatttttgaagatgtgtccttccgtctcctcaagggagaacatatcggcctggtcggtgccaatggtgaaggaaaatcaacctttatgagtatcgtgactggtaaaatgctgccagatgaaggaaaggttgagtggtccaaatatgtgacggctggttacttggatcagcactctgtccttgctgaaagacagtcggtgcgtgatgttctccgtacggcttttgatgagcttttcaaagctgaagctcgtatcaatgacctctatatggaaatggctgaagacggtgcggatgttgatgctctcatggaagaagtaggagaacttcaagaccgtctggagagtcgtgatttctataccttggatgctaagattgacgaagtagcgcgtgctcttggtattatggactttggcatggatacggatgtaacttctttgtcaggtgggcaaagaaccaaggtgcttttggcaaaacttctccttgaaaagcctgatattttgctgttggacgagccgaccaactacttggatgctgagcatattgattggctcaagcgctatctccaaaactatgagaatgcctttgttctcatttcgcacgatattccattcctcaatgacgttatcaatattgtctatcatgtggaaaatcaacagctgacgcgttactctggtgactactaccagttccaagaagtttatgctatgaagaaatctcagctagaggcagcctacgaacgccagcagaaagagattgcagacctcaaggactttgtggctcgtaataaagcccgtgttgcaactcgtaatatggctatgtctcgtcaaaagaaattggataagatggatattatcgaactccaaagtgagaaaccaaaaccatcctttgatttcaaaccagctcgtacaccagggcgctttatcttccaagccaagaacttgcaaattggttacgaccgtcctcttactaagcctttaaatcttaccttcgaacgcaatcaaaaggttgcgattattggtgctaatggtattggaaaaacaactctcttgaagagtctcttgggcattatctcgccaatcgctggggaagtggagcgtggagattatttagaacttggttattttgagcaggaagtagaaggtggtaatcgccaaactcctcttgaagctgtctggaatgcctttcctgcccttaatcaagcagaagtccgtgcagcccttgcccgttgtggtttgacaaccaaacatattgaaagccagattcaagtattatcagggggagagcaagccaaggttcgtttctgtctcttgatgaatcgtgaaaacaacgttttagtgctggacgagccgaccaaccatttggatgtggatgcaaaggatgagctcaaacgcgctctcaaagaatataggggatctatccttatggtctgccacgagccagacttttatgaaggctggatagaccaaatatgggattttaataatttaacttaa

SEQ ID NO: 111 - DNA, 483 bp, Streptococcus pneumoniae
atgatgaagaagacttataatcatattttggtctggggagtcattttctatagcatttgcattgtctatttttgctttactcctcaagaacaatctaccgtgggagtgggaactccagatattcagcatcttggacgcctggtttttcttttgactcctttcaattctctctggaaactgggcgaagtgagtgacattggacaattatgttggatttttttacaaaatatcctcaatgtcttcttgttttttcctctgattttccaactcctttatctatttccaaatttgcggaaaacaaaaaaggtccttctttttagttttcttgtgagtcttggaatcgagtgtacgcaattaatcttggactttttctttgatttcaatcgcgtctttgagattgatgatttgtggaccaacactttgggtggctatctggcttggctcctttataaacgattacataaaaacaagataaggaattaa

SEQ ID NO: 112 - DNA, 1086 bp, Streptococcus pneumoniae
atgaaaccctcaattcatagtttggcacatcaaaccatgcaggaatgggtattggagcagggagaaaagaaattccgtgcagatcaaatctgggaatggctctaccgtaaacgtgtgcagtcatttgaagaaatgaccaacctttccaaggatttgattgctaagctcaatgaccagtttgtggtcaatcccttgaaacaaggtattgtgcaagagtctgctgatggtacagtcaaatatctctttgaattgcccgacggtatgttaattgagactgtactcatgcgtcaacactatggtttatctgtctgtgtgaccactcaggtcggctgtaatatcggttgtaccttctgtgcctctggtttgattaagaagcaacgtgacctcaataacggtgaaatcgtagcgcaaatcatgctggttcagaaatactttgctgagcgtggtcaggatgaacgcgtcagccatatcgttgtcatgggaatcggtgagccctttgataattacaacaatgtcttgaatttctttcgtactatcaatgatgataaaggaatggctatcggtgctcgtcacatcacggtttcaacctcaggtttggctcataaaattcgtgactttgctgatgaaggggttcaggtcaatcttgccgtgtctcttcacgcacctaacaatgaacttcgttcaagtatcatgaagattaaccgtgcctttccgattgaaaaactctttgctgctattgaatactacattgagacaacaaaccgtggtgtaacctttgaatatatcatgcttaatgaagtcaacgacggtgtagaacaagccttggaattgactgaattgctcaagaacatcaagaaattgtcttatgtaaacttgattccttataacccagttagtgagcatgaccaatatagccgtagtcccaaagagcgcgtgttggctttctatgatacgcttaagaaaaaaggggtcaactgtgtggttcgtcaagagcatggtacagatattgacgcagcttgtggacaattgcgctctaacacaatgaaacgtgaccgccagaaggcagtcgcagcggtaaatccttaa

SEQ ID NO: 113 - DNA, 531 bp, Streptococcus pneumoniae
atgcgaaaagaaattgcacctgaattatacaactataacaagtttcctggtccggagttccatttacacggggacaaggtcgaaacggaagggatagctttttccttggttgaaaatatcaaggatgcctttgatgtgacaacttttaatcagcgtttttcagaagtattaaccaagtttgattatatcgtgggggactggagcaacgaacagcttcgcctacgaggtttttacaaggatgaccgaacagaagaaaaacttgaaaaaatcagtcgtttacaagactaccttttagagtattgtagttatggttgtgcctattttgtcttagaaaatgaagcccctaagcgagcatcatttgacaagaaaatgcgtaagacggaagaagaaacaccttctagaaaaggaaagaaaccgactcaaactaaacgaaagtcgaatgcagataagaaaaatagacgtcgtcagaaagaccagcattctcagaaagaggacaagggacaacgtcattttgtcattcgtcagaagtga

SEQ ID NO: 114 - DNA, 606 bp, Streptococcus pneumoniae
atggctattatcttaccagaacttccatatgcatacgacgctttggaaccatacatcgatgcggaaacaatgcatttgcaccatgacaaacaccatcaaacttatgtcaacaatgccaatgcagctttagaaaaacaccctgaaatcggtgaagaccttgaagccttgcttgctgatgtagaatctatcccagctgatatccgtcaagcacttatcaacaatggtggcggacacttgaaccacgctcttttctgggaattgatgactcccgagaaaacagctccttcagcagaactggcagcagcaatcgatgcaacatttggttcatttgaagaattccaagcagccttcactgcagcagcaacaactcgttttggttcaggttgggcatggttggttgtcaacaaagaagggaaacttgaagtgacttcaacagcaaaccaagacacaccaatctcagaaggtaaaaaaccaatcttgggcttggacgtttgggaacatgcttactacgtgaaataccgcaacgtgcgtcctgactacatcaaagctttcttttcagtaatcaactggaataaagtagatgaattgtacgcagctgctaaataa

SEQ ID NO: 115 - DNA, 1038 bp, Streptococcus pneumoniae
atgctagccattgaagaaagtcagaagttgactttatcaaatttaccgagcctgagcctatttacagggacagatcagggtcagtttgaagtgatgaagagtcaagtgttgaaacagattgggtatgattctgctgacctcaactttgcctactttgatatgaaagaagtagtttacaaggatgtggaactggagttggtcagccttcctttctttgcggatgagaaaatcgtgatattagattattttatggatatcacgactgctaagaaacgctttttgacagatgatgagcttaagtcatttgaggaataccttgacaattcttctccaacaaccaagttgataatctttgcagaaggaaagctggatagcaaaagacggttagtcaaattacttaagcgtgatgccaaggtcttcgatgcagtagaagtaaaagaacaagaattgcgccagtatttccaaaagtggagtcagaaacaaggtctgcagtttaccaatcattcttttgaaaatctcctcatcaagtcggggtttcaatttagcgaaatccagaaaaatcttctctttttacagtcctataaggcgaattctgttattgaggaagaggatattgttaacgcaattcccaagaccttgcaggacaatatttttgatttaactcagtttattctgactaaaaagatggatcaggcgcgcgatttggtgagagacttgaccttgcaaggggaagatgaaatcaaactgattgcagtcatgctgggacaatttcggacttttactcaggtgaagattttggcggagtctggccaaacagaatcgcagattgcaagtagtttaggtagttatctgggacgtaacccaaatccttatcaaatcaagtttgcattaagagattcgagaggactttctttgagctttttgaagcaagctatttcctatttgattgagacagactatcagattaagacaggtctttatgaaaaaggtttcctttttgaaaaggcactcttacagattgctagtcaggtcaattga

SEQ ID NO: 116 - DNA, 936 bp, Streptococcus pneumoniae
atggtatcaacgaaaacacaaattgctggttttgagtttgacaattgcttgatgaatgcagcaggtgtggcttgtatgacgatagaggagttagaagaggtcaaaaactcagcggcaggaacctttgttactaagacagcgaccttggacttccgtcaggggaatcctgagccacgctaccaagatgttccacttggttccatcaactctatgggcttgccaaataatggcttagactattatttggattatcttttagatttgcaggaaaaagagtcgaaccgaactttcttcttatctctggtcggcatgtctccagaggaaacccatactattttgaaaaaagtccaagagagtgattttcgtggtctgactgagctaaatctttcctgtccaaatgttccaggtaaacctcagattgcctatgattttgagacaacagaccggattttggcagaagtgtttgcttacttcaccaaacctcttggaattaaattgccaccttattttgatattgttcactttgatcaagcggcagctattttcaacaaatatccgctcaagtttgtcaactgcgttaactctatcggaaacggcctctatatagaagacgaatctgtcgttattcggcctaagaatggttttggtggaattggtggagaatacatcaaaccgactgctctagccaatgttcacgccttttatcaacgtttaaatcctcaaatccaaattatcggaacaggtggcgttctgactggtcgagatgcctttgaacacatcctctgtggagcaagtatggtgcaggtgggaacgacccttcacaaagaaggcgtcagtgcttttgaccgcattaccaatgaactgaaagcaatcatggtggaaaaaggctacgagagcttagaagatttccgtgggaaattgcgctatattgactaa

SEQ ID NO: 117 - DNA, 1191 bp, Streptococcus pneumoniae
atgtcagagcgtaaattattcacgtctgaatctgtatctgaggggcatccggataagattgcagaccaaatttcagatgcgattttggatgctattttagcaaaggatccagaggcgcacgttgctgctgaaacagctgtatatactggttctgtccacgtttttggtgaaatttctacaaatgcctatgtggatattaaccgtgtggttcgtgataccattgcagagattggttataccaatacagaatatggattttctgctgagacggtgggagtacacccatctttggtggaacaatctcctgacatcgctcaaggtgttaacgaagccttggaggttcgtggaaatgctgatcaagatccactggacttgattggagcaggtgaccaagggctcatgtttggatttgcagtagatgaaacagaagagcttatgccattgccaattgcactcagtcataaattggttcgtcgtctggcagaacttcgtaagtctggagaaattagctatctccgtccagatgcaaaatcacaagttacagttgagtacgatgaaaatgaccgtccggtacgtgtagatacagtcgttatttctactcagcatgatccagaggccactaatgaacaaatccatcaagatgtgattgacaaggtcatcaaagaagttattccatcttcttatcttgatgataagacaaaattctttatcaatccgacaggtcgttttgtaatcggtggtcctcaaggggactcaggtttgactggtcgtaagattattgtagatacttatggtggctactctcgtcatggtggtggtgccttctctggtaaagatgcgactaaggtggatcgttcagcctcttatgcggctcgctatattgccaagaatatcgttgcagcaggccttgctaagaaggcagaagtgcagttggcctatgctatcggtgttgcgcaacctgtttctgttcgtatcgatactttcggtacaggaacagtagctgaaagtcaacttgaaaaagcggctcgtcaaatctttgaccttcgccctgcagggattatccaaatgctggacctcaagcgtccaatttaccgtcaaacatcggcttacggtcacatgggacgtacagatattgatcttccatgggaacgtttggataaggtagatgctttgaaagaagcagtaaaataa

SEQ ID NO: 118 - DNA, 1344 bp, Streptococcus pneumoniae
atgtcatttacgaaatttcaatttaaaaactatattagagaagccttgaaggagttaaaatttacaactccaacagaggtgcaagacaagttgattcctattgttttggcaggtcgtgacctagtaggagaatcaaaaacaggttcaggtaagactcatactttcttgttaccgattttccagcaattagatgaagctagcgatagtgtgcaagcagtgattactgcaccgagtcgtgagttggctactcaaatttaccaagtagcgcgtcagatttcagctcactcagatgtcgaagttcgtgtggttaattatgtgggtggtacggataaggctcgccagattgagaaattggcaagcaatcagcctcatattgttattggaacaccaggccgtatctacgacttggttaaatctggtgatttagctattcataaagccaagacatttgttgttgatgaagcagatatgaccttggatatgggattcttggaaactgttgataagattgctggcagtcttccaaaagacttgcaattcatggtcttctcagcgactatcccacaaaaactgcaaccattcttgaaaaaatacttatcaaatcctgttatggagaaaattaagaccaaaacggttatttctgacaccattgataattggttgatttcgaccaagggacatgataagaatgctcaaatttaccagttgactcagttgatgcagccgtatttggcaatgatttttgttaacactaaaacgcgtgctgatgaattgcattcatatctgactgctcaaggcttgaaggttgcaaaaatccatggcgatattgcccctcgtgaacgcaagcgaatcatgaatcaggtgcaaaatctggattttgagtatattgtcgcaacagatttggcagcacgtgggattgacattgaaggtgtcagccatgtcatcaatgatgccattccgcaagacttatctttttttgttcaccgtgttggtcgtactggacgaaatggcctaccaggtacagctattaccctttatcagccaagtgatgactcggatatccgtgagttggagaaattgggaatcaagtttagtcctaagatggtcaaagacggggaatttcaagatacctatgaccgtgatcgtcgtgccaaccgtgagaaaaaacaagataaacttgatatcgaaatgattggtttggttaaaaagaaaaagaaaaaagtcaaaccgggttataagaagaaaattcaatgggcggttgatgaaaagcgccgtaaaaccaagcgtgctgaaaatcgcgctcgcggtcgtgcagagcgtaaagctaaacgtcaaacattttaa

SEQ ID NO: 119 - DNA, 816 bp, Streptococcus pneumoniae
atgaaatttttaacactcaatactcacagttggatggagaaagaagcagaggaaaaattccagattttgcttgaagatattcttgaaaaggactatgatttgatttgttttcaagaaatcaatcaggagatgacctcgtcagaggtggaggttaatgacctttatcaagctttgccagcagctgagcctattcaccaagaccattatgttagactcttggttgaaaagttgttagagcaagggaaaaattactactggacctgggcttataaccatatcggctatgaccgctaccacgaaggtgtggctatcttgtctaaaacacctattgaagccagagaaattttggtttcagatgtggatgatccaacagactatcatactcgccgtgttgccctagctgaaactgtagtcgatggcaaggagctagcagttgccagtgttcatctctcttggtgggataaaggtttccaagaagaatgggcacgatttgaggctgtcttgaaaaaattgaacaagccacttttactagctggagattttaacaacccagcaggtcaggaaggttaccaagctattttagctagtccattagacttacaagacgcatttgaagttgctcaagagaaaagtggtagctatactgttccgcctgaaattgatggctggaaagggaacactgaaccccttcgaatcgattatgtctttactaccaaagagttagcggtggaaaatttacatgtcgtatttgatggtaacaagagtccacaagtgagtgatcactatggcttgaatgctatgttaaactggaaataa

SEQ ID NO: 120 - DNA, 264 bp, Streptococcus pneumoniae
ttgagtgttaaaaatttcattcttttctcccaaaataagaggttggaatacagcttccaacctcaagtatattacaattctactttagcaactgctgttttagctgcaagagaacctgttttttctaacttaactgatttaattgcatcaccatttgtgaagacaactactgttgatgtttcacgtcctgctgcacggatagcatccaagtcagctgtgacaaggagatctcctgctgcaactttttgtccttcagcaacatga

SEQ ID NO: 121 - DNA, 2181 bp, Streptococcus pneumoniae
atgatgaaagatacattcaaaaatgtcttgtctttcgaattttggcaaaaattcggtaaggctttgatggtagttatcgcggttatgccggctgctggtttgatgatttcaatcggtaagtctatcgtgatgattaacccaacctttacaccacttgtcatcacaggtggaattcttgagcaaatcggttggggggttatcggtaaccttcacattttgtttgccctagccattggaggaagctgggctaaagaacgtgctggtggtgctttcgccgctggtcttgccttcatcttgattaaccgtatcactggtacaatctttggtgtatcaggcgatatgttgaaaaatccagatgctatggtaactactttctttggtggttcaatcaaagttgctgattactttatcagtgttcttgaagctccagccttgaacatgggggtattcgtagggattatctcaggttttgtaggggcaactgcttacaacaaatactacaacttccgtaaacttcctgatgcactttcattcttcaacgggaaacgtttcgtaccatttgtagttattcttcgttcagcaatcgctgcaattctacttgctgctttctggccagtagttcaaacaggtatcaataatttcggtatctggattgccaactcacaagaaactgctccaattcttgcaccattcttgtatggtactttggaacgtttgctcttgccatttggtcttcaccacatgttgactatcccaatgaactacacagctcttggtggtacttatgacattttaactggtgcagctaaaggtactcaagtattcggtcaagacccactatggcttgcatgggtaacagaccttgtaaaccttaaaggtactgatgctagtcaataccaacacttgttagatacagtacatccagctcgtttcaaagttggacaaatgatcggttcattcggtatcttgatgggtgtgattgttgctatctaccgtaatgttgatgctgacaagaaacataaatacaaaggtatgatgattgcaacagctcttgcaacattcttgacaggggttactgaaccaatcgaatacatgttcatgttcatcgcaacacctatgtatcttgtttactcacttgttcaaggtgctgccttcgctatggctgacgtcgtaaacctacgtatgcactcattcggttcaatcgagttcttgactcgtacacctattgcaatcagtgctggtattggtatggatatcgttaacttcgtttgggtaactgttctctttgctgtaatcatgtactttatcgcaaacttcatgattcaaaaattcaactacgcaactccagggcgcaacggaaactacgaaactgctgaaggttcagaagaaaccagcagcgaagtgaaagttgcagcaggttctcaagctgtaaacattatcaaccttcttggtggacgtgtaaacatcgttgatgttgatgcatgtatgactcgtcttcgtgtaactgttaaagatgcagataaagtaggaaatgcagagcaatggaaagcagaaggagctatgggtcttgtgatgaaaggacaaggggttcaagctatctacggtccaaaagctgacatattgaaatctgatatccaagatatccttgattcaggtgaaatcattcctgaaactcttccaagccaaatgactgaagcacaacaaaacactgttcacttcaaagatcttactgaggaagtttattcagtagcagacggtcaagttgttggtttggaacaagtaaaggatccagtatttgctcaaaaaatgatgggtgatggatttgcagtagaacctgcaaatggaaacattgtatctccagtttcaggtactgtgtcaagcatcttcccaacaaaacatgcttttggtattgtgacggaagcaggtcttgaagtattggttcacattggtttggacacagtaagtcttgaaggtaaaccatttacagttcatgttgctgaaggacaaaaagttgcagcaggagatctccttgtcacagctgacttggatgctatccgtgcagcaggacgtgaaacatcaacagtagttgtcttcacaaatggtgatgcaattaaatcagttaagttagaaaaaacaggttctcttgcagctaaaacagcagttgctaaagtagaattgtaa

SEQ ID NO: 122 - DNA, 936 bp, Streptococcus pneumoniae
atggatacgatgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacactccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagttttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttag

SEQ ID NO: 123 - DNA, 207 bp, Streptococcus pneumoniae
actactacacggacattattttcaatatctgtagctagtttcgctgtattgaaaataacagatgcaaatattgccaccaaggtcaaagtaatcatgactgaactgacagcagctactgtcatccaaccatttcgtttcaaactttttaaggcttcaaataaatggcgaaaaaatctactaatcatcgtatccatactctccttttga

SEQ ID NO: 124 - DNA, 693 bp, Streptococcus pneumoniae
atgtcaattattgaaatgagagatgtcgttaaaaaatacgacaacggaacgactgctctacgcggtgtttcggtcagcgttcaaccgggggaatttgcttacatcgtaggaccttcaggagcagggaagtcaacttttattcgttctctgtatcgtgaagtaaaaatcgataaaggaagcctatcagttgctggttttaatctggttaagatcaaaaagaaagatatcccgcttctacgtcgtagtgttggggttgtcttccaggattataaattgttaccaaagaaaactgtctatgaaaatattgcttacgctatggaagtaatcggggaaaatcgccgtaatatcaaaagacgagtgatggaagttttggacctggttggattgaagcataaggttcgttctttcccaaatgaactctcaggtggggagcaacagcggattgcgattgcgcgtgcaattgtaaataatcccaaagtattgatagctgatgagccaacaggaaatctggatccggataattcatgggaaattatgaatctcttggaacggattaacctacaaggaacaactattttgatggcgactcataatagccagattgtaaataccttgcgccaccgtgtcattgccattgaaaatggccgtgtcgttcgtgacgaatcaaaaggagagtatggatacgatgattag

SEQ ID NO: 125 - DNA, 225 bp, Streptococcus pneumoniae
atttcccatgaattatccggatccagatttcctgttggctcatcagctatcaatactttgggattatttacaattgcacgcgcaatcgcaatccgctgttgctccccacctgagagttcatttgggaaagaacgaaccttatgcttcaatccaaccaggtccaaaacttccatcactcgtcttttgatattacggcgattttccccgattacttccatagcgtaa

SEQ ID NO: 126 - DNA, 921 bp, Streptococcus pneumoniae
ttgaatgtatttaaaaacacttacaataccttccataagatggaagagttgcaggatgaagtcgaaattttattggattttttggctgaagacgagtcagtgcatgatgaactggtagcgcagttagccgaacttgataagataatgaccagctacgagatgactttactcttgtcagaaccttatgaccacaacaatgccatcttggaaatccatccaggttctggtggtactgaggcgcaggactggggtgatatgttgcttcgtatgtatactcgttatggtaatgctaaaggctttaaagtggaagtgttggattaccaagcaggtgatgaggctggtattaagtcggtaactttatcatttgaagggcctaatgcctatggtctcctcaagtcagaaatgggtgttcaccgcttagtgcgaatctcaccatttgactctgccaaacgtcgccatacctctttcacatctgtagaagtgatgccagaattggatgatactattgaagtggaaatccgtgaagatgatatcaagatggataccttccgttcaggtggtgccggtggacaaaacgtcaataaagtttcaacaggtgtacgtttaacccacattccaactggaattgttgtccaatcaacagtggatcgtacccagtatggaaatagagatcgtgccatgaagatgttgcaggctaagctctatcaaatggagcaagagaagaaggctgcggaggtagattctctcaaaggtgagaaaaaggagattacttggggaagccaaatccgttcttatgtcttcacgccttatactatggtaaaagatcaccgaactagctttgaggttgctcaggtagataaggttatggatggggacctagatggttttatcgatgcttatctcaagtggcgaattagctaa

SEQ ID NO: 127 - DNA, 657 bp, Streptococcus pneumoniae
atggcagttaaagattttatgacccgcaaggtagtttatattagtccagatacaacagtatctcatgcagcagatttgatgagagagcaaggtttgcaccgtctgcctgttatcgaaaatgatcaattagttggtttggtgactgagggaaccattgcacaagcaagtccatctaaagcaacaagtctttctatatatgagatgaattatcttctgaataagacaaaagtaaaagatgtcatgattcgcgatgttgtcactgtctcaggctatgctagtctagaagatgcaacttatctgatgttgaaaaataagattggtattctccctgtcgtagataaccatcaagtatacggagttattactgaccgtgatgttttccaagcctttcttgaaattgcaggttatggcgaagaagggattcgtgtacgctttgttacagaagatgaagttggtgttcttggaaaaattgtttctttgattgtagaagaaaatttgaatatctcccatacagtcaatattccgcgtaaggatggtaaggtgattatcgaagtgcaaatcgatgaatcaattgatttaccagccttgaaagaaaaatttgaagcaaatggtattcaagtggaagaaatcgctcgcacttcagcaaaagtcttgtaa

SEQ ID NO: 128 - DNA, 711 bp, Streptococcus pneumoniae
atgtctatgttaaaagttgaaaatctttctgtgcattacggtatgatccaagcagtccgtgatgtaagctttgaagttaatgaaggagaagttgtttcccttatcggtgccaacggtgcaggtaagacaactattcttcgcaccttgtcaggtttggttcgaccaagttcaggaaagattgaatttttaggtcaagaaatccaaaaaatgccagctcagaaaatcgtggcaggtggtctttcacaagttccagaaggacgccacgtctttcctggcttgactgttatggaaaatcttgaaatgggagctttcttaaagaaaaatcgtgaagaaaatcaagctaacttgaagaaggttttctcacgctttcctcgtcttgaagaacggaagaaccaagatgcagctactctttcaggaggggaacaacaaatgcttgccatgggacgcgctcttatgtcaacaccaaaacttcttcttttagatgaaccatcaatgggacttgccccaatcttcatccaagagatttttgatatcattcaagatattcagaagcaaggaacaaccgtcctcttgattgaacaaaatgccaataaagcacttgcaatctctgaccgaggatatgtattggaaacaggaaaaatcgtcctatcagggtcaggaaaagaactcgcttcatcagaagaagtcagaaaagcatatctaggtggctaa

SEQ ID NO: 129 - DNA, 201 bp, Streptococcus pneumoniae
atgatatcaaaaatctcttggatgaagattggggcaagtcccattgatggttcatctaaaagaagaagttttggtgttgacataagagcgcgtcccatggcaagcatttgttgttcccctcctgaaagagtagctgcatcttggttcttccgttcttcaagacgaggaaagcgtgagaaaaccttcttcaagttagcttga

SEQ ID NO: 130 - DNA, 765 bp, Streptococcus pneumoniae
atggcattacttgaagtaaaacagttaaccaaacattttggtggtctaacagctgttggagatgtgactcttgaattgaacgaaggggaactggttggattaatcggtccaaacggagctgggaaaaccacccttttcaaccttttgaccggtgtttatgaaccaagtgagggaacagtaactctagatggtcaccttttgaatgggaaatcaccttataagattgcctctttgggacttggacgtactttccaaaatatccgtctctttaaagatttaacagttttagacaatgttttgattgcttttggaaaccatcacaaacagcatgtttttactagtttcttacgcttaccagctttttacaagagtgaaaaagaattaaaggctaaagctttggaattgttgaaaatctttgatttagatggtgatgcagagactcttgctaaaaatctttcctacggacaacaacgtcgtttggaaattgttcgtgcccttgctacggaacctaaaattctcttcttagatgaaccagcagcaggtatgaacccacaggaaacagccgaattgactgagttaattcgtcgtatcaaagatgaatttaagattacaatcatgttgattgaacacgatatgaatctggtcatggaagtaacagaacgtatctacgtacttgaatatggccgtttaattgctcaaggaactccagacgaaattaagaccaataaacgcgttatcgaagcttatctaggaggtgaagcctaa

SEQ ID NO: 131 - DNA, 957 bp, Streptococcus pneumoniae
atgaaggaaaatttaaaagttaatattctatggttactccttttgttagctggctatagcttgattagtgtactggtttcagtcggagtacttaatctattctatgtacagattttacaacaaattggaattaatattattttggctgttggtctcaacttaatcgttggtttttcaggacaattttcacttggtcatgctggtttcatggcgattggtgcctatgcagcagctattattggttctaaatcaccaacctacggtgccttctttggagctatgcttgtaggggctttgctttcaggagcagttgccttacttgtcggcattccaaccttgcgcttgaagggggactatcttgcggtagcaactctaggtgtttctgaaattatccgtatctttatcatcaatggtggaagccttacaaatggtgcggcaggtatcttagggattcctaactttacaacttggcaaatggtttacttctttgtcgtgattacaaccattgcaaccttgaacttcttgcgtagcccaattggtcgttcaaccctctctgttcgtgaagatgaaatcgctgctgagtcagttggggttaatacgactaaaattaaaatcatcgcttttgtctttggtgccattactgcaagtattgctgggtcacttcaggcaggatttatcgggtctgttgtaccgaaagattacaccttcatcaactcaatcaacgttttgattattgttgtatttggtggactcggttccattacaggtgcgattgtttcggctattgttctgggaattttgaatatgcttctccaagatgttgctagtgtgcgtatgattatttacgctttggccttggtattggtaatgattttcagaccaggtggactccttggaacatgggaactgagcctatcacgtttctttaaaaaatctaagaaggaggaacaaaactaa

SEQ ID NO: 132 - DNA, 879 bp, Streptococcus pneumoniae
gtgaatcttatgctccaacaactcgtaaatggtttgattctaggtagtgtttacgcgctgttagccctaggatataccatggtttacggaattatcaagctcatcaacttcgcccatggtgatatttatatgatgggagcctttatcggttatttcttgatcaattctttccaaatgaatttctttgtagcgcttattgtagctatgctagtgacagctattcttggtgtcgtgattgagtttcttgcttaccgacctttgcgccactctactcgtattgctgttttgattacggctattggggtttctttcctattggagaatggaatggtctatctggttggtgccaatacccgtgccttccctcaagcgattcaaacagttcgatatgatttgggaccaattagcttaacaaatgtgcagttaatgattttggccatttccttgattttgatgattttgttacaagtcattgtccaaaagactaagatggggaaagccatgcgtgcagtatcagtagatagcgacgcggcacaattgatggggatcaatgtaaaccgtacgattagctttaccttcgctttgggttctgctcttgcgggtgcggctggtgttctgattgctctttattataactctcttgagcctttgatgggggttactccaggtcttaaatctttcgttgccgcagtacttggtggtatcggaattattcctggtgcggctcttggtggctttgtgattggtctattggaaacctttgcgacagcctttgggatgtcagatttccgtgatgccattgtttatggaatcttgttgttgatcttgattgtccgcccagctggtatccttggtaagaatgtgaaagagaaggtgtaa

SEQ ID NO: 133 - DNA, 1161 bp, Streptococcus pneumoniae
  unsure (160),(253): n at each above location is unknown.
atgaagaaaaaatttgccctatcgtttgtggcgcttgcaagtgtagcacttcttgcagcctgtggagaagtgaagtctggagcagtcaacactgctggtaactcagtagaggaaaagacaattaaaatcgggtttaactttgaagagacaggttctttanctgcatacggaacagctgaacaaaaaggtgcccaattggctgttgatgaaatcaatgccgcaggtggtatcgatggaaaacaaatcgaagtantcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgccaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaagattgtaaaccaagcgcgtggtatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaaccataa

SEQ ID NO: 134 - DNA, 450 bp, Streptococcus pneumoniae
  unsure (56): n at each above location is unknown.
ttgatttcatcaacagccaattgggcacctttttgttcagctgttccgtatgcagntaaagaacctgtctcttcaaagttaaacccgattttaattgtcttttcctctactgagttaccagcagtgttgactgctccagacttcacttctccacaggctgcaagaagtgctacacttgcaagcgccacaaacgatagggcaaattttttcttcatctttttgtctccttatttcttaaatagtctgttaagaatataccgaattatcagaaaattgtcaatgttttccttgaactttttcgatgataacgttttcctatcgataaagattgcccacaaagggtgtttccaactcttggatatgacaaaccctaacttttttaataaatttttccttgctcaagcgtccgaccaattgctccacttcttgagttggaacatagagttgtaa

SEQ ID NO: 135 - DNA, 249 bp, Streptococcus pneumoniae
atgtttgaaaaagtcaatcgctctggcttgattatctatctttactataatcgtgatgccaaaaaactgcaggattatggagatattacctatcattccaagaaacatcgttacttacaactctatgttccaactcaagaagtggagcaattggtcggacgcttgagcaaggaaaaatttattaaaaaagttagggtttgtcatatccaagagttggaaacaccctttgtgggcaatctttatcgatag

SEQ ID NO: 136 - DNA, 591 bp, Streptococcus pneumoniae
atgattcctgtagttattgaacaaacaagccgtggagaacgttcttacgatatttactcacgtcttctcaaagaccgcatcattatgctgacaggtccggttgaagacaatatggctaactctgttattgcccaactgcttttcttggatgcccaagatagtacaaaagatatttacctttatgtcaatacaccaggggggtctgtttcagctggtttggcaatcgtagataccatgaactttatcaaggcagatgtccaaaccattgttatgggaatggctgcatctatgggaacagtcatcgcatcaagtggagcaaaaggcaaacgtttcatgcttccaaatgctgaatacatgattcaccaaccaatgggcggtacaggtggtggtacccaacaaactgatatggctatcgctgcagaacacttgctcaaaactcgtaataccttggaaaaaatcttggctgaaaattcaggtcagtcaatggaaaaagtccatgcagatgcagaacgtgataactggatgagcgcccaggaaacacttgaatatggctttattgatgaaattatggccaacaattcattgaactaa

SEQ ID NO: 137 - DNA, 651 bp, Streptococcus pneumoniae
ttgaaagaaggaattccaaaaatgggaaaaattgaagttattaatcacccactgattcaacacaaattgtcaatcttgcgtcgtacagatacttctacaaaagcttttcgtgagctagtagatgagattgcaatgttgatggggtatgaagtacttcgtgatcttccactagaagatgtggaaatcgaaacaccaattacaaaaacagttcaaaaacaattggcaggtaagaaattggccatcgtcccaatcttgcgtgcaggtatcgggatggttgatggtctcttgagcttggttccagctgctaaagttggccacatcggtatgtaccgtgatgaagaaacacttcaaccagttgaatacttggtgaaattgcctgaggacattgaccaacgtcaaatttttgtagtagacccaatgttggcaacaggtggctcagcaatcttggctgttgattctcttaaaaaacgtggcgcatcaaatatcaaatttgtctgccttgtatctgctccagagggtgtaaaagcccttcaagaagctcatccagatgtagaaatctttacagcagccttggatgaacgtttgaacgaacacggttatatcgttccaggtcttggagatgctggagaccgcttgttcggtacaaaataa

SEQ ID NO: 138 - DNA, 162 bp, Streptococcus pneumoniae
ttggaattccttctttcaatttattcttcttattataccaaaaaacgggttaaaaatctttctaaaccatttatttttgataatttttacattagatcagcctctttaagagctgtctgtactgtctcaagtggtaaatgggtcaattctgtccctttttct

SEQ ID NO: 139 - DNA, 468 bp, Streptococcus pneumoniae
atgactgaaaaaagactggcctgggatgagtattttgcagcccaagctctactaattgcgaatcgttccacttgtaaacgtgctaaagtgggcgcgattctggtaaaagataataaggttatttccactggttacaatggttcggtgtcagggactgagcattgtattgatcacgaatgtttggtcattgaaggccactgtgttcgcacccttcacgctgaggtcaatgctatccttcaaggtgctgagcgtggtgttcccaaaggttttacagcctatgtaacccattttccttgtctcaactgtacaaaacaattgcttcaggtcggctgcaagcgtgtggtttatatcaaccagtaccgaatggacgactacgcccaatacctttatcaagaaaaagggacagaattgacccatttaccacttgagacagtacagacagctcttaaagaggctgatctaatgtaa

SEQ ID NO: 140 - DNA, 558 bp, Streptococcus pneumoniae
atgtctgaacgtagaatctctgaaaagtctcttgaaaatctcagaaaatcaaaccaagaatccaatttattaaccagagaagccattgaaacagccctcttgcaactcttggaaaaaaaggaactgaccaagattagtatttctgaattggtcaaacgtgcaggtgtttcgcgtgcggccttttatcgcaattatgactccaacgaggaaattttagagagcgtctttaaacgaactgtccacaatattatggaacagctgcatcattacgatttaaagacagacctttatttggtttgggttcaccttttccgggaggccagaaaggaagctagagtaattcaattggccttggattaccatctggaaaaaatctttgtccaagccatgcaggaatttctaggaaaataccatgggaaatcaaaaggtgtcagctcttatcttcattccttctggagctcagccatcgtctctgtccttctaaaatggatcaaggatggcatgaaggtaccagctgaaaagattgcagatttaggtttaccattttttaaaaaatag

SEQ ID NO: 141 - DNA, 846 bp, Streptococcus pneumoniae
atgacttggaagattattgctgactctggttgtgattatcgtcaactgccaacaccagctattaacacaacctttgtaagtgtccccttaaccattcaagtagctgatcaggtctttgttgatgacgccagtctcgatattgaccaaatgatggaaaccatgtatgcaactgcagaagcttcaaaatcggcttgtccaagcccagatgactatttgcgagcatttgaaggtgccaaaaacattttcctagtaaccatcacaggtaccctttctggcagtcacaatagtgctcaactagcaaagaatatttatctggaagaccatcctgacactaagattcatgtgattgatagtttatctgctggtggtgaagttgacctactcgtagaaaaattgaatgacttgattgaccagggcttgtcttttgaagaagtggttgaagctatcaccgcctatcaagaaaaaactaagttgctctttgtcctagccaaagtcgataacttggtgaagaacggccgtttgagcaagcttatcggtacggtcgttggccttctcaacattcgtatggtcggaaaagctagtgaaactggaactctcgaattgctacaaaaagcaaggggatcaaagaaatcagttcaagctgcctatgatgagttagtaaaagctggatatgctggtggccgtattgtcatggcccaacgcaataacgaaaaatgttgtcaacaactctcagagcgaatccgtgaaaccttcccacaagcggatattaaaattctaccaacctctggtctctgcagtttctatgcagaagatggcggtttgctgatgggctatgaaattgattaa

SEQ ID NO: 142 - DNA, 1176 bp, Streptococcus pneumoniae
atgaaacattttgatactattgtcatcggtgggggacctgctggtatgatggctacgatttccagtaacttttatggacagaaaaccctcctcatcgaaaaaaatcggaaacttggaaaaaaattagctgggactggtgggggacgttgcaatgtgaccaacaatggtagcttagacaacctgctagctggaattcctggaaacggacgctttctttacagtgttttctcccagttcgataatcatgacatcatcaacttttttacagaaaatggtgttaaacttaaggtcgaagaccacggacgcgtctttccagccagtgacaagtctcggactattatcgaagctttggaaaagaaaatcactgaactaggtggtcaagttgctactcaaatagaaatcgtttctgttaaaaaagtagatgaccagtttgtccttaagtcagcggatcaaaccttcacttgtgagaaactcattgtcacaacaggtggtaagtcttatccttcgactggttcgactggttttggtcacgagattgctcgccattttaagcataccatcaccgatcttgaggctgctgaaagtcctttattaacagattttccacataaagccttacaagggatttctctggacgatgtgaccctaagttatggtaagcatgtcatcactcatgatttactctttacccactttggtttgtcaggtcctgctgccctacgcatgtctagctttgtcaaaggtggggaggttctctcactcgatgttttgcctcaactttctgagaaggacttggttacatttctagaagaaaatcgggaaaaatccttgaaaaacgctttaaaaaccttgttaccagaacgcttggccgaattttttgtacaaggatatcctgaaaaagtcaaacagctgactgaaaaggaacgagaacaacttgtccagtccattaaagaacttaaaattcctgtaactggaaaaatgtcccttgcaaagtcctttgttaccaagggtggagtcagtctcaaggaaatcaatcctaaaacccttgaaagtaagctggtacctggcctccactttgcaggcgaagttatggatatcaatgcccacacgggtggctttaacatcacttctgccctctgtaccggctgggtggcgggaagtctgcattatgattaa

SEQ ID NO: 143 - DNA, 456 bp, Streptococcus pneumoniae
atgaacagaagagaggcagtcgaatttgttaacatgtgtatgattaaaaacggagataaggtcctggtccaagaccgagttagtcccgactggtctggcattacttttcctggtggtcatgttgaacgtggcgaatcctttgtcgatgctgtcattcgtgaagtgaaagaagaaactggtctgatcatttccaaaccccaactctgtggtatcaaaaactggtatgacgacaaggattatcgttatgtcgtccttttttacaagacagaacactttactggtgaactccagtcttcagacgaagggaaagtttggtgggaggactttgaaaatctttctcatctaaaacttgcaaccgatgatatgtctgatatgcttcgtgtgtttctagaagaagatctcagtgaattcttttactacaaaaacggtgacgactggctttatgatttgaagtaa

SEQ ID NO: 144 - DNA, 519 bp, Streptococcus pneumoniae
ttgccccatttaactaggcagttggactatctaactcgcgaaaggcaacatctggataccttgatttccaccttgcaaaaaactattcaagaacaaaaaggagaaagaaaaatgaccattgaggaaaaattcacgggatttagctatcaagacaatcaaaaatatcaccaagaagcggtagagaaatatggtcaagaagtcatgggacaagcgctcgaacgccaaaaaggtcacgaagacgaggctacggccgcctttaaccaagtctttcaaactttggcacaaaatcttcaagttggtttacctgcaacagcaaccgaaaaccaagagcaagcagccaagctcttgcaagctattcgcacttatggatttgactgctctattgaggtattcggtcatatcggtaaaggttacgtctacaacccagagtttaaggaaaacattgacaagtttggttctggaacagcccagtacacgtcagatgccattgcggcttacgttcagacaaatgcagaataa

SEQ ID NO: 145 - DNA, 1470 bp, Streptococcus pneumoniae
ttgaaaatggttttcttgacagaccttagaaaacatgataggatagtcaagtctatcaatcaaacagaaggctatttgacaactcaagtagctttttcttattttgaaaaaggagatcagagtttaactatgtcagaaaaatcacaatgggggtcgaaacttggctttattctagcatctgctggctcggtcatcgggcttggttccgtttggaagtttccctacatgactgctgctaatggcggtggaggctttttactaatctttctcatttccactattttaatcgatttccctctcctgctggctgagtttgcccttggccgtagtgctggcgtttccgctatcaaaacctttggaaaactgggcaagaataacaagtacaactttatcggttggattggcgcctttgccctctttatcctcttatctttttacagtgttatcggaggatggattctagtctatctaggtattgagtttgggaaattgttccaacttggtggaacgggtgattatgctcagttatttacttcaatcatttcaaatccagccattgccctaggagctcaagcgacctttatcctattgaatatcttcattgtatcacgtggggttcaaaaagggattgaaagagcttcgaaagtcatgatgcccctgctctttatcatctttgtcgtcatcatcgaacgctctctcagtttgccaaatgccatggaaggggttctttacttcctcaaaccagatttttcaaaactgactagcgctggtctcctctatgctctgagacaatctttctttgccctctcactaggggttacagccatgttgacctatgcttcttacttggacaagaaaaccaatctggtccagtcaagaatctccatcgtagccatgaatatctcggtatccatcatggcaggtctagccattttccaagctcggtcccccttcaatatccagtctgaagggggaccgagcttggtctttatcgtcttgcctcaactctttgacaagatgccttttggaaccattttctatgtcctcttcctctttgcgactgtcacttcttctgtcgttatgctggaaatcaatgtagacaatatcaccaatcaggacaacagcaagcgtgctaaatggagtgttattttaggaattttgacctttgtctttggcattccttcagccctatcttacggtgtcatggcggatgttcacatttttggtaaagccttctttgacgctatggacttcttggtttccaatctcctcatgccatttggagctctcttcctttcactttttacaggctatatctttaaaaaggctcttgcaatggaggaactccatctcgatgaaagagcatggaaacaaggactgttccaagtctggctcttccttcttcgtttcgtcattccaatcatcatctgtggtcttcatcgcccaatttatgtaatcaaaaggacttga

SEQ ID NO: 146 - DNA, 945 bp, Streptococcus pneumoniae
atgtcagaaccattatttttacaatcagttatgcaagaaaaaatctggggtggagccaagctacgtgatgagtttggctacgatatcccaagtgaaaaaatcggagaatattgggccatctcagcccatccaaatggagtctctaaagttgccaatggtcgttacgagggaacagatcttgctactttgtatgcggaacaccgtgaattatttggcaatcgtccagaacctgtatttccacttttgaccaagatcctcgatgccaacgactggctcagtgtccaagttcacccagacgatgcttatggactcgagcatgaaggcgaactcggaaaaacagaatgctggtacattatcgcagcggatgaaggttcagagattatctacggtcacaatgccaagtcaaaagaagaactccgccagcaaatcgaggataagaactgggatgcgctgttgacaaaagtgccagttaaagcaggagatttcttctatgtaccaagcggtaccatgcacgctatcggggcgggtatcttgattcttgaaacccagcagtctagcgataccacttaccgtgtctatgactttgaccgtaaggatgacaagggcaatttacgtgaacttcaccttgaaaaatctatcgatgtcttgaacattggtgaacctgcaaatagccgtccagtgacaatcaaagcagatgatctacgttccactctccttgtatccaatgatttcttcgcagtttacaaatgggaaattactggaaaagttaactttgaaaagacagctgactacagcttgttgagtgtcttggctggtcaaggtcaactaactgttgacgggaaaaactatccaatccaaaaagggagacactttatcctaccaagtgatgttgaatcttggactctagaagggcaagatttagaattaattgttagtcatccataa

SEQ ID NO: 147 - DNA, 402 bp, Streptococcus pneumoniae
atgtcattgatagcaatggtgcaagcatcgggtagagcacatttgtttactatttttataaaatcttctccctgctttataagatgtaaaaaagagttcaattcgaactctttttttgctataatgaggggagaaaaatcagacaggagatcgacatgtcagaaccattatttttacaatcagttatgcaagaaaaaatctggggtggagccaagctacgtgatgagtttggctacgatatcccaagtgaaaaaatcggagaatattgggccatctcagcccatccaaatggagtctctaaagttgccaatggtcgttacgagggaacagatcttgctactttgtatgcggaacaccgtgaattatttggcaatcgtccagaacctgtatttccacttttga

SEQ ID NO: 148 - DNA, 330 bp, Streptococcus pneumoniae
tttagtattatcgtagaaaatggactcggtgctatggatacaccggatgagaatggttatgtagcagataactatcggattacttacttagaggcccacatcaaggccatgcgagatgccatttaccaagacggggttgacttgcttggttatacgacttggagctgtatcgatccggtttcagctggcacaggggaaatgaataagcgctatggctttatctatgtagatcgagataatgtaggaaacggagctctcaaacgtagcaagaagaagtccttctattggtacaaggatgtcattgatagcaatggtgcaagcatcgggtag

SEQ ID NO: 149 - DNA, 267 bp, Streptococcus pneumoniae; identical to SEQ ID NO: 66

SEQ ID NO: 150 - DNA, 654 bp, Streptococcus pneumoniae
atggttggcgaaatattatgccacgtccagaacatcctaggaaagcagacgctcaaaccattgtcgcgtctaaaaataaaatctcaattcaagaaggcaagaaagcgctttaaatatagtagacgttttcgtaaggttcgcttgatgtaccaagatgaggctggtttcagtagaatcagtaaactgggatcttgttggtctccaataggagtagatccacatgtccatagtcactatatacgagaatttcgctattgttatggagctgttgatgcctatacaggcgaatcatttttcttaatagctggtagatgtaatactgagtggatgaacgcctttttagaagagctttcacaagcttatccagatgattatcttttactcgttatggacaatgctatatggcataaatcaagtatcttaaagattccgactaatattggttttgcatttattcctccatacacaccagagatgaaccccattgaacaagtgtggaaagagattcgtaaacgtggatttaagaataaagcctttcgaattttggaagatgtcatgaatcaactccaagatgtcatacaaggattggagaaggaggtgataaagtccatcgttaatcggagatggactagaatgctttttgaaagcagatga

SEQ ID NO: 151 - DNA, 348 bp, Streptococcus pneumoniae
atgaatttaaatcaattagatattatcgtttcaaatgttccccaagtctgtgctgacttggagcatattttggataaaaaggcagattatgctgatgatggttttgctcagtttacgattggtagtcactgccttatgttgtcacaaaatcatttggttcctttggaaaactttcagtcaggaatcattattcatatcgaggttgaggatgtagaccagaactacaaacggttgaacgagcttggtataaaggttttacacggaccaactgtaaccgattggggaacagagtccttattagttcaaggacctgctggtctagtgcttgatttttatcgtatgaaatag

SEQ ID NO: 152 - DNA, 1776 bp, Streptococcus pneumoniae
atgactcaagggaaaattactgcatctgcagcaatgcttaacgtattgaaaacatggggcgtagatacaatctacggtatcccatcaggaacactcagctcattgatggacgctttggctgaagacaaagatatccgcttcttacaagttcgccacgaagagacaggtgctcttgcagcggttatgcaagctaaattcggcggctcaatcggggttgcagttggttcaggtggtccaggtgcgactcacttgattaacggtgtttacgatgcagctatggataacactccattcctagcgatccttggatcacgtccagttaacgaattgaacatggatgctttccaagagcttaaccaaaacccaatgtacaacggtatcgctgtttacaacaaacgtgtagcttacgctgagcaattgccaaaagtaattgacgaagcctgccgtgctgcaatttctaaaaaaggtccagctgttgttgaaattccagtaaacttcggtttccaagaaatcgatgaaaactcatactacggttcaggttcatacgaacgctcattcatcgctcctgctttgaacgaagttgaaatcgacaaagctgttgaaatcttgaacaatgctgaacgcccagttatctatgctggatttggtggtgttaaagctggtgaagtgattactgaattgtcacgtaaaatcaaagcaccaatcatcacaactggtaaaaactttgaagctttcgaatggaactatgaaggtttgacaggttctgcttaccgtgttggttggaaaccagccaacgaagtggtctttgaagcagacacagttcttttccttggttcaaacttcccatttgctgaagtttacgaagcattcaagaacactgaaaaattcatccaagtcgatatcgacccttacaaacttggtaaacgtcatgcccttgacgcttcaatccttggtgatgctggtcaagcagctaaagctatccttgacaaagtaaacccagttgaatcaactccatggtggcgtgcaaacgttaagaacaaccaaaactggcgtgattacatgaacaaactcgaaggtaaaactgagggtgaattgcaattgtatcaagtttacaatgcaatcaacaaacatgctgatcaagacgctatctactcaatcgacgtaggtaacactactcaaacatctactcgtcaccttcacatgacacctaagaacatgtggcgtacatctccactctttgcgacaatgggtattgcccttcctggtggtatcgctgctaagaaagacaatccagatcgccaagtatggaacatcatgggtgacggagcattcaacatgtgctacccagacgttatcacaaacgttcaatacgaccttccagttatcaaccttgtcttctcaaatgctgagtacggcttcatcaagaacaaatacgaagatacaaacaaacacttgtttggtgtagacttcacaaacgctgactacgctaaaattgcggaagctcaaggagctgttggattcacagttgaccgtatcgaagacatcgatgcagttgttgcagaagctgttaaattgaacaaagaaggtaaaactgttgtcatcgatgctcgcatcactcaacaccgtccacttccagtagaagtacttgaattggatccaaaacttcactcagaagaagctatcaaagccttcaaggaaaaatacgaagcagaagaactcgtaccattccgtctcttcttggaagaagaaggattgcaatcacgcgcaattaaataa

SEQ ID NO: 153 - DNA, 201 bp, Streptococcus pneumoniae
gtaagaaaacctttcatcgaattctactcaatcttttctgggcttttatctacaatgttgtcgggaattccgattgcagcaggagtcttttcaggtgttggactggctctcaacccagaattggcaggtctagccatggcctttagttctgtatctgttctgaccagttcccttctgttaaattttagtaaaatagactaa

SEQ ID NO: 154 - DNA, 2199 bp, Streptococcus pneumoniae
gtggagactatgacagaaattgtgaaagcaagcttagaaaatggcattcaaaaaatccgtatccgagctgaaaaaggctatcatccagcccatatccagcttcaaaagggaattccagctgagattacctttcatcgtgctactccttcaaactgttataaggaaattctgtttgaagaagaaggtatcttggaaccaatcggcgtagatgaggagaaagtcattcgttttacacctcaagaattagggcgacatgaattttcttgtggcatgaagatgcaaaagggaagctatatagtcgttgagaagactcgaaaatctctatctctcctgcaacgtttttggattactagtatctttactgtgcctcttgtgattctcatgattgggatgttgacaggtagcattagtcatcaagtcatgcattggggaacctttctagcaacaacgcctattatgttagttgcaggtaagccatatatccagagtgcttgggccagttttaaaaagcacaatgccaacatggataccttggttgcgctgggaactctagtggcttatttctatagcctagttgctctctttgctggtctccctgtttacttcgaaagtgctggatttatcctctttttcgttcttttgggagcagtttttgaggaaaaaatgagaaaaaatacgtcccaagctgtggagaaattactggacttgcaagctaaaaccgcagaagtcttgagtgatgatagttatgtccaagttcctttggaacaagtcaaggtaggcgacctgattcgagtgcgtcccggtgaaaagattgctgttgatggtgtcgtagtagaaggtgtctctagtattgacgaatccatggtgacaggtgagagtctgcctgtggacaagacagttggagatactgtcattggctcaaccatcaatcatagtggaacgcttgtctttagagcagaaaaagttggctcagagactgttttggctcagattgtggattttgtgaagaaagctcagacaagtcgtgcgccgattcaggacttgacggataagatttcagggatttttgtcccagtagttgtcattttaggaatcatgaccttttgggtttggttcgtcttgctcagggatagtgtggtcgtgcttggagctagctttgtgtcctctcttctctacggagtggcggttttgattatcgcctgtccttgtgccttgggacttgcaacaccgacagcccttatggtggggacaggacgtagtgccaagatgggggttctcctcaaaaatggaactgtcttacaggaaatccagaaagttcaaactcttgtctttgataagaccgggactttgacggaagggaaacctgtggtaacagatatcatcggcgacgaagtagaagtgtttggattggcagcctccttggaagatgcttctcaacacccactggctgaggctatcgttaagcgagcgagtgaagctggacttgagtttaaaactgttgaaaattttcaggccttgcacgggaaaggtgtttcagggcgaatcaatggaaaacaagttttacttggaaatgctaaaatgctggatggcatggatatttctaatacttatcaagataaactagaagaactagaaaaagaagctaagacagttgtgttcttagctgttgacaatgaaatcaaaggcttgcttgctttgcaagatattcctaaggaaaatgctaagctagccatcagtcagctaaaaaaacgtggtctccgaacagtcatgctgacaggagacaatgctggtgtggcgtgtgctattgcagatcaaatcggaattgaagaggtcattgcaggcgtcttgccagaagaaaaagcccatgaaatccataaactgcaacagtcagggaaagtagcctttgttggggacggtatcaatgacgctcctgcccttagtgtagcagatgtggggattgctatgggagctggaacagatatcgccatcgagtcagcagatttggtgttgacaaccaataatcttttaggagtggttcgtgcctttgatatgagtaagaaaacctttcatcgaattctactcaatcttttctgggcttttatctacaatgttgtcgggaattccgattgcagcaggagtcttttcaggtgttggactggctctcaacccagaattggcaggtctagccatggcctttag

SEQ ID NO: 155 - DNA, 255 bp, Streptococcus pneumoniae
aaggttttcttactcatatcaaaggcacgaaccactcctaaaagattattggttgtcaacaccaaatctgctgactcgatggcgatatctgttccagctcccatagcaatccccacatctgctacactaagggcaggagcgtcattgataccgtccccaacaaaggctactttccctgactgttgcagtttatggatttcatgggctttttcttctggcaagacgcctgcaatgacctcttcaattccgatttga

SEQ ID NO: 156 - DNA, 183 bp, Streptococcus pneumoniae
atggttgagccaatgacagtatctccaactgtcttgtccacaggcagactctcacctgtcaccatggattcgtcaatactagagacaccttctactacgacaccatcaacagcaatcttttcaccgggacgcactcgaatcaggtcgcctaccttgacttgttccaaaggaacttggacataa

SEQ ID NO: 157 - DNA, 372 bp, Streptococcus pneumoniae
atgttaaatagtattgtaaccattatttgtattgcccttatcgcgtttatcttgttttggtttttcaaaaagcctgaaaaatctggacaaaaagcccagcaaaaaaacggataccaagagattcgagtggaagtcatgggaggctatactcctgagttgattgtcctcaagaaatcagtgccagcccgcattgtctttgaccgcaaggatccttcaccatgtctggatcaaattgtttttccagattttggtgtacatgcgaacctgccaatgggggaagagtatgtagtggaaatcacgcctgaacaggctggagagtttggctttgcttgtggtatgaacatgatgcacggcaagatgattgtagagtag

SEQ ID NO: 158 - DNA, 426 bp, Streptococcus pneumoniae
ttgacaaatgtagattttggaggtatggtaatgcagatttcagatgcagaatggcaggtcatgaagattatttggatgcagggggagcagaccagtacagatttgattagggttttggcagagcggttcgactggtccaagtcaaccattcaaactcttttggctcgtttggttgagaaagagtgtctgactcggaaaaaagaaggcaagttctttgtttattcagcccttttaactctagaccaaagtcgggatttacttgtccaagatatcaaagacaaggtttgttcccgtaggattaggaatttgttggctgacttgattgtagaatgtgaatttactcagactgacttggaagacttggaagctgtgatttcagagaagaaatcaagtgctgtaacagaagtaagatgtaattgtatgtaa

SEQ ID NO: 159 - DNA, 807 bp, Streptococcus pneumoniae
atgacttatttacccgttgctttgaccattgcagggactgaccctagtggtggtgctggcattatggcagatttaaagtcattccaagcgagagatgtctatggaatggctgttgtaaccagtcttgtcgctcaaaataccagaggtgttcagctaatcgagcacgtttctcctcaaatgttgaaagcccaattggagagtgtcttttctgatattccacctcaggctgtaaaaactggaatgttggctactactgaaatcatggaaatcatccaaccctatcttaaaaaactggattgtccctatgtccttgatcctgttatggttgctacaagtggagatgccttgattgactcaaatgctagagactatctcaaaacaaacttactacctctagcaactattattacgccaaatcttcctgaagcagaagagattgttggtttttcaatccatgaccccgaagacatgcagcgtgctggtcgcctgattttaaaagaatttggtcctcagtctgtggttatcaaaggcggacatctcaaaggcggacatctcaaaggtggtgctaaagatttcctctttaccaagaatgaacaatttgtctgggaaagcccacgaattcaaacctgtcacacccatggtactggatgtacctttgctgcagtgattactgctgaactagccaagggcaagagtctttaccaggcagttgataaggccaaggcctttatcacaaaagctattcaagatgcccctcaactcggtcatggttctggtccagtcaaccatacaacttttaaagattaa

SEQ ID NO: 160 - DNA, 633 bp, Streptococcus pneumoniae
atgaatagagaagcgcttagactatatctggtaaccaatcgctatcaagattccgtggaaagctttcttgcaaaagttgagacggcctgccgttcaggggttaccatagtccaattgcgagaaaaaaatctcacaaccaatcaatattatcaactggcaaaacaagtcaaggaaataacagatgcttatcaggtccccttgataatcgatgatcggttggatgtttgtcttgcggttgatgctgctggtctgcatattggagatgacgaactcccagtttcggttgcccgacaagtcttgggtcctgaaaaaatcctcggtgtcaccgctaaaacggttaaaagagctctggaagcggagaaatcaggtgcagattacttggggacaggagccatttttccgacaaccaccaaggaaaatgcacccatcaccctgatttcaaccttgaaaacaatttgccaaacggttgccattccaatagttgctattggcggcttgacttcggagaatattgatcagcttatgggcactggcatagctggtgtagctgttgtacgtgatttgatgcaagcagaagatattgaggcaaaaacgcaagcctttttaacaaagttgcatgacattctttcctaa

SEQ ID NO: 161 - DNA, 807 bp, Streptococcus pneumoniae
atgatgcaggcattgacaaatccttttcctataggctctagttccctcattcactgtatgaccaatgagatttcttgtgagatgctggcaaatgggattttggctctgggatgcaaacctgtcatggcagatgatccccgtgaagttcttgattttactaagcaaagccaggctctcttcatcaatttggggcatttgtcagctgagaaggaaaaagcaatccgcatggcagctttgtatgcaaaccaatcttctctcccgatggtagtagatgcggttggcgtaacgacttcatccattcgtaagagcttagttaaagaccttttagactatagacctacggtccttaaaggaaacatgtcagaaattcgaagtcttgttggattaaagcatcacggcgttggggtcgatgcgagtgctaaagatcaagaaacggaggatttgcttcaagtcttgaaagactggtgtcagacctatcctggtatgccattcttagtcacaggtcccaaggaccttattgtttcggagaatcaagttgctgtacttgagaatggctgtactgaattagactggataacagggacaggagacttggttggagccttaacagctgtttttctcagccaaggaaagactggttttgaagcttcttgcttagcagtctcttatctcaatatcgctgctgagaaaatagttgttcaaggaatgggattggaagaatttcgttaccaagtactcaatcagctttcgctcctaagaagagatgaaaattggctagataccatcaaaggagaggtttatgaatag

SEQ ID NO: 162 - DNA, 525 bp, Streptococcus pneumoniae
atgagaaagcaccaactacaagttcacaaattgaccattttatctatgatgattgcccttgatgtagtccttacacctatctttcggattgagggaatggcaccgatgtccagtgtagtcaatattctagcgggaatcatgatgggacctgtttatgccttggctatggctacagtgacagcctttatccgtatgacgactcaagggattccgcctttagctctcacaggagcgacttttggagcccttctagcaggtctcttttataagtacggtcgaaaattttacttttctgccttgggagaaattgtgggaacaggtattattggttctattgtttcctatcctgttatggtgctctttacaggatcggctgctaagcttagttggtttatctacacgcctcgatttttcggagcaaccttgattggtacagcgatttcctttattgcatttcgatttttaatcaagcaggaattctttaaaaaagtgcaaggatatttctttgctgaaaggatagaatga

SEQ ID NO: 163 - DNA, 693 bp, Streptococcus pneumoniae
atggaatttacagatattgcgatggaattatccaagaaagcttggcaggcttcctttcatcatccctttattttacaattacaagaggggaatttagaacctgccattttccgctattacctgattcaggatgcctactatctgaaggccttctcagaaatctatcatcttttggctgataagacttcaaaccaagagatgaaaagactcttgaaacaaaatgctcagggtttagtggagggtgagttatttattcgccaacaatttttcaaggaaatggaaatcagcgaccaggaaatggagcaacatccaattgctccaacctgttatcattacatttctcatatttataggcaatttgcagaaccgaacttagccatcgcttttgcaagcttgcttccttgtccttggttataccatgatataggcaaatcacttaatcttaaaccatcaccaaatcctctctatcaacaatggattgaaacttatattacggatgagttagagcaacagatcagagaggagggagcactggtcaatcagctctatcgagaaagtgatgagacagataagcaaaaaatgctagatgccttccacatcagtgttcatatggaagccaagttttgggagatggcttaccaacaccagacatggaagagcgatttacagtctttagaaaaaggagaagaatag

SEQ ID NO: 164 - DNA, 651 bp, Streptococcus pneumoniae
atggtcaaagtagcaacccagacaccgattatcagtctcttcttgctgattttatccttggaaacatctttcattccttcgattgctctgaatctttcggtagtcgcattttgtattctctttatgctctattaccgtcgatttaaaatgttagcttggatgatcatacttgccattttaccatcttttgccaactactgggcagttcagttacacggagatgcttcacaggcagtcatgcttggaacgagggcctttgtgacagtttgtatcggccttgtctttgtttcctctatttcactaaaagagcttctcttgtacttggctcaaaaggggctatcacgctcttggtcctatgccttgattgtggtattcaattcctttcctctcattcagcaagaaatcaagtccctcaaagaagcttgcctattacgtggtcaagaactgtatttttggtcgcccttgatttacagtaaggttctgatgacagtctttaggtggcgccatctttacctgagagctctgtctgctcatggatatgacgaacatgcacagttgaagaatagctatcggactttttatattcctaaaaaaacaaaattaatctacctgcttttctttttattgcttcaaaccagtctatttttataa

SEQ ID NO: 165 - DNA, 1386 bp, Streptococcus pneumoniae
atgggtctggaactacgagcgattcagtccccaatcttctctgagccgtttgattttacttttcatgcgcaagcctttaccttgttagttgggagcagtggttcaggaaaatccagcctttttcaagtcattgcccaagtcagttctcttccctatagtggtcaagtcctgatagatgggagcgaggtcagtcagctttctatcatcgcacgtgtccagaaggttggcattctctttcaaaatcccaatcatcaatttaccatggagaacttgtttgaggagctgattttcaccttggagaatatcggctatcaccttcaggaaattgattctaaaatagcagaggttgtccagcaatgtcgttgcgaggcaatcttacaccgtcccattcatcacctatcaggtggggaaaagcaaaaagcagcgctggctgtcctctttgccatgaatcctagggtctatctcttggatgagcccttcgcttctattgaccgcaagagcagaatcgagatattggagattctaaaagagttggctcttgatgggaagacagttattttgtgcgaccatgatttatctgactataaagcctatatcgaccatatggttgagctaagagacggaaaactaagggaagtgtttcaaatcccttcctatgagatgacacaggttgcttcaaaggaagttgcttctagcccggaactattccatatgaaccgtgtgactggtgagcttggtaatcgccccctcttttcaattgctgatttcacattctatcaagggatttcctgtatcctgggtgacaatggtgtcgggaaatcaaccctctttcgctctattcttcaatttcaaaagtataaggggcgcattgcatggaaggggacagtcctgaaaaagaaaaagagtttgtaccgtgatctgacgggtgttgttcaggaagctgagaagcagtttatccgagtcagtctgcgagaggagcttcgattagatggacctgattctgaaagaaatcagcggatttttcaagctttacgatattttgatttggagcaggcagtcgataagagtccctatcaattaagtggtggtcagcaaaaaattcttcagctcctgaccatcttgaccagtaaggcttccgtgatcttgctagatgaaccttttgcaggtttggatgatagagcctgccattatttttgcaagtggattgtggaggagaggaatcaaggaagaagttttctgctcattagtcatcgtttagaccctttgatttctgtggttgattattggattgagatgactagtcaggggctcagtcatgtgaaagaagtgaccattaccaaaccacttacatctcagagtagcaatacccaaggggaggtgagatag

SEQ ID NO: 166 - DNA, 561 bp, Streptococcus pneumoniae
atgttgaaaaaatggcagttaaaagatgttatcttgcttgctttcttgtctatcttttttggtggggttttcgttggttcaggatatgtgtataatattctcagtctactcttaacacctcttggtttgcaggcctttgccaatgaaatcctcttcggtctctggtgtatggctgcgcccattgctgccatctttgttccgagagtcggaagtgcaacgattggagaagtgctagctgcgcttgctgaagtcctttatggtagccaatttggtctaggagctcttttgtctggcttggttcaaggtttgggaagtgaatttggttttatcgtaactaagaatcgctatgaaagttggctctctctaactgctaatagtattggggttacgcttgttagctttgtctatgaatacattaagttaggttactacgccttttcccttccgtttgtcctttccttacttgtggtacgttttatttctgtttatttcttctgtaccatcttggttcgtgccattgtcaaactctatcatcagtttgcaactggaggaaaagcatag

SEQ ID NO: 167 - DNA, 225 bp, Streptococcus pneumoniae
aaccaaattcacttcccaaaccttgaaccaagccagacaaaagagctcctagaccaaattggctaccataaaggacttcagcaagcgcagctagcacttctccaatcgttgcacttccgactctcggaacaaagatggcagcaatgggcgcagccatacaccagagaccgaagaggatttcattggcaaaggcctgcaaaccaagaggtgttaagagtagactga

SEQ ID NO: 168 - DNA, 207 bp, Streptococcus pneumoniae
ttgcactcacaaagacagcagatctttcttttgcaaaaaacaaatgacctgtttgatgaattagccattcaagctgaatctagacatagctttttaaaaaaggaaaatcctacttacttagaatccaaggatagatatctattgttcactcatttcccgaacagttttttctatattttttgcatacgatattgccgaaatgattga

SEQ ID NO: 169 - DNA, 630 bp, Streptococcus pneumoniae
atgtttcataaagaattactaaaactatattttatttgtggaacgactacttgccaaggaaaaaatctatatacagtcgttgaggaagccttaaaaggtggtataaccttatttcaatttcgagaaaaaggtgagagtgctttagaaggcttagaaaaacttgagctagctatccaaattaaagaactttgtaaaaaatacaatgttccatttatcgttaatgacgatatagatttagcaatggaaattgacgccgatggcgtacatgttggtcaagatgatattggtgttgatgaaattagaaaattgatgccagataaaataattggtctttctataagaaacgaagaagaatttcaacaatcaaaagttgaatatgtagattatgtaggtgttgggcctgtatttgatacccagtcaaaagatgatgctggtggtgctataggttatgaaggtcttgaattgatgagaaaactattgccacaaatgcctttagttgcaattggtgggatacagacgaaacatattaaagacattataaagaccaatgttgacggcgtttcaatcatttcggcaatatcgtatgcaaaaaatatagaaaaaactgttcgggaaatgagtgaacaatag

SEQ ID NO: 170 - DNA, 804 bp, Streptococcus pneumoniae
gtgaaaaggaaggatttcaatatgacaagtttaaaattattaaaagaaaaagcaccattggtcatttgtataaccaatgatgtagtaaaaaatttcacagcaaatggattagtagcactgggcgtctcaccagccatgagtgagtttccagcagatttagaggatttgttaaagtatgctggtggtttattaataaacataggaacattgacagatgaaaattggaaattataccaagctgctctgaaaattgcggagaaatataatgtcccagcagttttagatcctgtagcctgtggagcaggagaatatagaaaaaaagtagcagatgatctaatcaacaattataaactagcagcgattagaggaaatgctggcgagattgcctctttagtaggaatagatgtggcatctaaaggagtagatagtgcgggcgtagataatattgacgaaattgctctagcagcaaatgagaagttcaatattccaatagtagtaacaggtgaagtggatgccattgctgttaatggagaagtggtaacgattcataatggtagtgctatgatgccgaaagtcattgggacaggatgcttattaggagctgtagtagcaagctttatcggactagaaaaaggtcaagaattgaaatcattagaaacagcaatgttagtttacaatatcgctggagaaatggcagaaaaacgtccaaatggacatcttcctgggacatttaaagttgaatttataaatgccttatacgagattacagatgaagatgtaaaggaattcaaaagagtgaagtaa

SEQ ID NO: 171 - DNA, 411 bp, Streptococcus pneumoniae
ttgttgattagatcatctgctactttttttctatattctcctgctccacaggctacaggatctaaaactgctgggacattatatttctccgcaattttcagagcagcttggtataatttccaattttcatctgtcaatgttcctatgtttattaataaaccaccagcatactttaacaaatcctctaaatctgctggaaactcactcatggctggtgagacgcccagtgctactaatccatttgctgtgaaattttttactacatcattggttatacaaatgaccaatggtgctttttcttttaataattttaaacttgtcatattgaaatccttccttttcactttatacgatctactgatttcgatttatctctatctttcgttaagaaatttttttcatttacgttga

SEQ ID NO: 172 - DNA, 246 bp, Streptococcus pneumoniae
ttgaatgatttatactcaatgaaaatcaaagagcaaactaggaagctaaccgcagattgctcaaaacactgctttgaacctgtagataagactgacgaagtcagctcaaaacactgttttgaggttgtggatagaactgacgaagtcagtaaccatacctacggcaaggtgaaactgacgtggtttgaagagattttcgaagagtattacctcatcaaatttgtaaatatcatgagccttctctag

SEQ ID NO: 173 - DNA, 225 bp, Streptococcus pneumoniae
gtatggttactgacttcgtcagttctatccacaacctcaaaacagtgttttgagctgacttcgtcagtcttatctacaggttcaaagcagtgttttgagcaatctgcggttagcttcctagtttgctctttgattttcattgagtataaatcattcaacgtaaatgaaaaaaatttcttaacgaaagatagagataaatcgaaatcagtagatcgtataaagtga

SEQ ID NO: 174 - DNA, 669 bp, Streptococcus pneumoniae
atggaaacacaagactatgcatttcagccaggtttgactgttggagaattattaaaaagcagtcagaaggattggcaggctgcaatcaatcatcgttttgttaaggaactttttgcggggacaattgagaataaggtcttaaaggactatctgattcaagattatcacttctttgatgccttcttatccatgctgggtgcctgcgtagctcacgcagataaacttgaatccaagcttcgttttgccaagcaactaggctttcttgaagcagatgaagatggttatttccaaaaggcttttaaagagttaaaagtagcagagaatgactatctagaagtgactttgcaccctgtaacaaaagcctttcaggatctaatgtattcggcggtggcttcatcagactatgcccatcttttggtcatgctggtcattgcagaaggtctctatttagactggggttctaaagatttggctttacctgaagtctatattcattcggaatggatcaatctccacagaggtcctttctttgcagagtgggttcaatttctggttgacgaactcaatcgtgtcggtaaaaatcgagaagatttgacagaacttcagcaacgctggaatcaagcagtcgctttagaattagctttttttgatattggttacgatgtctag

SEQ ID NO: 175 - DNA, 1137 bp, Streptococcus pneumoniae
atgtcatacaaaacaagcaatgcagaaggtcatgtagacttcatcaatacctatgatttggagccaatggcgcaacaagttattcctaaagcagcatttggctatatcgctagtggggcggaagatactttcactttaagagagaatatccgcgcctttaaccacaaactcatcgttcctcatacactttgcgatgttgaaaatccaagtacagagattgaatttgcaggtgaaaaactatcttcaccaatcattatggcgcctgttgcggctcataaattggcaaatgaacagggggaagtggcgactgcgcgtggtgtgcatgagtttggttctctttatacaaccagctcttactctactgttgaccttccagagatttctgaagcccttcaagggacaccccattggttccaattttactttagtaaggatgacggtatcaaccgccacatcatggaccgtgtgaaggctgaaggttataaagcgattgtcttgacggcagatgctactgtaggggggaatcgtgaagtggataagcgtaatggttttgtcttcccagttggcatgccgattgttgaagaatacctgccagaaggtgctggtaaatcaatggactttgtttacaaatcagctaaacaacgcttgtctccacgcgatgtagaatttatcgctgaatactctggtcttcctgtgtatgtcaagggaccacaatgccgtgaggacgttgaacgttcacttgctgcaggagcttctggtatctgggtaaccaaccacggtggtcgtcaaatcgacggtggaccagctgcctttgactcgcttcaagaagtggcagaagcagttgatagacgtgtgccgattgtctttgactctggtgttcgtcgtggtcaacacgtctttaaagccttggcttcaggagcagacttggtagctattggtcgccctgttatttatggcttggctctcggtggtagtgtcggtgtgcgtcaagtctttgaacacttgaatgcggaattgaagacagttatgcaattgtctggagctcagaccattgaagatgtcaaacactttaagctccgtcacaatccatacaacccaaccttcccagttgaccctcgtgacttaaaattgtattga

SEQ ID NO: 176 - DNA, 1491 bp, Streptococcus pneumoniae
atgtctacagaacatatggaagaactaaatgaccagcagattgttcgccgtgaaaaaatggctgcgctccgcgaacaaggaatcgatcctttcggaaaacgttttgaacgtactgcaaattcacaagaattaaaagataaatatgccaacctcgataaagaacaattacacgataaaaacgaaacagctactatcgcaggacgcttggtaaccaaacgtggtaaaggaaaagttggttttgcccaccttcaagaccgcgaaggccagattcagatctacgttcgtaaggatgctgtcggtgaagaaaactacgaaatcttcaaaaaagcagaccttggtgacttccttggtgtcgaaggtgaagtgatgcgtacggatatgggagaactctctatcaaggcaacccacatcacacacttgtctaaggctcttcgtcctcttcctgagaaattccatggtttgacagatgttgaaacaatttaccgtaaacgttaccttgacttgatttctaatcgtgaaagctttgaacgctttgtcactcgttcaaaaatcatctctgaaatccgtcgttaccttgaccaaaaaggattccttgaagtggaaacacctgttcttcataatgaagccggtggtgctgctgcccgtccatttatcacccaccacaatgcccaaaacattgacatggtgcttcgtatcgcgactgagcttcacttaaaacgccttatcgtgggtggtatggaacgtgtctatgaaattggccgtatcttccgtaacgaaggaatggacgctactcataaccctgagtttacttctatcgaagtttaccaagcttatgcagacttccaagacatcatggacttgacggaaggcattatccaacacgctgctaaatcagttaagggcgatggcccagtcaactaccaaggtactgaaatcaagattaacgaaccatttaagcgtgttcatatggtggatgctatcagagaaattactggtgtcgatttctggcaagacatgactttagaagaagctaaagctatcgctgctgagaagaaagttccagttgagaaacactacactgaggttggtcacatcatcaatgccttctttgaagagtttgttgaagaaactttaatccaaccaacctttgtctatggacatccagtagctgtatctccactcgctaagaaaaatcctgaagaccaacgctttactgaccgtttcgagctctttatcatgactaaggagtacggtaatgcctttactgaactcaacgacccaatcgaccaacttagccgttttgaagcccaagctaaagccaaagaacttggtgatgatgaagcgacaggaatcgactatgactacattgaagctcttgaatacggtatgccaccaacaggtggtttgggaatcggtatcgaccgtctctgcatgctcctcactgatacaacaactatccgtgatgtattgctcttcccaacaatgaaataa

SEQ ID NO: 177 - DNA, 681 bp, Streptococcus pneumoniae
ttggattggtccattgttgaacaatatctaccactatatcaaaaggcattctttctgaccttgcatattgcagtttggggaattttgggatcctttctgctcggtttaatcgttagtatcatccgacattatcgaatccctgttttggcgcaagtagcgacagcctacattgaattgtcacgtaatacgccccttttgattcaactcttctttctctacttcggtcttccccgaatcgggattgtcctatcttcagaagtctgtgcaacgcttggccttgtctttttaggaggctcctatatggcagaatctttccgaagtgggctggaagccatcagtcaaacccagcaggagattggcctcgctattggtctgacacctctacaggtctttcgctatgtggttcttccgcaagcaacagcggtggcactcccctcctttagtgccaatgtcattttccttatcaaggaaacctctgttttctcagcagtggctttggccgacctcatgtacgtcgccaaggatttgattggtctctactatgagacagacattgcgctagctatgttggtagttgcttatctgatcatgctgctacccatctcactggtctttagctggatagaaaggaggacccgccatgcaggattcgggaatccaagtactctttcaaggaaataa

SEQ ID NO: 178 - DNA, 381 bp, Streptococcus pneumoniae
atgcaggattcgggaatccaagtactctttcaaggaaataatctcctgagaatcttacaggggttgggcgttacgattgggatatccatcctgtctgtcctcttatccatgatgttcggaacagtcatgggaatcatcatgacctcccattctagaatcatacgatttttaacacgattgtatctggaatttatccgtatcatgccccagctggtgctactcttcatcgtttactttggcttggctcgaaactttaatatcaatatctcaggtgagacttcagctattatcatttttaccctctggggaacagctgaaatgggagacttggtacgtggagctatcacttctctccctaaacatcagtttgaaagtggatag

SEQ ID NO: 179 - DNA, 288 bp, Streptococcus pneumoniae
ttgactaatgttcaactttactaccacatcatcatcccacaagtcttaagaagactgctaccgcaggctatcaatcttgtcactcggatgattaaaaccacttcattagttgttttgattggggttgtggaagtgaccaaagttggacaacaaatcatcgatagcaatcgcctgaccatcccaactgcttcattttggatttatggaaccattctagtcttatatttcgcagtttgctaccctatttccaaactatccactcacttagaaaaacattggagaaactaa

SEQ ID NO: 180 - DNA, 213 bp, Streptococcus pneumoniae
atgtctgaaactatcttagaaatcaaggaactaaaaaaatccttcggagacaatcccatcctccaaggactttctctagaaatcaaaaaagggggaagttgttgtcatcctaggggcatctggttgtgggaaaagtaccctccttcgttgcctcaacggcttagaaagtattcaaggtggagatattcttctggatggtcagtctatcgttga

SEQ ID NO: 181 - DNA, 507 bp, Streptococcus pneumoniae
atggtctttcaaagttatgaactctttccccatctggatgtcttacaaaacctcatcctaggccctatcaaagctcaaggaagggacaagaaagaagtaacggaagaagctttgcaattactagagcgtgtcggtttgctggataaacaacatagctttgcccgtcaattatctggtggacagaagcaacgtgttgcaattgtccgtgccctcctaatgcatccagaaatcatcctttttgacgaggtgactgcttcgctggatccagaaatggtgcgtgaggtgctggaacttatcaatgatttgacccaagaaggccgtaccatgattttagtaacccacgaaatgcagtttgcccaagccattactgaccggattatcttcctcgaccaagggaaaatcgctgaagaaggaacagctcaagccttctttaccaatccgcaaaccaaacgagcccaggaatttttaaacgtctttgactttagccaattcggctcatatctataa

SEQ ID NO: 182 - DNA, 201 bp, Streptococcus pneumoniae
atggcttgggcaaactgcatttcgtgggttactaaaatcatggtacggccttcttgggtcaaatcattgataagttccagcacctcacgcaccatttctggatccagcgaagcagtcacctcgtcaaaaaggatgatttctggatgcattaggagggcacggacaattgcaacacgttgcttctgtccaccagataattga

SEQ ID NO: 183 - DNA, 243 bp, Streptococcus pneumoniae
atgaaactattcaaaccactcttaactgttttagcacttgcctttgcccttatctttatcactgcttgtagctcaggtggaaacgctggttcatcctctggaaaaacaactgccaaagctcgcactatcgatgaaatcaaaaaaagcggtgaactgcgaatcgccgtgtttggagataaaaaaccgtttggctacgttgacaatgatggttcttaccaaggctacgctacgatattgaactag

SEQ ID NO: 184 - DNA, 555 bp, Streptococcus pneumoniae
ttgatttcaaacaaggtagatattactcttgctaactttacagtaactgacgaacgtaagaaacaagttgattttgcccttccatatatgaaagtttctctgggtgtcgtatcacctaagactggtctcattacagacgtcaaacaacttgaaggtaaaaccttaattgtcacaaaaggaacgactgctgagacttattttgaaaagaatcatccagaaatcaaactccaaaaatacgaccaatacagtgactcttaccaagctcttcttgacggacgtggagatgccttttcaactgacaatacggaagttctagcttgggcgcttgaaaataaaggatttgaagtaggaattacttccctcggtgatcccgataccattgcggcagcagttcaaaaaggcaaccaagaattgctagacttcatcaataaagatattgaaaaattaggcaaggaaaacttcttccacaaggcctatgaaaaaacacttcacccaacctacggtgacgctgctaaagcagatgacctggttgttgaaggtggaaaagttgattag

SEQ ID NO: 185 - DNA, 648 bp, Streptococcus pneumoniae
atgaatgaaataattacattaaaaaatattgagttgaaattaaaaaaaacatgtgtttttcaaaaccttaattttagttgtaaacagggggaaattataggaattactggtgcgaatggctcagggaaaagtgtattgtttaaattaatagctggtttatatagtccgtcttatggagaagtgttaatcaatggggaaaatattgttcctgagagaaaaattccagctaatttgggagctttgattgaagaacctggttttataaattattatagtggctttaagaatttacaatatttggcaagcatacgaggagtagttggtaatcaggaaatcaatgatacactgaaaatagttggtctatatgagcaaaaagaccagaaagttaaaacttattcgctaggtatgaggaaaaagctagggattgctcaagcaattatggagaatccctctattcttttactagatgaacctatgaatgccttggataaatcaagtgtagaaaatatgagaacattgtttagaaagctctctagtgaaaaagggacaacaattttgattgctagtcatagtgaagaggatattcgtatcttatgtgataaagtatatgcaatagaagataaagtatgtacactgtgttcagattga

SEQ ID NO: 186 - DNA, 705 bp, Streptococcus pneumoniae
ttgaaaatgggaaagttaagtagtcacatatggaggttgaatcagataatctataccaagtacttttggggttatgttcttttttggatattgatttgtttaggattatggtattggttagaaggaaatgatagacttgttatagaaattttaaaagggcctaatctgagtcaaaactcttttttattcttatctatatggttgcttcattggtttattattcatacattttttctagcagttgtatatcgtagaagagcatccgatttctttctggaagtgattcgattttcttctattaagctctggattaggtatcagatttggacctgttttctttatggactcattttaatcatggtaaaagttctagtgattcaatttatgttacagttaccaaactgggatataggagttttgtttatagttgattttttgaatgcttgtgtgttagtcttgttttgctttatgttatacgcactaggagcgaatgtacaaatgaactttgcttgcgttagtttctttttactcatgattgtgtttggtggtctatttgtaggaaatcgaactaattatctattttatattttaaatcgagggaatggagatataggacgagatttatttcttcagttgctatttttagtctttctttttaaaagcattttctatttcactcgtcaaaagaggaggtttatagaatga

SEQ ID NO: 187 - DNA, 204 bp, Streptococcus pneumoniae
caagtctatcatttccttctaaccaataccataatcctaaacaaatcaatatccaaaaaagaacataaccccaaaagtacttggtatagattatctgattcaacctccatatgtgactacttaactttcccattttcaacttttacactctcctccagtttctatgaacaggaaaatacattccatgggatttatgatagatag

SEQ ID NO: 188 - DNA, 807 bp, Streptococcus pneumoniae
ttgtttggttgtttatggtacattttttctacattcagaggactatgtataatgaaacaatttgttcaattttataaaaaagatttcttagcagtattggtttattttatattactgctatcctgtgttttatctagtacagtatatttattgcgctgtcgccaatattcaatccatccaaatgtattagaatggatcttagttttacttcaagatatgacgactggagtatattgctttccgttcacatatatattgttctttttttatttgatgaataactattttaataggttggagtgtcgcattcgtctgaaatcaattaagcactttaccagttttagtttcaaattagcagctcttagtacggggatttggacggcgattttatttttattgatttttctaattgcatttagtaatggttttagcttctctttggagataaaggaggttgattttttaagagaattttatggcataagtattgcaaacaatgctagtttctttataggattttttttctcttatatagcatactatttctttttatccttacttactattagcagtttttcttggtttaaaaaatcaaacatgagcttagtatttctgtttacttttttattcgtagaatccttattctggatttatcagttgaacaatgggataattggattattgccaatttttcagtatatggtaaattccaatccgtatgcattgatttattggcctggcattactatctatcataaatcccatggaatgtattttcctgttcatagaaactggaggagagtgtaa

SEQ ID NO: 189 - DNA, 765 bp, Streptococcus pneumoniae
atggaatttttcatttgtaatcttgtacgagtcgttcaatcacctcggttttatatgtctttatttttgacccttctttgcatgagtttaggaaattttcttgctttcaatggtatttataaaattgaaggtttatcgattttttttgccgcttcttctattcgaggattttcaccgattagcctagtagctgcacttatctgtacactgccctattctagtcagataatagaggatgctgagagtcattttctaacagcacaattgtgccgaatttctaaaaagaggtatctagctattgtaggtagtactgcaattatttcttcttttctagtcttttttctcccctatttattattattaggaattaatcttttagtgactccttatcaggaaatttatattggagattatagtggtgccttaaaagaattatttgattctaatcagtttctctatagtcttgtgacgactctctggtatggagtttggggcgctgtgttctctatttttggactagctagtgctttgctagtgaagaaaaaattaggagctattttcatcccagttgcctatatgatggttggtggtattttatgggctattttagggctatcttacttagaacctgtgacaacgctagctttgggatatcagaaagatatcagtctttccttagttagtgggcatcttgcttttattttatttgttagttgtttggttgtttatggtacattttttctacattcagaggactatgtataa

SEQ ID NO: 190 - DNA, 351 bp, Streptococcus pneumoniae
ttgtttctccctacagttttagctagacagattggaaattatgatttaacgttgccgcgttggggttcggatacaactagtgagcttgagaaagaaaacgcctctgctggaattaataatagtgacagcactggtggcggtaaaaggttaaatacctctattcgtagcgcctatagtgggtcagatattaccccggtatattcattggggtctggctctaggattgtcatgtactataatggaggtggtgacaattatattggttctggtactagattagctatggcgccacaatttggaaatcatgtaagaattcatacttcaggttcttggagtccagattcttattaa

SEQ ID NO: 191 - DNA, 633 bp, Streptococcus pneumoniae
atgacacttgctaaagatatcgctagccacctcttgaaaatccaagccgtttacctcaaaccagaggaacccttcacttgggcatctggtatcaagtcaccgatttacactgataatcgtgtgacactagcctatccagaaactcgtaccctaattgaaaatggttttgtggaagctatcaaagaagcctttcctgaagtagaagtgattgcaggaactgcaacagcagggattccacacggagccattattgctgataagatggacttgccttttgcctacatccgtagcaaaccaaaagaccacggagctggtaatcaaatcgaaggtcgcgtagctcaaggtcaaaaaatggtagtggttgaagaccttatttcaacgggtggttcagttcttgaagctgtagcagcagccaagcgagaaggagcagatgtacttggagttgtagcgattttcagctaccaattgccaaaagcagataagaactttgcagatgctggtgttaaacttgtgacgctttcaaactatagcgagcttatccatctagcccaagaagaaggttacatcacgccagagggccttgatcttctaaaacgctttaaagaagaccaagaaaattggcaagaaggttag

SEQ ID NO: 192 - DNA, 702 bp, Streptococcus pneumoniae
atgcgagaacatcgtccaatcattgctcttgattttcctagttttgaggcggtcaaggaatttttagctctttttccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaaggtcttgtctcagcttggtgtcgatatgactaatgtccatgcggctggtggtgtagagatgatgaaggcggcgcgtgaaggtcttgggagtcaagctaaattgatcgctgtaacgcagctgacatcaacgtcagaagcccagatgcaggagtttcaaaatatccaaaccagtctgcaagagtctgtgatttactatgccaagaagacagctgaagctggcttggatggtgttgtttgctcggctcaggaagtacaagtcatcaagcaggctaccaatccagattttatctgtctgacaccagggattcgtccagctggtgctgcagttggagatcaaaaacgagtcatgacacctgctgatgcctatcaaatcggcagtgactatatcgtagtgggacgtcccattacccaagctgaggatcctgttgcagcttatcataccatcaaggatgaatggacacaggactggaattaa

SEQ ID NO: 193 - DNA, 201 bp, Streptococcus pneumoniae
ctgcctctctggactgctttaaaggttttttactattctattatttctactagcacttgtcaagtaaaaacatggtcactaaagaactataagagaaaaagtaaacctagcgacgcgatgagcgctgggtcgtttggtttcgattgctctcttcctcttgttttttctgttcttcttcttgttttttctcagcttccttag

SEQ ID NO: 194 - DNA, 1200 bp, Streptococcus pneumoniae
atgtcaaaagataagaaaaatgaggacaaagaaatcctcgaagaattgaaagagttatcagaatggcagaaacgaaaccaagaatatctaaaaaagaaggctgaagaagaagcggctctagctgaggagaaggaaaaggaaagacaagctcggatgggagaagaatctgagaagtcagaggacaaacaggaccaggagagtgaaacagaccaggaagattcagaatcagctaaggaagagtctgaagaaaaagtagcatcctcagaggctgacaaagagaaagaagagaaagaagaatcagagtctaaagagaaggaggaacaggataaaaagcttgctaaaaaggctacaaaggaaaaaccagccaaagcaaagattcctggtatccatatcttgcgagccttcacgattttatttccaagtctgcttttattgattgtctctgcctacttgctcagtccttatgcgaccatgaaagatattcgtgttgagggaacggtgcaaactacagctgatgatattcgacaggcttcaggcattcaggattcggattatacgattaaccttctgctagacaaggcaaaatatgaaaagcagattaagtctaactattgggttgaatcagctcaacttgtctatcaatttccaactaagatcactattaaggtcaaggaatatgatattgtggcctactatatttctggtgaaaatcattatcctattctttccagtggtcagcttgagactagttctgtgagtctgaacagtttaccagaaacttatttatcagttctctttaatgatagtgaacaaatcaaggtttttgtctcagaacttgctcaaattagcccagaactcaaggcgactatccaaaaggtggaattagctccaagcaaggtgacatccgatttaattcgattgaccatgaatgattcggacgaagtcttggttcctctatctgaaatgagtaagaaactgccatattacagtaagattaagcctcaattgtcagaaccgagtgtggtcgacatggaagctggaatctacagctacactgtggcggataaattaattatggaagctgaggaaaaagccaaacaagaggctaaggaagctgagaaaaaacaagaagaagaacagaaaaaacaagaggaagagagcaatcgaaaccaaacgacccagcgctcatcgcgtcgctag

SEQ ID NO: 195 - DNA, 444 bp, Streptococcus pneumoniae
gtgaaggctcgcaagatatggataccaggaatctttgctttggctggtttttcctttgtagcctttttagcaagctttttatcctgttcctccttctctttagactctgattcttctttctcttctttctctttgtcagcctctgaggatgctactttttcttcagactcttccttagctgattctgaatcttcctggtctgtttcactctcctggtcctgtttgtcctctgacttctcagattcttctcccatccgagcttgtctttccttttccttctcctcagctagagccgcttcttcttcagccttcttttttagatattcttggtttcgtttctgccattctgataactctttcaattcttcgaggatttctttgtcctcatttttcttatcttttgacatttactttccttatgataaatcttttttcaacaattga

SEQ ID NO: 196 - DNA, 1059 bp, Streptococcus pneumoniae
atgaaaaaaattgtctttacaggtggggggacggttggacacgttaccctcaatcttttgttaatgcctaagttcatcgaagatggttgggaagtccactatatcggggacaagcgtggtatcgaacaccaagaaatccttaagtcaggtttggatgtcaccttccactccattgcgactgggaaattgcgtcgctatttctcttggcaaaatatgctggacgtcttcaaagttggctggggaatcgtccaatcgctctttatcatgttgcgacttcgtccacagacccttttttcaaaggggggctttgtctcagtaccgcctgttatcgctgcgcgtgtgtcaggagtgcctgtctttattcacgaatctgacctgtctatgggcttggccaataaaatcgcctataaatttgcgactaagatgtattcaacctttgagcaagcttcgagtttgtctaaggttgagcatgtgggagcagtgaccaaggtttcagatcaaaaaaatccagaaccagatgaattggtggatattcaaagccactttaatcataaattgccgactgtattgtttgttggcggttctgcaggtgctcgtgtctttaaccaattggtgacagaccataagaaagaactaacagagcgctacaatattatcaatctaactggagattctagcctgaatgagttgagccaaaatctttttcgtgttgactatgtgaccgatctctatcaacccttgatggaattggctgatattgttgtgacacgtggtggtgccaatacgatttttgagctcttggcgatagcaaaattgcatgtcattgtgccacttggtcgtgaagctagtcgtggtgaccagattgaaaatgcagcttactttgttaagaaaggctatgcagaagaccttcaagaaagcgatttgaccttggatagtttggaagagaagctttctcacttactaagtcacaaggaagattaccaagctaagatgaaagcttctaaggaattgaaatctctagcagatttttatcaattgttgaaaaaagatttatcataa

SEQ ID NO: 197 - DNA, 1353 bp, Streptococcus pneumoniae
atgaaagtaatagatcaatttaaaaataagaaagtccttgttttaggtttggccaagtctggtgaatctgcagctcgtttgttggacaagctaggtgccattgtgacagtaaatgatgggaaacctttcgaggacaatccagctgcccaaagtttgctggaagaagggatcaaggtcattacaggtggccatcctttggaactcttggatgaagagtttgcccttatggtgaaaaatccaggtatcccctacaacaatcccatgattgaaaaggctttggccaagggaattccagtcttgactgaggtggaattggcttatttgatttcagaagcaccgattattggtatcacaggatcgaacggtaagacaaccacaacgactatgattggggaagttttgactgctgctgggcaacatggtcttttatcagggaatatcggctatccagctagtcaagtggcccaaactgcgtcggacaaggacacgcttgttatggaactttcttctttccaactcatgggtgttcaagaatttcatccagagattgcggttattaccaacctcatgccaactcatatcgactaccatgggtcattttcggaatatgtagcagccaagtggaatatccagaacaagatgacagcagctgatttccttgtcttgaactttaatcaagacttggcaaaagacttgacttccaagacagaagccactgttgtaccattttcaacacttgaaaaggttgatggagcttatctggaagatggtcaactctacttccgtggtgaagtagtcatggcagcgaatgaaatcggtgttccaggtagccacaatgtggaaaatgcccttgcgactattgctgtagccaagcttcgtggtgtggacaatcaaaccatcaaggaaactctttcagccttcggtggtgtcaaacaccgtctccagtttgtggatgacatcaagggtgttaaattctataacgacagtaaatcaactaatatcttggctactcaaaaagccttgtcaggatttgacaacagcaaggtcgtcttgattgcaggtggtttggaccgtggcaatgagtttgacgaattggtgccagacattcctggactcaagaagatggtcatcctgggtcaatctgcagaacgtgtcaaacgggcagcagacaaggctggtgtcgcttatgtggaggcgacagatattgcagatgcgacccgcaaggcctatgagattgcgactcaaggagatgtggttcttcttagtcctgccaatgccagctgggatatgtatgctaactttgaagtacgtggcgacctctttatcgacacagtagcggagttaaaagaataa

SEQ ID NO: 198 - DNA, 642 bp, Streptococcus pneumoniae
atgattgaactaaagaatatatctaaaaaatttggaagccgtcaactattttcagatacaaatcttcattttgaaggtgggaaaatttatgccttaatcggtacaagtggctgtggtaagacaacattcttgaatatgattggacgattagagccatatgacaaaggacaaatcatctatgatggtacttctcttaaggacatcaagccttctgttttctttagagattacttgggatatttatttcaagattttggcttaattgaaaaccaaaccgtcaaagagaatctcaatctgggtttagttggtaaaaagttgaaggaaaaagagaaaatctctttgatgaaacaagctctaaaccgtgtaaacctctcttatttggatttgaagcaacctatatttgagttatcaggaggagaagcacaacgtgttgcattagcgaagataattttaaaggatccacctttgattctcgcagatgaaccaaccgcttcactagaccccaaaaactctgaggaattactttccatcctagaatctctaaaaaatccgaatcggaccattattattgcgacccacaatcctctgatttgggagcaagtggatcaggtcattcgagttaccgatttatcacatagatga

SEQ ID NO: 199 - DNA, 2022 bp, Streptococcus pneumoniae
atgaagaaactattcatattattatcaactttttttctcagcttcttccttgcttggattattgtcttacgtgcgccacaatatttatatgcaagctatgattccgtttctttacttcgtgtcaaaaaagatactcaggaaccgacgcgtgaggtatttgaacaggaattggagaattttgcaaactcagaacagagtttaatagctagaagaattgtagagccgagtaaggatgggacgactcactttacttatgcaacttatggtcagggaactttaccaaaagaattccaagaagctagccaagaaagtcgtgaacgtagtgatccgctaaatagttatctccttttgtcaggctccttgacgaaagaaaagcttgccgataaattaggagatttgggttataaagcaagtgctgaccgaaagataccgccctattttcttgcttttcgaatattactaaatccccttattttaattagtttagcaatatttggcttatctttctttgctttagtgattatcactcggattaaggaaatgagagcagcaggtataaaactcttttctggtcagactctcttatccatcatggggcattctttatctactgatatcaaatggctccttctatcagccctcctttccttcctaggtgggggagtcgttctttttagtcaaggtttgttttatcctatcttgttagccacctatggttttgggattagtttctatctgttgtttttattggcgatttcaattttactaatgcttctttatctaatgagtttgagttacaaagcattagttcccgttattaaggggagattaccccttaaacgcctgatgattttaaccctattgtgtcagttggttgctgtctttacagtaggctacgctgttaagacaggtttgatgtcttaccaacgattgaaagaacttgaaatttcaaaacaagcatggcaggatagagcagactattatcaaatttcttttggcttaggtgatagaggaaaagatacagaaaatcagagcaagtggtatgcctttgccaaggaagcaatcgaagaagaacaagctctttatgtaaaggataatctgctccattttgccaatccacaaggaaaaaatgaacagggagagacactggatacctatagtccagatgctaatacgctctatgttagtcccagttatttggacaaggaaaaggtcgtggtagatgctgagaccaaacagaagttagcccatctccaaaaaggtgagtttatcctcttgctcccagaacatttgcgctctcgagaagcagaacttaagaaagtttttgaagaaagattgagttattatggaaaatctggtgaggaggcaagtgctcctttggattatgagatgaaagcgcacgttagttatctttcaatgggagaaaagcggtttgtttataataacggtgagaatcccgtatctactcagtatttgactgatccgattttagttgtattcacgccgacttctacaggtgatagttttatatccttatctagttggtctatcaatgctggaaaacaactctttatcaaaggatatgagagtgggctagaactcttgaagaaagctggaatttatgagcaagtatcctatcttaaagaaggaagaagtgtttatctaactcgttataatgaagttcaaactgaaacagcaactttaatcttaggagctattgtggggatagctagttccttgttactattttattctgtcaatcttctatatttcgagcaattccgccgagatatcttgattaaacgaatttcaggtttacgattttttgaaacacatgctcagtatatggttagccaatttgccagttttgtatttggtgctagtctctttattttaagcagtcgagacttggtgattggcttgctcactttattagtctttctagctagtgcagttctgacgctttaccgtcaagcgcagaaagaatctcgtgtttctatgacaattatgaaaggaaaatag

SEQ ID NO: 200 - DNA, 405 bp, Streptococcus pneumoniae
atgttattcttatcacataagaaagcggtttcaataaaagagagaggaggacttattttgttgcattgttgctcaaggtgtgatttttttgaaagaaaaaataaaatgaaaacgaaaaaacatagattacttgctctagctcttatttcaagttttacattattgggagctgcatcagctgctgtacaatatccagatggaggagtatggacgtatggagaaggttcaggaggtggttgggctttttcaaattactatcatggtaaaaaatatcattattcttctcttgtaagtagatggaatagtcattcagataaaggagaagctcctgctggaaaaacctcctatgcatggatttggactaaatggggagaacaagtagcattttactgtgattatgactaa

SEQ ID NO: 201 - DNA, 219 bp, Streptococcus pneumoniae
atgcaaccagtactaaccaaatataaaatagatgccattaacgaattttattcaagtttttcccattcatactatccaagcaaaagagatgatgttatagtacaaaacaattcaaactattgtaaaattcctagcaaaaaagagagccaaaactctcttttttatcttcttttactttttttgactggcatgagtgtaatgtctctaacactaaagtaa

SEQ ID NO: 202 - DNA, 255 bp, Streptococcus pneumoniae
atggtctatttagtcctaggaattttactgctcctactctatgtatttgcgacaccagaaagcattaaagggacagtcaatatcgtcgctatggtatgtattttagtggcactcttgattttattggttctatcttttctgaaaatttttcaattaccaacagaaatattcctagcaatagccatgttgatcctagcttactttagtgttagagacattacactcatgccagtcaaaaaaagtaaaagaagataa

SEQ ID NO: 203 - DNA, 1863 bp, Streptococcus pneumoniae
ttgaatattatagaggaaatcatgacaaaattaagagaagatatccgtaacattgcgattatcgcccacgttgaccacggtaaaacaaccctggttgacgaattattgaaacaatcagaaacgcttgatgcacgtactgaattggcagagcgtgctatggactcaaacgatatcgaaaaagagcgtgggattaccatccttgctaaaaatactgccgttgcttacaacggaactcgtatcaacattatggacacaccaggacacgcggactttggtggagaagttgagcgtatcatgaaaatggttgacggtgttgtcttggtcgtagatgcctatgaaggaaccatgccacaaactcgtttcgtattgaaaaaagccttggaacaagaccttgtcccaatcgtggttgttaacaaaatcgataagccatcagctcgtccagcagaagtagtggatgaagtcttggaacttttcatcgagcttggtgcagatgacgaccagcttgatttcccagtggtttatgcttcagcgatcaacggaacttcttcattgtcagatgatccagctgaccaagaagcgactatggcaccaatctttgacacgattatcgaccatatcccagctccagtagataactcagatgagcctttgcagttccaagtgtcgcttttggactacaatgacttcgttggacgtatcggtatcggtcgtgtcttccgtggtacagttaaggttggggaccaagttaccctttctaaacttgacggtacaactaaaaacttccgtgttacaaaactcttcggtttctttggtttggaacgtcgtgaaatccaagaagccaaagcgggtgacttgattgccgtttcaggtatggaagacatctttgtcggtgaaaccatcactccgacagatgcagtagaagctcttccaatcctacacatcgatgagccaactcttcaaatgactttcttggtcaacaactcaccatttgctggtaaagaaggtaaatgggtaacttctcgtaaggtggaagaacgcttgcaggcagaattgcaaacagacgtttcccttcgtgttgacccaactgattcaccagataaatggactgtttcaggacgtggagaattgcacttgtcaatccttatcgaaacaatgcgtcgtgagggctatgaacttcaagtatctcgtccagaagttatcgtaaaagaaatcgacggtgttaaatgtgaaccatttgaacgtgtacaaatcgacactccagaagaataccaagggtctgttatccaaagcctttctgaacgtaaaggtgaaatgttggatatgatttcaactggtaatggtcaaactcgtttggtcttccttgttccagcgcgtggtttgattggatactcaactgagttcttgtcaatgactcgtggttacggtatcatgaaccataccttcgaccagtacttgccattgattccaggggaaattggtggacgtcaccgtggtgcccttgtttctatcgatgctggtaaggctacaacttactcaatcatgtctatcgaagaacgtggtacgatctttgtcaacccaggtactgaggtttatgaaggaatgatcatcggcgaaaactctcgtgaaaatgacttgacagttaacatcacgaaggcaaaacaaatgaccaacgttcgttcagctactaaggaccaaacagctgttatcaagacgcctcgtatcttgacacttgaagagtctcttgagttcttgaacgacgatgagtacatggaagtaacgcctgagtctatccgtttgcgtaaacaaatccttaacaaagcagagcgtgagaaagctaacaagaagaaaaaatcagctgaataa

SEQ ID NO: 204 - DNA, 726 bp, Streptococcus pneumoniae
atgcgtttagataatttattagcccaagaaaaaatcagccgaaaggccatgaagcaagcactcctcagaggggaaattctagtcgatggttgcccagcccgctccctagctcaaaatatcgatacaggactacaagaactcctttttcaggatcgaatcattcaaggctatgaacacacctatcttatgcttcataaacctgctggtgtcgttacagccaacaaagacaaggaacttccgaccgtcatggacctgcttccatctgacatccagtctgacaagctctatgccgtcggccgactggaccgagatacaacaggactccttctcttgaccgataacggtcccttgggcttccaactcctccatccccaatatcatgtcgataagacttaccaagtccaggttaatggacttctaacacctgaccatatccaaacctttcaaaaaggaattgtctttttagatggcactatctgtaaacctgcaagactagagattctatcagcaagtccttccttcagtcaagcctctatcaccatttcagaaggaaaatttcatcaaatcaagaaaatgttcctctcggttggtgttaaggtgactagcctcaagagaatccaatttggggacttcacattgaacccagatttagcagaaagtaactaccgccctttgaaccaaaaagagttacaaatcattaaaaactatttagagatgagtcgataa

SEQ ID NO: 205 - DNA, 198 bp, Streptococcus pneumoniae
gtgggtatcttgtcgattattcttggtttgttatttccaattgtaggcctgattttgggtatcataggattggtcttggctatttcataccaaaaagagtcacaattagactataaaatagaaaagattcttaatatcttaggaattgtgatttctgtagttaactggattgtagcaatcgccttaatttttcggtaa

SEQ ID NO: 206 - DNA, 381 bp, Streptococcus pneumoniae
atggttacttggattttgtgggcacttatactagcaatgttggcgtggatgggctttaactatcttcgtattcgccgtgcggctaaaattgtggacaatgaggagtttgaagccttgattcgtacgggtcaattgattgatttgcgcgacccagcagaattccacagaaaacatatccttggtgcacgcaatattccttcaagtcagttgaaaactagtcttgcagcccttcgtaaagataaacctgtccttctctacgaaaaccaacgtgcgcaacgagttacaaatgcagctctttacttgaaaaaacaaggtttttctgagatttatatcctttcttatggcttggattcttggaaagggaaagtgaagactagctaa

SEQ ID NO: 207 - DNA, 222 bp, Streptococcus pneumoniae
atgaaaacattctatgatgtgcagcaattcctcaaacgatttggtattattgtttacatgggaaaacgcttatatgatattgaactgatgaagttggaactatctcggatttacgatgcagggttgatggataaattagactatctagaggcagaagcagttcttcgaagagagcacaaggtagaattggattatattgagaaaaatggagaaaagaactaa

SEQ ID NO: 208 - DNA, 909 bp, Streptococcus pneumoniae
atgagaattcaacaattacattatattatcaaaatcgtcgaaactggctccatgaatgaggcagccaagcaactctttatcactcagccaagtctctccaatgcagtgcgagatttggaaaatgaaatgggcattgagatctttatccgcaatcccaagggaatcaccttgacccgtgatgggatggagtttctctcttatgcccgtcaggttgtcgagcagacccagcttctggaggaacgctataaaaatcctgtcgcccaccgcgaactctttagcgtttcgtctcaacactatgcctttgtggtcaatgcctttgtctctttgctcaagaaaagcgatatggagaaatacgaactcttccttcgtgaaactcggacttgggagattatcgacgacgtcaagaacttccgcagtgaggtcggggtcctcttcttaaacagttacaaccgtgatgttttaaccaagatgctggatgacaatcacctgctagcccaccatctcttcacagcgcaaccgcatatctttgtcagcaagaccaaccctctggcaaagaaagacaaggtgaaactgtctgatttggagaatttcccttacctcagctatgaccaagggacgcacaactccttctacttttcagaagagattctttctcaagaacaccacaagaaatccattgtggtcagtgaccgtgccaccctctttaatctcttgattggtttggatggttataccattgcgacagggattttgaacagcaacctaaacggagacaatatcgtttctatcccactggatattgatgacccgattgagctggtctatatccagcatgagaaaaccagcctatctaagatgggcgaacgctttatcgactatctactagaagaagttcagtttgatagttga

SEQ ID NO: 209 - DNA, 756 bp, Streptococcus pneumoniae
atgcctactattctcattaccggagctagcggtggtctagctcaagaaatggtcaaactcctgcccaatgaccaactcatcttgcttggtagaaataaggaaaaattagcccaactctacggaaattattcccatgcagaattgattgaaattgatattaccgacgattcagccctagaagctctggtaactgatctttatctccgctatggcaagattgatgtcttgattaacaacgctggttacgggatttttgagggatttgaccagattgctgataaagatattcaccagatgtttgaggtcaatacctttgccctgatgaatctgtctcgtcaccttgcggctcgtatgaaggaaagcagcaaagggcatatcatcaacatcgtcagcatggcaggtctaatagctactggcaagtctagtctttactcagcgaccaagtttgcggctattggtttttcaaatgctctgcgactcgaacttatgccctatggagtctatgtgacaacagtcaatccaggtccaatccgaacaggattttttgaccaagctgacccagatggaacttatcttaaatcggttgaccgcttcctcttagaggcagatgcagtggctaaaaagattgtcaagattataggcaaaaataaacgagaactcaatctcccgattttgttgaacctagcccataagttttatactctctttcccaagctagctgataagttggcaggggaaacttttaattataagtaa

SEQ ID NO: 210 - DNA, 930 bp, Streptococcus pneumoniae
atggatattcaatttttaggaacgggggctggtcagccctctaaagcccgcaacgtttcaagtctcgccctgaaacttttggatgagattaacgaagtttggctctttgactgtggagaaggtacgcaaaatcgcattctggaaaccacaattcgaccacgtaaggtcagcaaaatctttattacccatctgcatggagaccacatttttggtttgccaggtttcctttctagccgtgcctttcaggccaatgaagagcagacagatttggaaatctacggacctcaaggaatcaagtcatttgtcttaaccagccttcgtgtgtcaggttctcgtctgccctaccgcattcatttccatgagtttgaccaagattctctaggtaaaattcttgaaatcgataaattcactgtgtatgcagaggagctggaccacactattttctgtgttggctatcgtgtcatgcaaaaggatctagaagggacgctggatgctgaaaaactcaaggctgctggtgttccgttcggcccgctttttggtaaaatcaaaaatggccaggatcttgttttggaagacggaactgaaatcaaggcagcagactatatctcagcgccacgtccaggtaagattatcactattttaggagacactcgaaaaacggatgccagtgtgcgtctggctgtcaatgcagatgtcctagttcatgagtccacttatggcaagggtgatgaaaaaattgctcgtaaccatggtcactcaactaatatgcaagctgcacaagtagcggtagaagcaggtgccaaacgcctcctactcaaccatatcagtgcccgtttcctctcaaaagatattagcaaactcaagaaagacgctgccacaatttttgaaaatgtccatgtggtcaaagacttggaagaagtggaaatctag

SEQ ID NO: 211 - DNA, 624 bp, Streptococcus pneumoniae
atgactgatattaaaactttggctctaaagtatggaggttatacaagtctggacaaggtctatctggatcagcttctagctggtaaaacagatcaggagcagttaacacttattacacctccgccaagtgttgttaatgcctactttgcagaactctatcagaaaaagagtcctcaggctgcgacggattattttgcagaactcagtcaggaactgaatctttacaatactgagccaagtttcaccctagaaaataagccttttattcggcttaatctgtctggtaaatcctttggtttttgttatgagagtgacggccttggtcggattttctttgaaaatgaggagaaaatctcggatgacttgctctttgaaattgcgcaaattttcccccatcaattagtctttgaagagtctggtaagatttacatgaagcctgtcgaggacgaggaagttatcagcctagaaagtctcacagctttgactgatttggaaagattggctgatggtcgaaaacgtctcaaaggctacagccaagaggatttattgcaagaagctgctgctttttctggcaaacgctatttccgatcggaaaaccgcacagccatgttatatattgattaa

SEQ ID NO: 212 - DNA, 1239 bp, Streptococcus pneumoniae
atgattgaaacggagaataaagaggagcgagtcctgctgattggtgtggaattgcagggtatggacagttttgacctctccatggaagaattggctagtttagcgaaaacggcaggggcagtcgttgtagatagctacagacaaaaacgtgaaaaatatgattccaagaccttcgtcggctctggtaagttggaagagattgcgcttatggtggatgcagaagaaatcactactgtcatcgtcaacaatcgtctgaccccaaggcagaatgtcaatctagaggaagttctcggtgttaaggtcattgaccgtatgcagttgattttggatatctttgccatgcgggctcgaagccatgaagggaagctccaagtccacctagcccaattcaaatacctcttgcctcgcttggttggtcaggggattatgctcagccgtcaggcagggggaattggttcccgtggtcctggtgaaagccaactggagctgaaccgtcgtagcgttcgcaatcaaatcacggatatcgagcgccagcttaaggtggttgagaaaaatcgtgcgactgtcagagaaaaacgtttggagtctagcacttttaagattggtttgattggttatactaatgctgggaaatcaactatcatgaacatcttgaccagtaagacccagtatgaagcagatgagctctttgcgactctggatgcgacaaccaagagtattcatctgggaggcaatctccaagtaactttgacagataccgttggctttatccaagatttgccgacagagttggtgtccagtttcaagtcaaccttggaagaaagcaagcatgtggaccttctggttcatgttatcgatgctagcaatccttaccacgaggagcatgaaaaaacggttctctccatcatgaaagacctggacatggaagatattcctcacttgacgctttataataaagcggatttggtggaggatttcacgcctacccaaacgccatataccctcatttctgccaagtctgaggacagtcgtgaaaacttgcaagcattattgctagataagattaaggaaatttttgaagcatttaccctgcgagtgcctttttcaaagtcctacaagattcatgatttagagagtgttgcaattctggaagaacgtgattatcaggaagacggcgaagtgattacaggctacatttccgagaaaaataaatggaggttagaagaattttatgactga

SEQ ID NO: 213 - DNA, 936 bp, Streptococcus pneumoniae
ttgtgttataataatagtaacgaaaaaatgggaatttttcaaggaaaaaagatgaaaacaaaaataattgtgattgttggaccgactgctgttggaaagacggctctagctattgaagttgcaaagcgttttaatggcgaagtggttagtggagatagccagcaagtctatcgaggacttgatattgggacggccaaggctagtccagaagagcaggcagctgttcctcatcatttaatcgatgttagagagataaccgagtcttactcggcttttgattttgtttcagaagctaagatgactattgagggtattcacaaccgtggcaagctagccattatcgccggtgggactggactttatatccagagcttgctagaaggttaccacctaggtggggagactcctcatgaggagattttagcttatcgagctagtttggagccatattcagatgaggaattagcccatttggtggagcaagcaggccttgagattccccagtttaatcgtcgtcgtgctatgcgtgccttagaaattgcccattttggtcaggatttggaaaatcaagagatcttgtatgaaccgctgattatctgcttggatgatgaacgtagtcaactttatgagcgtatcaaccaccgagtggatttgatgtttgaggctgggcttttggatgaggccaagtggctgtttgaccattcccctaatgtacaggctgctaaaggaattggctataaggaactctttccttatttccgtggagagcagacctttgaggaagctcgtgagagtcttaatcaggcgacccgtcgttttgccaagcgtcagctgacctggttccgtaatcgcatgctggtcaccttttatcatattggagaatctggtgtacaagaccgcattttaagccagatagaggagtctttagatgattga

SEQ ID NO: 214 - DNA, 189 bp, Streptococcus pneumoniae
atgaaagctgctttttgctcttctggttcgattactttctttttaaatgcgtatagtgcacatgcaacggcagcgacagttcatgcgacacctgttacaagacctttagcgaatcctttagccatgagtcttcctcctttatattctcaatcagccagcctcctcaagaggtcacatttttctgactga

SEQ ID NO: 215 - DNA, 198 bp, Streptococcus pneumoniae
ccaattttaaacaggttcgggaaattggtcggttgggaaacgtttaaaattcccacccaggtttggtttttaaatgttcctgaggggactatttttttgaatatcaaagcagaagatttgaggttggtggattatgaccctgttaagccacagttgaagtttgccctagcttttaaaagaatagaaaaaagaagttga

SEQ ID NO: 216 - DNA, 663 bp, Streptococcus pneumoniae
ttagagaacaaaattgctccccaattattatggagtcgtcgtttggcagatgggcgtcatatgtgtgctcaagaatggttgacaggcaagatattgaccccctatgatatgaatcgtaagcaaatcgtcaatattttaacccgtcttcatcgctcacgtcggttgatgacacaattgagtcgtttgggctatgccatggaaacacctgtagatttactacagtcttggcaagaaacggctccagatgctttgcgtaaaaatcattttatcagtgaagtgatggctgatttgcgtcagactattccaggatttagagaggaccatgcgaccattgtccatggagatgtacgacatagtaattggattgagacagatagtggcttgatttatttagtagattgggattcggttcgcttgaccgatcgcatgtttgatgtggcccatatgctctgccattatatttcagaacatcagtggaaggaatggttgacctactacggttacaagtacaatcaaacggtattaagtaaattgtattggtatggtcaattgtcttatttgagtcagatttccaagtattatatgaaccaagatttagaaaatgtcaatcgggagattcatggtttgcgtcatttccgagacaagtatggaaagagaagatga

SEQ ID NO: 217 - DNA, 636 bp, Streptococcus pneumoniae
atgagagttagaaatcgtaaaggggcaacagaattactagaggcaaatccccagtatgtggtcctcaatcccttggaagccaaggcaaaatggcgggacttgtttggcaatgataatcccattcatgtggaagttggaagtggaaagggtgcctttgtttcaggtatggccaagcaaaaccctgacatcaactatatcgggattgatattcaaaagtctgttttgagctacgctttggacaaggtgcttgaagttggagtgcctaacatcaagctcttgtgggtagatggttctgacttgactgactactttgaagacggtgagattgatcgcttgtatctgaacttttcagatccatggccgaaaaaacgccatgaaaagcgtcgtttgacctacaagacctttttggacaccttcaaacgtatcttgcctgaaaatggagaaattcatttcaaaacggataaccgtggcttgtttgagtacagtttagtgagcttttctcaatatggcatgaaactcaatggtgtctggctagatttgcatgccagtgattttgaaggcaatgtcatgacagaatacgagcaaaaattctcaaacaaggggcaagttatctaccgagttgaggcagaattttaa

SEQ ID NO: 218 - DNA, 267 bp, Streptococcus pneumoniae
gtggatatcgagtatggaaagattggcagtgacatgattctcagtatttttgtagataaacccgaaggaattaccttgaacgacacggcagacttgacagaaattatcagtccctgtcctagacaccatcaagccagatcccttcccagaacaatatttcctagaaattaccagtccaggcttggaacgtcctttgaaaaccaaggatgccgtcgctggagcggttggaaaatacatccatgtcggactctaccaagccatcgataa

SEQ ID NO: 219 - DNA, 309 bp, Streptococcus pneumoniae
cagaaattatcagtccctgtcctagacaccatcaagccagatcccttcccagaacaatatttcctagaaattaccagtccaggcttggaacgtcctttgaaaaccaaggatgccgtcgctggagcggttggaaaatacatccatgtcggactctaccaagccatcgataagcaaaaggtctttgaaggaactttgttggccttcgaagaggacgagttgactatggaatatatggacaagacgcgtaagaaaaccgtccgaattccatacagtttagtatcaaaagcacgtttagcagttaaattatag

SEQ ID NO: 220 - DNA, 1137 bp, Streptococcus pneumoniae
atgagtaaagaaatgctagaggccttccgcattttggaagaagacaagggaatcaaaaaagaagatatcatcgacgcagtagtagagtcgcttcgttccgcttatcgcagacgctatggtcagtcagacagcgtagctattgacttcaacgaaaaaacaggtgactttacagtttatactgtccgtgaagttgttgatgaagtatttgatagccgtttggaaatcagcttgaaagatgctcttgccattaattcagcttatgaacttggagacaaaatcaagtttgaagaagcaccagctgagtttggtcgtgtagcagcccaatctgccaaacaaaccatcatggaaaaaatgcgcaagcaaacacgtgccatcacttacaatacttacaaagaacatgagcaagaaatcatgtctggtacagtagaacgctttgacaaccgctttatctatgtcaaccttggtagcatcgaagcccaattgtcaaaacaagaccaaattcctggagaagtttttgcttctcatgatcgtatcgaagtttatgtttacaaggttgaagacaaccctcgtggtgtgaacgtctttgttagccgtagccatccagaaatgatcaaacgtttgatggagcaagaaattccagaagtttatgatggaactgttgaaatcatgagcgtggctcgtgaagcaggtgaccgtacgaaggttgctgttcgtagccacaatccaaacgtggatgctatcggtacaatcgttggacgtggtggtgctaatatcaagaagattactagcaaattccacccagctcgttacgatgctaaaaatgaccgcatggtaccaatcgaagaaaatatcgatgttatcgagtgggtagcagatccagctgaatttatctacaatgccatcgctcctgctgaggttgaccaagttatctttgatgaaaacgacagcaaacgtgccttggtggttgttccagataacaagctttctcttgccattggtcgtcgtggacaaaacgtgcgcttggcggctcacttgactggttaccgtatcgatatcaagtctgctagcgaatttgaagccatggaagacgctgcttcagtagagttggaagtagaaaacgatactgtagaagaataa

SEQ ID NO: 221 - DNA, 294 bp, Streptococcus pneumoniae
atgaaaacaagaaaaatccctttgcgcaagtctgttgtgtctaacgaagtgattgataagcgtgatttgctccgcattgttaagaacaaggaaggacaagtctttattgatcctacgggcaaggccaatggccgcggcgcttatatcaaactagacaatgcagaagccctagaggcgaaaaagaagaaggtctttaaccgcagctttagcatggaagtggaagaaagcttttatgacgagttgatcgcttatgtggatcacaaagtgaaaagaagagagttgggacttgaataa

SEQ ID NO: 222 - DNA, 300 bp, Streptococcus pneumoniae
ttgaataagcaaaagataagtaatctcttggggcttgctcagcgagcagggcgcatcatatcgggtgaagaattggtggtcaaggccattcaagacggcaaggccaagttggtctttctagctcatgatgctggacccaatctggccaagaagattcaagataaaagtcattattatcaagtagaaattgtaaccgtgttttcaacactggaattaagcatagcagtcgggaaatcgagaaaggttttggctgtaacagatgctggatttacaaagaaaatgaggtctcttatggaatag

SEQ ID NO: 223 - DNA, 495 bp, Streptococcus pneumoniae
ttgcccttattttgcttacgtcgttctgcctgctctttagcacgggcttcacgctcagccttgaaattacggctttgcggtttcgctgctactttttctgttttcggagcaactggctcagccggttttgcctcttccttagctacagctggtttagctggctcagatttttcggctttcttttctgcacttacttttggtgctgcaggttttgcttctactttcggagcagctgcaggcttaaagctggcagcaatttttgcagcgacagcttcttccacacttgatgagtggcttttcacatccaagcccaactcttttgcacgcgctacaacttctttactttcttttccaagttcttttgcgatttcgtacaatcttttcttagacaaatcatgtcctcctcttctattccataagagacctcattttctttgtaaatccagcatctgttacagccaaaacctttctcgatttcccgactgctatgcttaa

SEQ ID NO: 224 - DNA, 2793 bp, Streptococcus pneumoniae
ttgtctaagaaaagattgtacgaaatcgcaaaagaacttggaaaagaaagtaaagaagttgtagcgcgtgcaaaagagttgggcttggatgtgaaaagccactcatcaagtgtggaagaagctgtcgctgcaaaaattgctgccagctttaagcctgcagctgctccgaaagtagaagcaaaacctgcagcaccaaaagtaagtgcagaaaagaaagccgaaaaatctgagccagctaaaccagctgtagctaaggaagaggcaaaaccggctgagccagttgctccgaaaacagaaaaagtagcagcgaaaccgcaaagccgtaatttcaaggctgagcgtgaagcccgtgctaaagagcaggcagaacgacgtaagcaaaataagggcaataaccgtgaccaacaacaaaacggaaaccgtcagaaaaacgacggacgtaatggtggaaaacaaggtcaaagcaaccgcgacaatcgtcgctttaatgaccaagctaagaagcagcaaggtcagcaaaaacgtagaaatgagcgccgtcagcaagaggacaaacgttcaaatcaagtggctccacgtattgactttaaagcccgtgcagcagccctaaaagcagagcaaaatgcagagtacgctcgttcaagtgaggaacgcttcaagcagtatcaggctgctaaagaagccttggctcaagctaacaaacgcaaggaaccagaggaaatctttgaagaagcggctaagttagctgaacaagcacagcaagttcaagcagtggttgaagtcgtccctgagaaaaaagaacctgcagtggatacacgtcgtaaaaaacaagctcgaccagacaaaaatcgtgacgattatgatcatgaagaagatggtcctagaaaacaacaaaagaatcgaagtagtcaaaatcaagtgagaaatcaaaagaatagtaactggaataacaacaaaaagaacaaaaaaggcaataacaagaacaaccgtaatcagactccaaaacctgttacggagcgtaaattccatgaattgccaacagaatttgaatatacagatggtatgaccgttgcggaaatcgcaaaacgtatcaaacgtgaaccagctgaaattgttaagaaacttttcatgatgggtgtcatggccacacaaaaccaatccttggatggggaaacaattgaactcctcatggtggattacggtatcgaagccaaacaaaaggttgaagtggataatgctgacatcgaacgtttctttgtcgaagatggttatctcaatgaagatgaattggttgagcgtccaccagttgttactatcatgggacacgttgaccacggtaaaacaacccttttggatactcttcgtaactcacgtgttgcgacaggtgaagcaggtggtattactcagcatatcggtgcctaccaaatcgtggaaaatggtaagaagattaccttccttgatacaccaggacacgcggcctttacatcaatgcgtgcgcgtggtgcttctgttaccgatattacgatcttggtcgtagcggcagatgacggggttatgcctcagactattgaagccatcaaccactcaaaagcagctaacgttccaatcatcgtagctattaacaagattgataaaccaggtgctaacccagaacgcgttatcggtgaattggcagagcatggtgtgatgtcaaccgcttggggtggagattctgaatttgttgaaatctcggctaaattcaaccaaaatatcgaagaattgttggaaacagtccttcttgtggctgaaatccaagaactcaaagcagacccaacagttcgtgcgatcggtacggttatcgaagcgcgcttggataaaggaaaaggtgcggtcgcaacccttcttgtacaacaaggtaccttgaatgttcaagacccaatcgttgtcggaaataccttcggtcgtgtccgtgctatgaccaacgaccttggtcgtcgtgttaaagttgctggaccatcaacaccagtctctatcacaggtttgaacgaagcaccgatggcgggtgaccactttgccgtttacgaggatgaaaaatctgcgcgtgcagcaggtgaagagcgtgccaaacgtgccctcatgaaacaacgtcaagctacccaacgtgttagccttgaaaacctctttgatacccttaaagctggggaactcaaatctgttaatgttatcatcaaggccgatgtacaaggttctgttgaagccctttctgcctcacttcaaaagattgacgtggaaggtgtcaaagtgactatcgtccactcagcggtcggtgctatcaacgaatcagatgtgacccttgccgaagcttcaaatgcctttatcgttggtttcaacgtacgccctacaccacaagctcgtcaacaagcagaagctgacgatgtggaaatccgtcttcacagcattatctacaaggttatcgaagagatggaagaagctatgaaagggatgcttgatccagaatttgaagaaaaagttattggtgaagcggttatccgtgaaaccttcaaggtgtctaaagtcggaactatcggtggatttatggttatcaacggtaaggttgcccgtgactctaaagtccgtgttatccgtgatggtgtcgttatctatgatggtgaactcgcaagcttgaaacactataaagacgacgtgaaagaagtgacaaacggtcgtgaaggtggattgatgatcgacggctacaatgatattaagatggatgatgtgattgaggcgtatgtcatggaagaaatcaagagataa

SEQ ID NO: 225 - DNA, 246 bp, Streptococcus pneumoniae
ttgggctttttggttatccgaagcaaggttactcaaaatggtgtaataaaccttggcaacagacaagtcacccagcatctgaacatctgtgatggtcacaccttggacacgtggatcacggactttcttttgcaaaatctcattgacttcacgcttgatttccatgcccacacgatccgtacggaaatgatttgccatgatattcctttctctactttgaaccaaaagctaggccagcagacctag

SEQ ID NO: 226 - DNA, 351 bp, Streptococcus pneumoniae
atggcaaatcatttccgtacggatcgtgtgggcatggaaatcaagcgtgaagtcaatgagattttgcaaaagaaagtccgtgatccacgtgtccaaggtgtgaccatcacagatgttcagatgctgggtgacttgtctgttgccaaggtttattacaccattttgagtaaccttgcttcggataaccaaaaagcccaaatcgggcttgaaaaagcaactggtaccatcaaacgtgaacttggtcgcaatttgaaattgtacaaaatcccagatttgaccttcgtcaaagacgagtccatcgagtatggaaacaagattgacgagatgctacgcaatctggataagaactaa

SEQ ID NO: 227 - DNA, 780 bp, Streptococcus pneumoniae
atggctgaacaagacttagctatgcaagtattacaacaagtggtaaaactaccagttgttaaggttgatagttcgaaatttttagtggataagttttccaaagaattgggtccacaggacattcctaccttattggaacaaggtccaacgtctctcttatctcaagaaatcttagatcgagtagctaatgcttgtattcgggacaatgtattattagcgagtgggacttctgttttggcaggattacctggagggcttgctatggcaattaccattccagctgatgtggctcaattttatgctttctctctgaaattggctcaagaattaggttatatttatggttatgaggatctttgggtttcacgagaggagttgagtgaagatgctcaaaataccctcttgctttatctaggcgtaatgttaggggtgaatggaactgctgctttgctacgtgctggtggtataacaattgccaaacaggtaatgaaaacagtgcctaataaagctttaacaaagacgctttggtaccctattttgaaaaaagtcttaaaaatatttggtgtgaatcttaccaagggagggttggccaaaggaatggggaaatttattcctatcttgggtggtatcatttcaggtggtttaacctttgcaactatgaaaccaatgggggaaagcttgcagaaagaattatccaagctagtcaactatagtgaagttcaatatcaagaagatgttgaaacaatccgaaaagaggctgaaatcatcgaaggagagtaa

SEQ ID NO: 228 - DNA, 252 bp, Streptococcus pneumoniae
gtgaagttcaatatcaagaagatgttgaaacaatccgaaaagaggctgaaatcatcgaaggagagtaatatgggactcataaaaactctagctaaaatttatggtaattactttttgaccgtgcaaggtgtaaaagtgatgaaaacgataaagaaagctgaccatgtcgttgttggtctgggcaaactttttattgcagataagctaatggatacggctcggtggctcattaagccagaggagagagaatga

SEQ ID NO: 229 - DNA, 222 bp, Streptococcus pneumoniae
gtggggttcctgctagttttctgcgacttggattaccatctagataagtttaaagaaccaatccaatatcttgtaaaacagcaattgaactgcaaaagaaatgatcatccaaaagaatttcacaatcccaataatcggtttgataaaaagaatagcaagaagaccaaaaaaatttcattctctctcctctggcttaatgagccaccgagccgtatccattag

SEQ ID NO: 230 - DNA, 195 bp, Streptococcus pneumoniae
ctcttcgaaaatctcttcaaaccacgtcagcttcaccttgcagtatatatgttactgacttcgtcagttctatccacaacctcaaaacggtgttttgagctgacttcgtcagttctatccacaacctcaaaacactgttttaagcaacctgcggctagcttcctagtttgctctttgattttcattgagtattag

SEQ ID NO: 231 - DNA, 234 bp, Streptococcus pneumoniae
atggacaatatcatcgatgtgtcaattcctgttgcagaagtggtggacaagcatccagaagtcttggaaattctagtggagttgggttttaaaccccttgccaatcccttaatgcgcaatacagttggtcgtaaagtatcacttaaacagggttctaagctagcaggaactcctatggacaagattgtacgcacactggaagcgaatggctacgaagtgattggattagactaa

SEQ ID NO: 232 - DNA, 1335 bp, Streptococcus pneumoniae
atgacagatgaacggattcatgtcctacgggatattttgttagaattgcacaatggcgcctctcctgagtcggttcaagatcgctttgatgcgacctttacgggcgtgtcagccatcgagatttcccttatggagcacgagctgatgaactcggattcgggcgtcacttttgaagatgttatggaactctgtgatgtccatgccaatctttttaaaaatgctatcaaaggtgtcgaagtttcagatactgagcatccaggtcacccagttcgtgtcttcaaagaagaaaatctggctctccgtgcggccttgattcgcattcgtagattgttagatacctatgagtctatggaagacgaggaaatgctggcggagatgcgtaagggtttggtgcgtcagatgggacttgtgggtcaatttgacatccattaccaacgtaaggaagaactcttctttcctatcatggagcgctatggacacgattcacctcccaaagttatgtggggagtggatgatcagattagggaactctttcaaacagctctaacgacagccaagtcactaccagaagtgtcaattagcagtgtaaaggaagcttttgaagcttttgcgacagagtttgaaagtatgattttcaaggaagagtccatcctgctcatgattctccttgagtcttttactcaggatgactggcttcagattgcggaggagagtgatgcctatggctatgccatcatccgtccgtcagagaaatgggtgccagaacgacagatctttattgaggaaaagattgcagaggagcctgtacagctagatacggcagaaggtcaagttcaacaagtcatagatacgccagaaggccattttaccattacctttacccctaaggaaaaggaagctgtgctggaccgccatagtcaacaggcttttggtaatggctatctttcagtcgagcaggccaatctcatcctcaatcatctccctatggagattacctttgtcaataaagaagatattttccagtattacaatgacaatacgccagctgatgagatgattttcaaacggacgccgtcccaagtcgggcgcaatgtcgaactctgtcatccgcctaagtatttggacaaggtcaaggctatcatgaagggacttcgtgaggggaccaaggacaagtatgaaatgtggttcaagtctgagtcgcgaggaaagtttgtccacatcacctatgctgcagtacacgatgaaaacggagaattccaaggtgtactggaatacgttcaggatatccagccctaccgtgagattgatacggactatttccgtggattagaataa

SEQ ID NO: 233 - DNA, 255 bp, Streptococcus pneumoniae
atgagttacgaacaagaatttatgaaggaatttgaagcttgggtcaatacccaaatcatgattaacgacatggcgcacaaggaaagccaaaaagtttacgaagaagaccaggacgagcgtgccaaagatgccatgattcgctacgagagtcgcttggatgcttatcagttcttgcttggtaagtttgaaaacttcaaagtaggcaagggattccatgatttgccagaaggcttgtttggtgagcgaaattattaa

SEQ ID NO: 234 - DNA, 396 bp, Streptococcus pneumoniae
atgtcaaagaaactcaatcgtaaaaaacaattacgaaatggcctccgacgcgcaggtgccttttcaagtactgtgactaaggttgtagatgagacaaaaaaagtcgtgaagcgtgcagaacagtcagcaagcgcagctggtaaggctgtttctaaaaaagttgaacaagcagtagaagctcccaaagagcaagctcaaaaagtagctaattctgtagaagattttgcagcaaatttgggtggacttccacttgatcgtgccaagactttctatgatgaaggaatcaagtctgcttcagatttcaaaaactggactgaaaaagaactccttgccttgaaaggaatcggcccagctaccatcaagaaattgaaagaaaatggcatcaagttcaagtaa

SEQ ID NO: 235 - DNA, 207 bp, Streptococcus pneumoniae
gtggacttctcagcgccgccactttctgtaaaatgtgggattcaaaacacctctaatggctctattgtagcaagattttttcggaaatgcaaggctcaagaaaaattacttgaacttgatgccattttctttcaatttcttgatggtagctgggccgattcctttcaaggcaaggagttctttttcagtccagtttttgaaatctga

SEQ ID NO: 236 - DNA, 450 bp, Streptococcus pneumoniae
gtgattggagtcgttgcgagagagaatgccgcagagcagatcaaacagtatcaaaaatttactgtgaatatttctgatgaaacttctatgcttgcgatggagcaggctggttttatcagtcatcaggagaaattggaacgtttgggagtgcattatgaaatttctgaacgaactcagatttctattttagacgcctgtccacttgttttagattgtcgggtagataggattgttgaggaagacggtatttgccacatctttgccaagattcttgagcgacttgttgccccagaattcctggatgaaaagggacattttaaaaatcaactgtttgccccaacctatttcatgggagatggatatcagcgcgtttatcgctatctggacaagcgtgtagatatgaagggcagtttcatcaaaaaagcgaggaagaaggatggcaagaactga

SEQ ID NO: 237 - DNA, 558 bp, Streptococcus pneumoniae
atggcaagaactgagctgtcagataaaatcgaaacagaacgtctcgttttacgagtccgtactgtggcggatgctgaggatatccatgcctacgctagtttgccagaggtcgcctatccagcaggttttcctccagtcaagaccttggaagatgagatttattatctggagcacattcttccggagcgtaatcaaaaggaaaatctcccagcaggctacgggattgtcatcaaaggaacggataagatcgctggctctgtcgatttcaaccatcgctatggggacgatgtgctagagcttggctataccttacactcagactactggggtcgaggttatgttccagaagctgcgcgtgccttgattgacttagcctttaaagatttgggtcttcacaagattgaactaacttgctttggatataaccttcaaagtaaacgagtcgcggaaaagcttggctttaccctcgaagctcgcataagagaccgcaaagatgctcaaggcaactgctgtgatgatttaagatatgccttgctgaagagtgaatgggaggaataa

SEQ ID NO: 238 - DNA, 963 bp, Streptococcus pneumoniae
atgagcgatgtaaaagaggaagtaagctctctatctgagaagcagttacgccaaattgatgttgagtatgctgaattaaatgatagtgatattatcgagcgattagcttatttagaaattaacaacaatgaaaaacgtattgtcatctctgatattgaaccaaccaaggaaataatgtcagtctcggaccaaatttttgagattcaaaagaattttcaaaaaatcaagaatatgttcgaattgtttatttcagatgtctcggattttttaagtattaaaaataaacttgagtcaaaggaattagaaattgaagaggcagatgtaaatcgtttcatgattcatttattatccagtggaaaattgtttgtcgattttaacgaaaaccaaattaaacaaaaatattccaaagatagtgaggagtttgattgtatacatggttttgcaagctatcagtatgatatcaattttacttatcgattttgccattctttgagaaattattcgcaacatactgacttaccaataaatgaggtaaaagctgttagcccagatgatgagactgttataatagatttctatattgatttagattatcttttaaattccaactttaaatggaaaaaattgaaaggggagttgataaaactaaaccaagaaacatctaagattgacgctatagctctagtgaaagaatactttaatgctcttacagagctctatggtaattataataagttgtttttaaagttaaaccataatacattagtagatattaaatcaaagttggaatcattaaaattgaaacactctaggtattatatttcaaagataagcaagtatgatcttaaatataatcctggaaattatactatgtcaccacttgcagcatttgctgaaattgaagagatttatattgaactttcaaaaattggtttggttaaaattgtcaataaaagtaattaa

SEQ ID NO: 239 - DNA, 2652 bp, Streptococcus pneumoniae
atgtctaaagaactttcatctaaatacaatccagccgaggttgaggctggtcgttaccaaaaatggcttgatgctgatgttttcaagccttcaggcgatcaaaaggctaagccttattcaatcgttattccaccaccaaacgttacaggtaaacttcaccttggtcacgcttgggatacaactttgcaagatattatcatccgtcaaaaacgcatgcaaggttttgataccctttggcttcctgggatggaccacgcagggattgccactcaggctaaggtagaggagcgcttgcgtggtgagggcatttcccgctatgaccttggtcgtgagtctttcttgacgaaagtctgggaatggaaagacgaatatgccactactatcaaggaacaatggggcaagatggggctctctgtagactactctcgtgagcgtttcactcttgacgaaggtttgtcaaaagctgttcgtaaggtctttgtggacctttacaagaaaggctggatctaccgtggtgagtttatcatcaactgggacccagcagctcgcacagccctttctgatattgaggtgattcacaaggatgtcgaaggtgccttctaccacatgaactacatgctggaagatggttcacgcgcccttgaagttgctacaactcgtcctgagactatgtttggggacgttgcggttgcggttaatccagaagacccgcgctacaaggacttgattggtaaaaacgtcatccttccaatcgctaataaactcatcccaatcgttggagatgagcacgcagatcctgagtttggtactggtgtcgtgaaaatcacacctgcccacgatccaaatgacttcttggttggccaacgtcataacttgccacaagtcaacgtcatgaacgacgacggaactatgaatgagcttgcctttgaattttcaggcatggatcgttttgaagctcgtaaggcagtcgttgctaagttggaagaaatcggtgcccttgtcaaaatcgaaaaacgtgtccattcagtcggtcactcagaacggacaggtgtcgtagttgagccacgcttgtctactcaatggttcgtcaagatggaccaattggctaagaacgccattgccaaccaagacacagaggacaaggtcgaattctacccacctcgtttcaacgataccttccttcaatggatggaaaatgtccacgactgggttatctctcgtcagctttggtggggtcaccaaatccctgcctggtacaatgctgatggtgaaatgtatgtcggcgaagaagctccagaaggtgacggatggactcaggacgaagacgtcttggatacttggttcagttctgccctctggccattttcaaccatgggctggcctgaagtcgactcagaagactttaaacgttatttcccaacttcaaccttggtaacaggttacgacatcatcttcttctgggtgtctcgtatgatcttccagtcattggaattcacaggccgtcaaccattccaaaacgtccttatccatggtctaattcgtgatgaagaaggacgtaagatgtctaaatctcttggaaatggcattgacccaatggatgttattgataaatatggtacagatagtcttcgttggttcttgtcaaacggctcagctcctggtcaagacgttcgtttctcttacgagaaaatggatgcttcatggaactttattaacaagatttggaacatttctcgctatatcctcatgaacaatggaggtttgacgctggatgtggcgcatgacaatgtcacaaaagttgcaacaggtgaggctggtaatgtgacggaccgctggattctccacaatctcaacgaaaccattgcaaaagttactgaaaactttgataagtttgagtttggtgtggctggtcatatcctttacaacttcatttgggaagaatttgccaactggtatgttgagttgaccaaggaagttctttacagcgacaatgaagacgataaggtaattactcgatctgttctcctctatacgctggataaaatccttcgtctccttcacccaatcatgccgttcgtgacagaagaaatctttggtcagtacgctgaaggctctatcgtgacagcagcatacccaactgtcaacccagcctttgaagaccttgctgcccacactggtgtggaaagtctcaaaaacttgattcgtgctgttcggaatgcgcgtgcggaagtaaatgtagcaccaagcaaacctatcacaatccttgttaagactagcgatagtgacttggaagccttctttaacagcaatgtcaactacatcaagcgctttacaaatccagaacatttggaaatcgcatcaaccatccctgcacctgaactggctatgtcaagcgtcatcacaggagcagaaatctacttgccactggcagaccttctcaatgtcgaagaagaactggctcgtctcgacaaggaactcgctaaatggcaaaaagaactggatatggtcggtaagaaactctctaacgaacgcttcgtagccaacgccaaaccagaagtcgtccaaaaagaacgcgacaaacaagctgactaccaagccaagtatgatgcgaccgtagcacgtattgatgagatgaagaagttggtgaaataa

SEQ ID NO: 240 - DNA, 756 bp, Streptococcus pneumoniae
atgtccaaacaccctcattatgaattgttaaatttaattggctacggtcttgccaagtttgacaagctttttataaaagaatttcaatgctctagcaagtcggagttttatcgctatgtggtttctctgggaattgctgaaacaactggagttgtaaaaaatagaatggatttatttgatccttattttgacaataatcgaaaaggttggtggcagaaagctgaagtttatcgttttcgtaaagatttaattgatatgatgtttggaaatgaagatgttcatagttatgctgaaatagttaaaatgttacttgccagtgaagggaagaaaacaggcataaccatcgttgaaaaaccaatagttcgaactaaattcaaacgtctacaggaaacgggaatggaggctgagaattattttatccttcattttgataaagaagaaaaattccaaggtggacagttaaccgatgcccgtctttatggtgatggatatgactttcaggtagatgtccaagagtattcttaccttgccgaagtaaaaggtatccgaaaatctaaggggcgtgtgcgtttaactgcaaaagaatttgaaaaagtcaaggagtttcaatcggattttattttatccttggtcacaaatctagatgatattccaaagttagtgttaatcgataatcctttaaaacattttgagtttaaaaagaatattatcaaaaatgaaatcattgaatatagaagcgtagaggatttgtattag

SEQ ID NO: 241 - DNA, 804 bp, Streptococcus pneumoniae
atgcaaccaacttacaacattgacaatccaaacttgtcttatgaagcgaagcgtgatttatggcggataggttttggtctgcagaaagttgacaatctagtgccatcagcgtatatggaatctttggctgagaaacagtcccggggagaactgacttatgagcaggtttatgaggatgcaacggcttatcaccatactattgatgcaagtacggaagaggcagacttggtttctctacgtattgtagaactattgtctcgaagaggctttagctttagtcctgcgaccttacttgctattcataaggagttgtttcaagatatatttgaaccctctattccggtggggcaatttcgtcagaccaatatcacaaagaatgaacctgttttgaatggtgaaagtgttgtgtactctgattactccatgattcaaatgaccttagattatgattttaatcaggaaaaacaagttgcatatgcgacactaactcaggcggatgtggttaaacaaatccagcattttatttcaggaatctggcagattcatccatttcgcgaaggaaacactcggacagtaacggtctttttgattcagtatcttcgtgagtttggttttgatattgataatacaccatttcagcaacattccaaatattttcgtgatgccttggtattagataatgcaaagattttacagcgacgttctgagtttttaacagctttttttgaaaatctcttgctcggtggtcaaaatgatttgtcttcagaaaaaatgtatctagatttagacctcgatttttcataa

SEQ ID NO: 242 - DNA, 285 bp, Streptococcus pneumoniae
ccaaggctggcaataccgacacgattcttatcatcggttcctaagagtaagggaattcaagcatctatgtcacgcaagggaaacagccaagacaacggtatgatggagtccttctttgggattctgaaatcggaaatgttttatggctatgagaaaacatttaaatcacttaatcaattggaacaagctattgtagactatattgattactacaacaataaacgaattaaggtaaaactaaaaggacttagccttgtgcaatacagaactaaatccttcggataa

SEQ ID NO: 243 - DNA, 306 bp, Streptococcus pneumoniae
atggaaaagtgctacacagatgtgacagaatttgccattccagcaagtactcaaaagctttacttatcaccagttttagatggctttaacagcgaaattatcgcctataatctttcaacttcacccaacttagaacaagtacaaacaatgttggaacaggcattcacagagaagtactacgagaatacgattctccatagtgaccaaggctggcaataccgacacgattcttatcatcggttcctaagagtaagggaattcaagcatctatgtcacgcaagggaaacagccaagacaacggtatga

SEQ ID NO: 244 - DNA, 273 bp, Streptococcus pneumoniae
atgactgagttttcgttagatcttcttctaaaagccattaaactagctcgttcgacctactactatcacttgaaacagctagacaaaccagataaggaccaagagcttaaagctgaaattcaatccatttttatcgaacacaagggaaattatgcttatcgctgtattcatttagaactaagaaatcgtggttatctggtaaatcataaaagagttcaaggcttgatgaaagtactcaatttacaagctaaaatgcgacagaaacgaaaataa

SEQ ID NO: 245 - DNA, 276 bp, Streptococcus pneumoniae
gtgtacatgaactacaccccaaaagttagacagaaaaaatctaacttttggggtgtttttattatgaaattaacttatgatgataaagttcagatctatgaacttagaaaacaaggatatagcttagagaagctttcaaataaatttgggataaacaattctaatattaggtacatgattaaattgattgatcgttacggaatagagttcgtcaaaaaagggaaaaatcgttactattctcctgatttaaaacaagaaatgattaataaagtctga

SEQ ID NO: 246 - DNA, 1266 bp, Streptococcus pneumoniae
atggctgtttttgtgtctttggatggaattgtggtagaagtacttgatgtcttttcttcttttaatggggatagtgagtttttcttgtgtaaacgtcttaaagacaagagtcagtttgttatggaacgctctcagttcgaggagatgttccaacttcaaagtagtcgcttgacgacgcaagaaaaattacaattgtttacctctgtgtttgctggccgttatgatgtttatgctaagagttttatcaatgatcaagggaaaattcagtattttccttcctatgattgtggttggaagcagttgctacctgaaaaacggagtttccagacattgacggattccgttttgaaatctcattttcgtggggagacagctatcggtatctttcctatgcacttagatgatagctgtcattttttggtactggattttgatgaaggagattggaaagaagctggtttaaccattcgaagaatagccagggaacgccagatggaagcccatttagagatttctcgttcgggtcacggactccatatttggttcttctttgaggaagcgattccgagtcgagaggctcgcttgtttggaaagaaactgatagaactggcaatgcaggaaagtatgcaactgtcctttgattcttttgatcgcatgtttccaaatcaggatgtccttcctaaggggggatttggaaatttgattgccttgccttttcaaggagaagcttaccatcaagtgcgaacggtctttgtggatgaacattttcaaccttatggagaccaatggaggtatctgcaaggaattcagaagatttcaactgctaaagtggcactgttaatccaagaggagttaggcaagcaagaattggataaggagttgaaggtcgttttatccaatatgatccaacttaaaaaatcgtctgtgacacccaagacactgtttttcttgaaaaatatggcttcattttctaatcccgaattttatttaaagcaggctatgcgacagccaacctatcaaattcctgagcgaatgtatttatttggagaatccgattattatttatggctgccaagaggcttgttatatccattgcaagataaatttaagcaggtagttgtggaggataggagaaaggtacaaaggtctattagagtagcatttaagggagagcttactttggagcaagaattagccctgtcagatatgaattctaaagaaaatggtttacttcatgcgggacaggttttggaaagagcgttttag

SEQ ID NO: 247 - DNA, 1197 bp, Streptococcus pneumoniae
atgattcaatctctatttaagttggaaaatagtcaaagtcttttggatgagtatgagatgatgattgtggatgagtgtcaccatatctctgccttgatgtttgaaaaagttgttgctcagcttagagggaagtatctttacggtttgacggctacgcctgagcgtaagaatggtcatgagcctattgtttttcagagaattggtgagatactccatactgctgataagagggaaacggattttaaacggcaattgcaattaagattcacttcttttggtcatttggagattgaaaagaccaaagcaagtaattttatacagctcagtgattggattgctacagactcagcgaggaatcagttgattctcaaggatattctagcccaagtggcagaaggacggaatatcttgggtttagttaatcgaattcaacagatagatgtctttgaaaagttattgaaagagaaagaggttgatgactgttacattattagcggaaaaaccaaagtccgagaaagaacgagtttactggagacgttagaacagttagataaagggtttgttttgttgtctactggaaaatacattggcgaagattttgacttacctcagttggacacgcttatcttggcagcacccttttcttggaaaaataatttaattcagtatgcaggtcggattcatagaaactacaaggataagtctttggtgcgtattttcgattatgtggatattcatgttccttatttagaaaagatgtttcagaaacgacaagtagcttatcgaaagatggattatcgtgtcatcgagggtgaggagaaacaattcgtttatgttgatagtagatatgagaaggtgttgagagaggacttagcaggggaaagacaggaatgtctgcttattttaccttatgtgcaccagacaaaactgatgaattttctaaaagaatttaggattagtcaaattgagatatgtataccagagacggttgcaaataaagcatggctagaccagttgaagagccagaaaattaaagtgtcttttactcaatcaaaaatagtaacgcctattcttttggtgaataagactattgtttggtatggtgcaatgccattattagggaaggtagatgagatgaccatattacgtttggaatcagctagtatagtttctgaactagtggcaggtttacgatag

SEQ ID NO: 248 - DNA, 294 bp, Streptococcus pneumoniae
ataatttcatcaaaattattacccaatgttattttacctaggttaattattttttcggtgatgtacaccaactccaaaggaacgttaataaacatctctgtaaaacgggtcatattatctctatttttgagaaaaaaacttttctcaatatcaattggatttactttatctccagtttttcttccaaaagctattccccttccaaaaagaagaatatcgatatcttttttactttgcgcaattacggcattgtggtttagtattcgttttatgatcataaaatttcccttttaa

SEQ ID NO: 249 - DNA, 840 bp, Streptococcus pneumoniae
atgatcataaaacgaatactaaaccacaatgccgtaattgcgcaaagtaaaaaagatatcgatattcttctttttggaaggggaatagcttttggaagaaaaactggagataaagtaaatccaattgatattgagaaaagtttttttctcaaaaatagagataatatgacccgttttacagagatgtttattaacgttcctttggagttggtgtacatcaccgaaaaaataattaacctaggtaaaataacattgggtaataattttgatgaaattatctatattaatttaacggatcatatttcttcgagcatagaacgttataaagaagggattattatttcgaatcccctacgctgggaaatatcgaaatattataaagaagaatttgaacttgggaaaagggctttacaaataataaaaaaagagttaggtattgaacttccaattgatgaagctgcattcatagcgctacattttgttaatgctaatttagaaaataattttcaagagtcgtataaaatcactgaaataattatgggaattgagaaaatcattcaagatttctattgtactgagtttaaccaagattctattgattattatagattcataactcatataaaattatttgcccatcgcttggttgaaaatacaacttattgtgacgatgatgatgaagacttgttagcattaatgaaaaataaatatcctagagaatatgaatgtggtgaacaggtggcaatgtttatacaaactgagtacaattatttgctgacttctagtgaattagtttatttgatggctcatattcgtcgcttaacaaaaaatttagattaa

SEQ ID NO: 250 - DNA, 1839 bp, Streptococcus pneumoniae
atgagttataaagatacggtacaaaaaatcctcgatgtaattggaggtgaaaaaaatgtcaatagagttacccattgtgtaacacgtttaagattagaattaaaagatgaaaatttagtcaatgatgatgatgtgaagaagataccaggtgtaataggtattatgaaaaagaatggacaatatcaaattatacttggtaatgatgtagctaattattataaagaattcgttaaacttggcaattttgaatccgattcagttgttcaagggcacaaagggaatattttagaaagaatcattgagtatatcgctggttccatgactccaatcattccagcaatgttagggggaggtatgctgaaagtcttggtaattattttaccaatgcttggtatattgcaatcagattctcagactattgcttttttgacattttttggggatgctccatattatttcttaccgctgttattagcttattctgcatcacaaaaattaaaagtaacatctacattagctatgtctgtagcaggtgtacttctccatccaaattttgttcaaatggtgcaatcagggaatcctcttagtttatttggtgcacctgtgacaccagctagttatggttcgtcagtcgttccaattcttattatggtttggttgatgaaatatattgaaaaaatgattgctaaattaacaccagctgttactaagagttttttgcaacctacgctagtattattagtatcaagctgtattgccttagttgtagtcggacctattggagtaattgttggtgaaggattatcaaatctagttgggcaaatgtatggtgtagctggatggcttacattagctattcttggtgctattatgccatttattgttatgactggaatgcattgggcttttgcacctatttttttggcggcatctattgctactccagacgtattaattcttccagcaatgttagggtcaaacttagctcaaggggctgcttcgatggctgttgcattaaagagtaaaaataataatacaaaacaaattgcttttgcagcaggtttctcagccttacttgcagggattaccgaacctgcattatatggtgtgactttaaaatataaaaaaccgctttatgcagctatgattggtggtggattagcgggattatttgcaggtcttactagtgttaaagcatatctatttgctgtcccatctttgatagcgttgcctcaatttatttattctgatgtgccatcaaatattgtaaatgctttaattgtggcggtcatttcggttgttattacctttgtattagcttatatatttggaatcgatgaagaagagagttctagcaatttagaagttaaagctggagtttcaaataaaaaaatgatattttctcctatatcaggagaaatcattccgttaagcgatgtccaggataaaacattttcagataaactaattggagacggagtagcgattatcccaagtgaaggtaaggtttatgcaccatttgatgggaaaattacaaatatttttccgactaagcacgcaattggattgaagagtgatgagggtgttgagttactaattcatattggattagatactgttgagctaaaaggtcaaggttttattagtcatgtagaagaaggagacagagttttcaaaaatcagttgatttttgaaatggacttgaatttaatcaagactaaaggctacgaaacagttacaccagtaattgtaacgaataccaatgattttctagatgtattagtattacctaataatcagacaatcgagcattctaaggaattactggtaatattataa

SEQ ID NO: 251 - DNA, 1416 bp, Streptococcus pneumoniae
atgaccatttttccagatgattttctttggggtggagctgttgcagctaatcaagtagagggagcatataatgaagatggtaagggcttatcagttcaggatgtgttacccaaaggtggattaggagaagcaacagaaaatcctacagaagataacttaaaattgataggtattgatttttatcataaatataaggaagatatatccttgttttctgaaatgggctttaatgtttttcgtacttctattgcatggagtagaatttttccaaaaggagatgaagaagaacctaacgaagctggtttgaaatattatgatgaattgtttgatgaactacatgctcacgggatagagccacttgtaactctttcacactatgagactccattatatttagcaagaaaatatcatggatgggttgataggagaatgattcatttttatgaaaaatttgctcgaacagttttagaaaggtataaagataaagttaaatattggcttacatttaacgaagtaaactctgttttggaattaccatttactagtggaggaatagatatacctaaggagaatctttcgaaacaagaattatatcaagctatacatcatgaattagtcgcctcaagtttggttacaaaaattgctcgtgagattaattcagagtttaaggtgggatgtatggtattagctatgccagcttatccaatgactccaaatccaaaagatgtatgggcgactcatgagtatgagaatctaaattatctattttcagatgtgcatgttagaggttattatccgaattatgcaaaaagatattttaaggaaaatgacattaacatagagtttgcagctgaagatgcagagttattaaaaaattatactgtagattttttatcctttagctattacatgagtgtgactcaatctgctattccaacacagtataattcaggagaagggaatattattggtggtttagtaaatccttatttagagtcttcagagtggggatggcaaattgatccaattggactacgtataattttaaatagatattatgaccgttatcaaatcccattatttatagtagaaaatggattaggtgctaaagatcaactaataaaagatgaacttaataacttaaccgtccaagatgattatagaattcagtatatgaaagaacatttattgcaagttgctgaagctctacaggatggtgttgaaattatgggctatacgtcttggggatgtattgactgtgtttctatgtccactgcacaactttctaaaaggtacggtctcatttatgttgatcgaaatgatgatggaaatggcacattcaatcgatataagaaaatgtcctttacttggtataaaggagtgattgaatcaaatggagaatccttattcaaatag

SEQ ID NO: 252 - DNA, 1047 bp, Streptococcus pneumoniae
atgtcaactattgaagaacaattaaaagcgcttcgcgaagaaacgctggctagcttgaagcagattactgctggaaatgaaaaagagatgcaagatttgcgtgtctctgtccttggtaaaaagggttcgctcactgaaatcctcaaagggatgaaagatgtttctgctgagatgcgtccaatcatcgggaaacacgtcaatgaagctcgtgatgtcttgactgctgcttttgaagaaacagctaagctcttggaagaaaagaaagtcgcggctcaactggctagcgagagtatcgatgtgacgcttccaggtcgtccagttgcgactggtcaccgtcacgttttgacacaaaccagtgaagaaatcgaagatatcttcatcggtatgggttatcaagtcgtggatggttttgaagtggagcaagactactataactttgaacgtatgaaccttccaaaagaccacccagctcgtgatatgcaggatactttctatatcactgaagaaatcttgctccgtacccacacgtctccagttcaggcgcgtgctatggatgcccatgatttttctaaaggtcctttgaagatgatctcgccagggcgtgtcttccgtcgcgatacggacgatgcgacccacagtcaccaattccaccaaatcgaaggcttggtagttgggaaaaatatctctatggctgatcttcaaggaacgcttcagttgattgtccaaaaaatgtttggtgaagagcgtcaaattcgtttgcgtccatcttacttcccattcacagagccatctgttgaggtggatgtttcttgcttcaagtgtggtggagaaggctgtaatatatgtaagaaaacaggttggatcgaaattatgggggccggtatggttcacccacgtgtccttgaaatgagtggtatcgatgcgactgtatactctggctttgcctttggtcttggacaagagcgtgtagctatgctccgttatggaatcaacgatatccgtggattctaccaaggagatgtccgcttctcagaacagtttaaataa

SEQ ID NO: 253 - DNA, 993 bp, Streptococcus pneumoniae
ttggtagaatccacggatatcgttgattccataacggagcatagctacacgctcttgtccaagaccaaaggcaaagccagagtatacagtcgcatcgataccactcatttcaaggacacgtgggtgaaccataccggcccccataatttcgatccaacctgttttcttacatatattacagccttctccaccacacttgaagcaagaaacatccacctcaacagatggctctgtgaatgggaagtaagatggacgcaaacgaatttgacgctcttcaccaaacattttttggacaatcaactgaagcgttccttgaagatcagccatagagatatttttcccaactaccaagccttcgatttggtggaattggtgactgtgggtcgcatcgtccgtatcgcgacggaagacacgccctggcgagatcatcttcaaaggacctttagaaaaatcatgggcatccatagcacgcgcctgaactggagacgtgtgggtacggagcaagatttcttcagtgatatagaaagtatcctgcatatcacgagctgggtggtcttttggaaggttcatacgttcaaagttatagtagtcttgctccacttcaaaaccatccacgacttgataacccataccgatgaagatatcttcgatttcttcactggtttgtgtcaaaacgtgacggtgaccagtcgcaactggacgacctggaagcgtcacatcgatactctcgctagccagttgagccgcgactttcttttcttccaagagcttagctgtttcttcaaaagcagcagtcaagacatcacgagcttcattgacgtgtttcccgatgattggacgcatctcagcagaaacatctttcatccctttgaggatttcagtgagcgaaccctttttaccaaggacagagacacgcaaatcttgcatctctttttcatttccagcagtaatctgcttcaagctagccagcgtttcttcgcgaagcgcttttaa

SEQ ID NO: 254 - DNA, 510 bp, Streptococcus pneumoniae
atgattataaaagtagaaatggcagatgttgaggtgttggctaaaattgccaaacaaacctttcgtgaaacctttgcgtatgataatacggaagagcagttacaggaatactttgaagaggcttatagtctgaaaactttgtcaactgagttgggaaatcctgactctgaaacctatttcattatgcatgaggaggagatagctggttttctcaaagtcaactggggaagtgctcaaactgagagagaattagaggacgcttttgaaattcaacgcctctatgtgctacaaaaattccaaggatttggactaggtaagcaactgtttgaattcgcacttgaacttgctacaaaaaatagtttttcttgggcttggctaggtgtttgggagcataatacaaaagctcaagccttttataatcgatatggttttgaaaaatttagccaacatcattttatggttggtcaaaaagtagatacggattggttactgagaaagaaattaaggtaa

SEQ ID NO: 255 - DNA, 2403 bp, Streptococcus pneumoniae
atgcttatatcttataaatggttaaaagaattggtggacattgatgtgccatcacaagagttggctgaaaaaatgtcaactacaggaatcgaggtagagggtgtcgaatcaccagctgctggtctctcaaaaattgtcgtcggtgaggtcttgtcttgcgaagatgtgccagagactcacctccatgtttgtcaggttaacgttggcgaagaagagcgtcagatcgtttgtggtgccccaaatgtgcgtgctgggatcaaggtcatggtggctcttccaggagctcgtatcgctgataactacaaaatcaaaaaaggaaaaatccgtggtttggagtcacttggaatgatctgttcacttggtgaattgggaatttctgactcagttgtgcctaaggaattcgcagatggcatccaaatcttgcctgaagatgccgtgccaggtgaggaagtcttttcttacctagacttggatgatgaaatcatcgaactttccatcacaccaaaccgtgcagatgccctttctatgtgtggagtggctcacgaagtggcagccatctatgacaaggcagtcaactttaaagaatttactctaacagaaactaatgaagctgcggcagatgccctttctgtcagcattgagacagacaaggcgccttactatgcagctcgtatcttggacaatgtgaccatcgcaccaagtccacaatggttgcaaaaccttctcatgaacgaaggaatccgtcccatcaataacgtagtggacgtgaccaactacatcctgctctattttggtcaaccaatgcatgcctttgacttggataactttgaagggactgacatccgtgtgcgtgaagcgcgtgctggtgaaaaattggtgaccttggacggtgaagaacgtgacttggacgtgaatgacctagtcatcactgtcgcagacaagccagtagcccttgcaggtgtcatgggtggtcaagcaacagaaatctctgaaaaatctagtcgtgttgtccttgaagctgctgttttcaatggcaaatctatccgtaagacaagtggtcgcctgaaccttcgttctgagtcatcttctcgctttgaaaaaggaattaatgtggcaacagttaatgaagcccttgatgcggcagctagcctgattgcggaacttgcaggtgcgacggtgcgtaagggcatcgtttcagcgggtgagcttgatacttcagatgtagaagtttcttcaacccttgctgatgttaaccgtgtcctcggaactgagctgtcttatgctgatgtagaagacgtcttccgtcgtcttggctttggtctttctggaaatgcagacagctttacagtcagagtcccacgtcgtcgttgggatatcacaatcgaagctgacctctttgaagaaattgctcgtatctatggttatgaccgcttgccaactagtctaccaaaagacgatggtacagcaggtgaattgacagccacacaaaaactccgccgtcaagttcgtactattgctgaaggagcaggtttgacagaaatcatcacctatactctaacaactcctgaaaaagcagttgagtttacggctcaaccaagtaaccttacggaactcatgtggccaatgactgtggatcgttcagtcctccgtcaaaatatgatttcaggtatccttgataccgttgcctacaacgtggctcgtaagaataaaaacttggccctttacgagattggaaaagtctttgaacaaacaggtaatccaaaagaagaacttccaaatgaaatcaacagttttgcctttgccttgacaggcttggttgctgaaaaagatttccaaacagcagcagttccagttgatttcttctatgctaagggaatccttgaagccctatttactcgtttgggactccaagtaacctatacagcaacatctgaaatcgctagccttcatccaggtcgtacagccgtgatttcactcggtgaccaagttcttggtttccttggccaagtgcatccagtcactgccaaggcttacgatattccagaaacgtatgtggctgagcttaacctttcagctatcgaagctgcgcttcagccagcgactccatttgtagaaatcaccaaattcccggcagtcagccgtgacgttgcccttctcctcaaggcagaagtgactcatcaagaagttgtagatgctatccaagctgccggcgtgaaacgtttgacagatatcaaactctttgacgtcttctcaggtgagaaattgggacttggtatgaagtcaatggcttatagcttgaccttccaaaatccagaagatagcttaacggacgaagaagtcgcacgctatatggaaaaaatccaagcatcgctcgaagaaaaagtcaatgcagaagtgcgttaa

SEQ ID NO: 256 - DNA, 888 bp, Streptococcus pneumoniae
ttggcacagatttatgccttccccttagctactgcaactatggctgctattttaagtttcttattttttttcctatctttttacaagaaaaataaacaaatacggttttactctggcattttgctcttactatcgctcatattactattattcggaacagataaaaccctttcttctgcatcaaataagactaaaaccttaaaattagtaacttggaacgtcgctaatcaaatagaagcacaacatattgagcgaatttttagccattttgacgccgatatggctatattccctgaactagctaccaatatcagaggtgagcaagaaaaccagagaatcaaactattgtttcatcaagttggactttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgctcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgcactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaa

SEQ ID NO: 257 - DNA, 447 bp, Streptococcus pneumoniae
atgttaagattagaagatgggaaaaaagaaggaaaatcaaatagagaaattgcctctctacttggaaaagctcctcaaactatccatactgaaatcaagtatgggacagtccgaaaatgtcttggaaaagggcgcttcaaagaggtttattctgccgactatgctcaacagtcttatgaaaataatcgcaagcactcggtcaagagatcaagcttgaccaaggaactaaaggaaaagattctccactatcataaccaaaaatttttgcctgaaatgatggtgatggctaaaggggttaacgtgggaatttcaaccatttactattggattcatcatggaaagttggggttaagcaaacaggatttgctttatcctagaaaaggaaaatctgttaagaaacaagttagtcccaattttaaacccgctgatcaatctatcgaatcataa

SEQ ID NO: 258 - DNA, 267 bp, Streptococcus pneumoniae
ttggaaggatgtctatctgagctctttagcaaggaggaaatccttgaaagtgatatgcgagtagctatcatgagcgagttgattgaagccagaaataagcaaggaatcagtcagaaaaagctagaggaagtcagtggagtgagtcagcctgttatagctaggatggagacaggtaagactagtccacagttggacacagtcttaaaagtcctagctagtctaggaaagacactagcagtcgttccacttgaacagggaaaaagttga

SEQ ID NO: 259 - DNA, 297 bp, Streptococcus pneumoniae
tttgaaactatatatctgtttcggacaaaagaaaaagacttgaagcaaacgtctcaaatcctttgtatagcttgttttatagctttatttcagttagacggttcaaacgcgttattagtaattcttataagtgactatggcttgttattagaaaagactataactgattctagtcaactttttccctgttcaagtggaacgactgctagtgtctttcctagactagctaggacttttaagactgtgtccaactgtggactagtcttacctgtctccatcctagctataacaggctga

SEQ ID NO: 260 - DNA, 2250 bp, Streptococcus pneumoniae
atgtcaactacaatcgtcggtttccctcgtttgggcgaattccgtgaattaaaatttacaactgaaaaatactttagaaaagaaatctcagaagaagaacttttagcagcagcaaaagacttgcgtgctaaacactggaacattgtcaaagaaaaaggcatcactgaaattccatcaaatgacttttctcactatgataacttcctagatgcggctttccttttcaacgtggtgcctgcatccgttcaaaacttggacttgtctgaccttgagcgctacttcgctttgggacgtggttaccagggagaaaaaggggacgttcgcgccctcccaatgaagaaatggtttaacactaactaccactacatcgttcctaaatttgaaaaagacactcaagtaaaattggctggtcacaagatttttgatgagttccaagaagccaaagaaattggattgaacactcgtcctgttcttgtaggtcccttcactttccttcaattgtcagactttgaagaaggcgtgaaagcagacgacttcgtagatagcttagtggctgcttaccaagaagtttttgctaaattggctgaacttggtgcgacttgcatccaattggatgaagcggctcttgtaaaagacttgacagctgaagaaaaagctctcttcttgaatctttacaacaaactcttggctgacaaaaaaggtcttgaagtcttgcttcaaacttatttcggtgatgttcgtgacgtatacgctgaccttgtaaacttgccagtagatgctatcggttttgactttgttgaaggtaagaaaactcttgaactcgttaaaggtggcttcccagctgacaagactctctatgcaggtattgtcaatggtaaaaacatctggcgcaacaactatgaaaagagcttggctgttcttgagcaaatcccagctgaaaacatcgttttgacaagctcttgctcacttcttcatgtgccatttacaactgctaatgaagaatttgaaccagcactcttgaaccactttgcctttgcagttgaaaaattggatgaaatccgtgacttggatgctatccgcaatggtcaaggttcagaagctcttgcagccaacaaagaactctttgcgactgagcgtgttggtgaaaatgctgaacttcgtgcgcgtatcgctggcttgacagacacagactacactcgtttgccagcctttgcagaacgtgaagctatccaagaagaagctttcaaacttccagctcttccaacaacaacgattggttcattccctcaaacaaaagaagttcgtgccaaacgtttggcttaccgtaaaggtgaattgtctcaaaaagagtacgatgctttccttgctgaaacgattgacgaatggatcaagtggcaagaagatattgactttgatgtccttgttcacggtgaatttgagcgtaatgacatggttgagtacttcggtcaaaacttgtcaggatacctcttctctaaaaatggatgggtacaatcatacggtatgcgtggggtaaaaccaccaatcatctggggtgatgtcactcgtcttaaccctatcactgttaaatggtctagctatgcacaaagtcgtacaaacaaacctgttaaaggtatgttgactggacctgttaccatccttaactggtcattcccacgtgaagacatctctatcaaggattcaactctccaaatcgcccttgctatcaaggatgaagtacttgaccttgaagctgctggtgtgaaaatcatccaaatcgacgaggctgctcttcgtgaaaaattgccactccgccgtagcgactggtacgaagactaccttgactgggctattcctgccttccgcttggtacactcaacagtagcgccagacacacaaatccacactcacatgtgttactcagaatttacagatatcatcccagctatcgataacatggatgcagacgttatttcctttgaagctagccgttcaaaccttgaaatcttggacgaactcaaagcgaaaaacttccaaacagaagtgggacctggggtttacgatatccactcacctcgtgtaccaaatgaaggcgaaatcgacaacacaatcgaagccatccttgctaaagtgccaagcaagaaagtttggatcaaccctgactgtggtttgaaaacacgtggtatcccagaaacaaaagaaagcttgatccgccttgttgaagcagctaaagctgcgcgtgagaaattgtaa

SEQ ID NO: 261 - DNA, 867 bp, Streptococcus pneumoniae
atgtcacgccaaacaccgtcactctcatttgaagtgttccctccaaacccagccgtgggtaatggtaacattatttcagccttgcaggatatgcaggagttggctccccattttatcagtgtaactgccagcaataataaatttaatatcaaggaaacgacggttcgtttggctgactttatccaaaatgatttggcgattccgaccattgcccacttgccagctatttatctaactaaggacaaggttgctgaaactattgctgacttggacaaagttggggtgcagaaaatcttggctcttcgtggggatattattccagacgtggaaccacaaaaggatttccgctatgcaaccgacttgattgagtttatcaaggaacaaacccctcactttgatattattggagcttgctatccagaagggcatccagattcgccaaatcagatttcagatattcaaaatcttaagaagaaagtggatgcaggctgttcgagcctcgtaactcagctcttctttgacaatgagcgcttctatgattttcaggacaagtgcatcttggctgggattgatgttcccattcatgcaggaattatgccaattctgaatcgaaatcaggctctccgactcttgaagacttgtgagaatatccatcttccacgcaaatttaaagccatcttagacaagtatgagcatgaccctgaatcgctcagagcagcaggacttgcctatgcagtggaccaaatcgtggacttggtaactcaggatgttgccggtgtgcatctctatacgatgaataatgctgatacagcaaaatacatccatcaagcaacccatgccttgtttaatcaccagtctctaggataa

SEQ ID NO: 262 - DNA, 270 bp, Streptococcus pneumoniae
gtgctaggaagcttatcttttttcctaagaaatgagaccaaaattcaattactcaagatgctaagccgtcaagcaactcaaaggaaaataggaaatcgaacgacggagcgactgctcctaggcagatttatctttttccacagagttgtaggcgtgttcagttttcaagatacatcattagaaagatttaatattaaagtatctaaacctttcacgctaatcgctatcgggcgattagctaaatgctttactaactctctcgtcaaataa

SEQ ID NO: 263 - DNA, 2214 bp, Streptococcus pneumoniae
atggcaaaacaagtgtttcaaacgacttttgcgggtcgtgagttaattgtagagactggtcaggttgctaagcaagcaaatggctctgttgttgtacgttacggtgagtcaactgtcttgactgctgccgttatgtctaagaaaatggcaactggggatttcttcccactccaagtcaactacgaagaaaaaatgtatgcggctgggaagtttcctggtggctttatgaaacgtgaaggacgtccttcaacagatgcgaccttgacagcgcgtttgattgaccgtccgattcgtcctatgtttgcggaaggtttccgtaatgaagtccaagtcatcaatacagtgctttcttatgatgaaaatgcatctgcaccaatggctgctatgtttggttcatctttggcactgtctatttcagatattccatttgacggaccaattgctggggtacaagtgggatatgtagatggccaaatcatcatcaacccaagtcaagaacaagcagagcaatctcttcttgaattgacagtagctggaaccaagcacgctgtcaacatggtagagtctggtgccaaagaattgtcagaagaaatcatgttggaagcgctccttaaagggcacgaagctgtcaaagaattgattgccttccaagaagaaatcgttgctgctgtcggtaaagaaaaagcagaagtggaattgcttcacgtggatgctgaattgcaagctgaaatcattgcagcctacaacagtgacctccaaaaggcagttcaagtagaagagaaattggcccgtgaagctgcgactcaagtagtgaaagaccaagtgactgccgtttacgaagaaaaatatgcggaccacgaagaatttgaccgtattatgcgtgatgtggctgaaatcttggaacaaatggaacacgcagaagtgcgacgtttaattacagaagacaaggtgcgtcctgatggtcgtaaggtcgatgaaatccgtcctttggatgcggttgtcgacttccttcctcgtgtacatggttcaggtctctttactcgtgggcaaactcaagctctttcagtcttgaccttggctccgatgggagaaactcaaatcattgatggtttggatccagagtacaagaaacgctttatgcaccactataacttccctcaatattctgtaggggaaacaggtcgttacggtgcgccaggtcgtcgtgaaatcggtcacggtgcccttggtgagcgtgctcttgctcaagtcttgccaagcttggaagaattcccatacgctatccgtctagtagcagaagttttggaatcaaacggttcttcatctcaagcttctatctgtgcgggaactcttgcccttatggctggtggtgtgccaatcaaggcgccagtagctggtattgctatgggacttatctcagatggaaataactacacagtattgacagatatccaaggtttggaagatcactttggagatatggacttcaaggttgcaggtactcgtgatgggattacagcccttcaaatggatatcaagattcaagggattactgcagaaatcttgacggaggctcttgctcaagccaagaaagcgcgttttgaaatccttgatgtcattgaagcaaccattccagaagttcgtctagaattggctccaactgctccgaaaattgatacgatcaagattgatgtagacaagattaagattgtcatcggtaagggtggagaaaccatcgacaagattatcgctgaaacaggtgttaagattgatatagacgaagaaggaaatgtgtctatctactctagtgaccaagatgctattaaccgtgccaaagaaattattgctggtttggttcgtgaagccaaagtggatgaagtttaccgtgctaaagtcgttcgtatcgagaaatttggtgcctttgttaacctctttgataagacagatgcccttgttcatatctctgagatggcttggactcgtaccaatcgtgtagaggatttggtagaaatcggggatgaagttgatgttaaggttatcaagattgatgaaaaaggccgtatcgatgcctctatgaaggctcttctacctcgtccgccaaaacctgagcatgatgaaaaaggtgaaaagtctgagcgccctcaccgcccacgtcatcacaaggatcacaaacctaagaaagaatttacagaaacaccaaaagattcagagtaa

SEQ ID NO: 264 - DNA, 618 bp, Streptococcus pneumoniae
atggggtggtggcgcgaaaccattgatatcgtaaaagaaaatgatccagcggcccgcaccactttggaggttttgctgacttatccaggtgtcaaggccttggcggcccaccgtctctcgcattttctctggaagtacgacttcaaactcttagctcgtatgcacagtcagttttggcgcttttggactcagattgagattcatccaggagcccagattgattcaggtgtctttattgaccatggttctggtctggtgattggagagacagcgattgttgaaaaaggcgttcttctctatcacggagtgactctcgggggaacagggaaagactgtggcaaacgccatccgactgtacgaaagggagccctcatatcagcccatgcccaagttatcgggcctgtggaaattggtgaaaatgccaaggtcggtgctgcagcagttgtcgtagcagatgtacctagtgatgtgacggttgtcggtattccggccaagattgtccgtcttcatggtaagaaagatgagcctgttattcacgaagtcgaagaaaaacgggagtattatgtcaataaactcgagcaggctaaagatgccagtcacagatcgtctggtttgtag

SEQ ID NO: 265 - DNA, 885 bp, Streptococcus pneumoniae
atgattcaagcaagaaacaagttaagccaagaagagctatctgaggcgaaaaaagtaattaactgttgccaaaactatgacggtacctatcgcgatccctatctctctaacatgcttaattttgatccaaacatgcccgcctttttcctttattatgaaaaaggcgaacttgttggtttattaactgtctatgcagatgaccaagatgtagaagtgacgatactggttcatccaggtcatcgccgtcaggggattgcgcgtgcattgtttactagttttgagagagaaacagcttctttccccattcggtcagtcacttttcagacagaacgtatttttttagagaatcatcctgactttgccagtaactggggactaatcgaggatgaagagacagaaacctggttaggtaaggatagaagaccatatcagttagcaaaactttctaatcttgaagttttgttagcagatagttcgtatcaggagcaaattagccagttaaaatttcaggcattttcaggggaacatgaatcgagagaagttgtggatagatatgtcgctgaagctctgaaggatccagaaagtcgcttatatattttgttaaaagacggtcaggttattgggacttgcacggttgatttatcgagcgatacgaattacttctacggtttagcaatatcagaacctgaacgtgggaaaggctatggaagctacttagcaaaatcccttgtcaaccaactaattgagcaaaatgataaggaatttcagattgcagtggaagatagcaatgtaggtgccaaacgtttgtatgaaaaaattggctttgtcaaacagacacaggtggtttatctgaatgagaaaggagcaagggattccgaagtgtag

SEQ ID NO: 266 - DNA, 456 bp, Streptococcus pneumoniae
gtgggatttttctacacggaaatagacatccccttgactctcataggcaaagcctttctcgatcaagtcttccacaaaacggatgatgtctgccataaactccactacacgcggatggcgagtcgcaggtttcacgcccaatgccgtcacatcctcacgaaaggcagcgatgtacttatccgcaacctcctgaggtgtgatgccttcttccctggcacggttgataatcttatcatccacatctgtaaaattggaaatataggcaaccttatacccacggtactcaaaatagcgacgaatcgtatcaaaagctaccgtcgaacgggcgtttcccacgtgaatatagttgtacacggttggcccacaaacatacatcttgatcttgccgtcctcaatcgggacaaattctcgcaaatcacgagacatggtgtcatagattttaatcataaatcataa

SEQ ID NO: 267 - DNA, 1344 bp, Streptococcus pneumoniae
atgattaaaatctatgacaccatgtctcgtgatttgcgagaatttgtcccgattgaggacggcaagatcaagatgtatgtttgtgggccaaccgtgtacaactatattcacgtgggaaacgcccgttcgacggtagcttttgatacgattcgtcgctattttgagtaccgtgggtataaggttgcctatatttccaattttacagatgtggatgataagattatcaaccgtgccagggaagaaggcatcacacctcaggaggttgcggataagtacatcgctgcctttcgtgaggatgtgacggcattgggcgtgaaacctgcgactcgccatccgcgtgtagtggagtttatggcagacatcatccgttttgtggaagacttgatcgagaaaggctttgcctatgagagtcaaggggatgtctatttccgtgtagaaaaatcccacaactatgctaaattggctaataaaaccttggaagatttggagctaggtgcttcaggtcgtaccgatgaagaaacggctcgtaaggaaaatcctgtagactttgctctatggaaatcttccaaaccaggtgagatttcttgggatagtccttggggacctggacgtccgggttggcatattgagtgttcagtcatgtcgacagagattttaggtgataccattgatatccacggtggtggagctgacctagagtttccacaccacaccaatgaaattgcccagtctgaagctaaaacaggcaaggcttttgctaactactggatgcacaatggctttgtcaatatcgacaatgtcaaaatgtctaagtccttgggtaacttcattacggtacacgatgcccttaaaactcttgatgggcaagtacttcgtttcttctttgcgacccagcactaccgtaagcctatcaacttcacggaaaaggcagttcgcgatgccgagaccaatctcaagtatctcaagaatacttacgaacaaccatttacaggaaatgtggatgcccaagagttacaaaactttaaagataagtttgtagcagctatggatgaagattttaatgctgccaacggtatcacagttgtctttgaaatggccaaatggatcaactcagggaactatgatgcaagtgtcaagcaagctcttgcagatatgttagaaatttttggaattgtctttgttgaggaagttttggatgcagagattgaagacttgattcaaaaacgccaagaggcgcgtgccaatcgtgactttgcgacagcagaccaaatccgtgaccaattggttactcaaggaattaagctccttgataccaaggatggagtgaggtggacacgtgattga

SEQ ID NO: 268 - DNA, 387 bp, Streptococcus pneumoniae
gtgattgatgtcaatctcattaacgggattgcgctagcctttgagggggatgcggtgtattctatgtatattcgccgtcacctcatcctcaaaggtatgaccaaacccaataaactccatcaagaagcaactaagtacgtgtcagccaaggctcaggctcgcctgattgctctcatgttggaggagcaggtcctaacggaaaaagaagaagaaatctacaaacgtggccgcaataccaatagccacacaaaggctaaaaatgcagatgtcgtgacttatcgtatgtccacgggatttgaagcggttatgggctatctccatatgactgagaatctggaacgtcttgagagtttggtttcatggtgcatccaaaaagtggagggctag

SEQ ID NO: 269 - DNA, 885 bp, Streptococcus pneumoniae
atgagggcaaaagaactacaagactggtttcctgaggctcggatttcagaccaaccagtagagaaagagggctatctcacgctccctttagcttctcagcagtggattttgctggaggaagctgggctcagcgagcgtgaaaagcagttggttgcccttttgacccagcaggagcaggctcgttcgctaaacccttggtattcctatctggttgagggcaagggacaggcaccgcaagtttttaaaaagattcagttggtttattgccatctttcttattttcagcaggaaaatctggcttcttggctagatatgatgcggactctttttccgaattgtcagacagtgctacaggtcggagctcaggattatgttttcgtgcttcaacaagacaaatacacttctgtaagagatattttaagtgatacgattgaagcggttgagtatgactttggacttcgtctttctatcatgttgggtcaggtttggtctcagacgggacatcaagccctatcagacttaatcaaagctgagcgggatttgttcaagacatggtggcgtcagggtcaccaaggtgttcatactttttctcagctctatctttggagtatgggagaaagactcgtggacttgaagccaatcaaggaatgtctacaccagatgattttggatcaagatcagattcaggaaatcattctctctctttgggaaaatagtgctgttctcactaaaacagcccagcaactctatctgcaccgcaattctctccaatacaagattgataaatgggaagagttgacagggcttcagttgaaagagttgaccgacctgaccttgtgttatcaattgattttaggttctttgtcaactatagttggtttgtaa

SEQ ID NO: 270 - DNA, 264 bp, Streptococcus pneumoniae
atgggaagagttgacagggcttcagttgaaagagttgaccgacctgaccttgtgttatcaattgattttaggttctttgtcaactatagttggtttgtaaagaagttaatatttggagaagaggattgctatcttctccatttttatgtgcagagttatagtggcttgatgctgggaaagtacactgtgactgctaaaacattcctagaagttgctttgatttacctaatctatttatgcaaattttatgttattttactataa

SEQ ID NO: 271 - DNA, 600 bp, Streptococcus pneumoniae
atgcaaattttatgttattttactataacagttgttgctaatccaaataatagtggggaagttcatttagatgtaagcattgaagataatcagggaggtagtgggtataatttcagttctgtttcaagtagctcacaaacagctaaatatgaaggagctggttataataacaattcatcattatatataacgattgataaaacgtctgatgcaacagctcttttgaaattaaagttgaataatgttaataatcaacctgctactgaagttcctagttcaggaattactgtaaaattaaatgctaaagataatgctggaaactggacaagtgcttcgaataaaaaagaagtaacagtaaaaattgtttctgctaaaccgacatatccagacaaaattttagtgaaaaatcctgataatataaaagatacagaaaaaaatgccattattgaaaaattgaaagaggcaaataaaaatcatccagcaggagctccaacctttgctaaaggtgaaggagagcatgcaaatgatattgtagcaacttattcagatggtacaacttattatgtaccgttaaatgatgtgacaaaatatgcgaggtag

SEQ ID NO: 272 - DNA, 156 bp, Streptococcus pneumoniae
ttgactcaattcacacctcactgcttagacagactcttccaatcgtctgctttagttagcctactgcgtccctccatcactacatactctagtacaggaatatcaacctgttgtccatcggatacacctttcggtctctccttaggtcccgactaa

SEQ ID NO: 273 - DNA, 246 bp, Streptococcus pneumoniae
atgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaa

SEQ ID NO: 274 - DNA, 234 bp, Streptococcus pneumoniae
gtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtag

SEQ ID NO: 275 - DNA, 216 bp, Streptococcus pneumoniae
tgtagcggttatcacgtcgccctgtcacggcgaagatcgcgggttcgattcccgtcgggaccgtttaaggtaacgcaagttattttagactcgttagctcagttggtagagcaattgacttttaatcaatgggtcactggttcgagcccagtacgggtcatatatgcgggtttggcggaattggcagacgcaccagatttaggatctggcgcttaa

SEQ ID NO: 276 - DNA, 189 bp, Streptococcus pneumoniae
ttggtagagtacttggtttgggaccaaggtgtcgcaggttcgaatcctgtcttcccgattcatggcggtgtagctcagctggctagagcgtccggttcatacccgggaggtcgggggttcgatccccttcgccgctataatgatcttgtcggacctttagctcagctggttagagctctcggctcataa

SEQ ID NO: 277 - DNA, 936 bp, Streptococcus pneumoniae
atgaaatcctaccaagctgtctaccaaatcctatctaaagaaaccgactatatcagcggagaaaaaatcgcagaaaaactatccctaagccgaacagcaatttggaaagccatcaagcgactagaacaagaaggcattgaaattgatagtatcaaaaatagaggatataaactgatgaatggtgaccttattcttccagagattctagaagaaaatcttccaattaaagtcagctttaaacccgaaacaaaatcaacacaactagatgcaaaagaagcaattgatttaggccatgaagcaaataccctctatctagcttcctatcaaacagcaggccgaggccgttttcaacgttccttctactcaccacaaggtggtatttatatgacactccatcttaaaccaaatctcccctatgacagattaccatcctacacactacttgtagctggagctgtctacaaagccattaagaacctaactttaatagatgtcgacataaaatgggtcaatgatatctatctaaacaatcataaaattggaggaatccttactgaagcaatgacctctgtagaaactggcttagtcacagatatcattattggagtaggtatcaatttcactattaaagacttccctcaggaattaaaagaaaaagctgccagcttatttaaagctacagctcctataacaaggaatgaattgatcatagaaatctggcgtgctttcttcgaaacaccagcagaagagctattatacctatacaaaaaacagtcattcattctaggaaaagaagtcactttcacactagagcaaaaagactacaagggacttgctaaagacatctcagaaaatggaaaacttttagttcaatgtgataacggaaaagaaatctggctaaatagtggcgaaatttctctcaatagttggaagtaa

SEQ ID NO: 278 - DNA, 861 bp, Streptococcus pneumoniae
atgttagttttttcagaataccagactggaacaatcgaccttgccctaagcttttatggatatgaggaatgcacacctaattactcttttggtccagccattcgtgatacatacgttctacattacattactaaaggacaaggaaaattttattacaagggtaaaattgttgatttaaaagaaggagatttctttctattaaaaccagaggaactaaccttttatcaagcagatagtaaagaaccttgggcctactactggttaggaatcactggagggaaatcccctgattattttgctctttctcaaatttctgatcaatcctatctcatccaatctgaaacttgtcatacccagactactgcaaaactcatctcagacattgtccgcttcgctcagattacaaaatcaagtgaattagctcaactccatatcatgggacaacttcatgaactgatgtttcatctgggaactattgctcccaatcagaaaaaaaagaatatttcatcaacccaccaactctatcttgaatgcaaacgattaattgatagccactatcctcaatcacttacaattcaagatttagcaaaagaactatccgttcacagaagctacttatcaagcgtattcaaagaatttaataccttatcacccaaagaatacctactctacgttcgaatgcaccgagctagacaacttctcgaaaatacccaagagtccatcaaggtaattgcatactcggtaggtttttcagatccactccatttttcgaaagcttataaacaatactttaatcagactccaagtcatacaagaaaagaatactctcaataccaactagtaagaaaggcaacattatga

SEQ ID NO: 279 - DNA, 2163 bp, Streptococcus pneumoniae
atgggagttaggatagagaataatctattttatgttgagagtaaaaatctaagtttgattattgaaaatcgaaatggctacttacttttgaaacatttaggaaagactattaagaactataaaggttccaatagtgtttatgaacgagaccatgccttttcaggaaatccaacggctactaatcgaacctttagtttagatactcagcgacagatttttggacaacatggcttaggagattttaggaaaccaaccatacaggttcagcatagtgtaactgaagtaacagactttcgatttgtagaagcaaagattttaaaaggtcagaatggtccacagggcttaccttctccacatagcatggacgatacagagactcttgtcttaatgttagaagattctaaggctcaacttagtctgactttgtattatactacttttaataatgatgcgactattgctagctacagtaaattagataataatagtaatcaggaagttgtcatccataaagatttttcttttatggctgattttccagctgcagattacgaaatagtaactctgcagggtgcttatgctcgtgaaaagactgttagacgtcaacaggtagaacaaggaatcttttcgattagctcaaaccgaggtgcttctggtcatgctcaaacaccagctcttctactatgcgaacaaggagtcacagaggatgctgggaatgtgtttgctattcaactaatgtatagtggcaactttgaagcttttgttcaaaaaaatcaattgaatgaagttcgggtggctattggcattaatccagaaaacttttcttggaagttagcccctgaggaatactttgaaacaccggtagctttagtgactcattcagatcagggattaactggtattagtcatgaaagtcagaattttgtactgaagcacattattctaagtgaattttctaaaaaagaacgtccaattctaatcaataactgggaagctacttactttgactttcagagagaaaaactgttagagttagcagatgaagctaagaaagttggcattgaactttttgtattagatgatggttggtttggcaatcgttttgatgataatcgtgctttaggtgattgggttgttaatgaggaaaaactgggtggaagtctagaaagtctgatttcagctatccatgaaagaggtttgcagtttggactttggttagaacccgaaatgatttctgtagatagtgatttgtatcgtcaacatcctgactgggctattcaggttcctgattatgagcatacttattctcggaatcaattagtacttaatcttgccaatcctcaggtagtagaatacttgaaaagtgtcttagatcaactcctatcttatcatgagattgattacattaaatgggatatgaaccgcaatatcactaagctagggaatggattaacttatctagagacacagatgcaatctcatcagtacatgctggggctttacgaactcgtttcttatctgacagagaagcacagccatattctctttgagtcctgctctggtggtggtggacgaaatgatcttggtatgatgcgctatttcccacaagtctgggctagtgataatacagatgctattgcacgtttaccaattcaatacggttcatcctatctctatccaaccatttctatgggggctcatgtgtcagcagtaccgaatcatcagatggggcgaacgacaccattagaaacacgtggacatgtagcaatgatgggaaatttgggctatgagcttgatttgacaagtttatcagatgaagagaaagctgagattgctaatcaggtgaacttgtataaagaattacgaccagtagttcagttaggacaacagtatagactaattaatcctgatactgcatccaatgaagctgctgtacaatttaattacaaaaatcaaacgattgtaacctacgttcgcgttttgtcagttgtagagaccatggaaacaactttaaagttaaaagatttggatgaagagggactatatgaattacaggaaaatggcgaagtttactcaggtgcagaactcatgtatgcgggtttaactgttattttatcccaaggagattttttgagtaaacagtatatttttagaagactataa

SEQ ID NO: 280 - DNA, 1260 bp, Streptococcus pneumoniae
atgaaatggtataaaaaaatcggacttcttgcaactacaggtttagctttggttgggctcggcgcttgctccaactatggtaaatctgcggatggcacagtgaccatcgagtatttcaaccagaaaaaagaaatgaccaaaaccttggaagaaatcactcgtgattttgagaaggaaaaccctaagatcaaggtcaaagtcgtcaatgtaccaaatgctggtgaagtattgaagacacgcgttctcgcaggagatgtgcctgatgtggtcaatatttacccacagtccatcgaactgcaagaatgggcaaaagcaggtgtctttgaagatttgagcaacaaagactacctgaaacgcgtgaaaaatggctacgctgaaaaatatgctgtaaacgaaaaagtttacaacgttccttttacagctaatgcttatggaatttactacaacaaagataaattcgaagaactgggcttgaaggttcctgaaacctgggatgaatttgaacagttagtcaaagatatcgttgctaaaggacaaacaccatttggaattgcaggtgcagatgcttggacactcaatggttacaatcaattagcctttgcgacagcaacaggtggaggaaaagaagcaaatcaataccttcgttattctcaaccaaatgccattaaattgtcggatccgattatgaaagatgatatcaaggtcatggacatccttcgcatcaatggctctaagcaaaagaactgggaaggtgctggctataccgatgttatcggagccttcgcacgtggggatgtcctcatgacaccaaatgggtcttgggcgatcacagcgattaatgaacaaaaaccgaactttaagattgggaccttcatgattccaggaaaagaaaaaggacaaagcttaaccgttggtgcgggagacttggcatggtctatctcagccaccaccaaacatccaaaagaagccaatgcctttgtggaatatatgacccgtccagaagtcatgcaaaaatactacgatgtggacggatctccaacagcgatcgaaggggtcaaacaagcaggagaagattcaccgcttgctggtatgaccgaatatgcctttacggatcgtcacttggtctggttgcaacaatactggaccagtgaagcagacttccataccttgaccatgaactatgtcttgaccggtgataaacaaggcatggtcaatgatttgaatgccttctttaacccgatgaaagcggatgtggattag

SEQ ID NO: 281 - DNA, 246 bp, Streptococcus pneumoniae
atgaccacaaaagcccatgcccaatatttttgtaatacttttttcatagtctctctactcctaatccacatccgctttcatcgggttaaagaaggcattcaaatcattgaccatgccttgtttatcaccggtcaagacatagttcatggtcaaggtatggaagtctgcttcactggtccagtattgttgcaaccagaccaagtgacgatccgtaaaggcatattcggtcataccagcaagcggtga

SEQ ID NO: 282 - DNA, 867 bp, Streptococcus pneumoniae
atgaaaaaagtattacaaaaatattgggcatgggcttttgtggtcatccccctcttgttacaagcaattttcttctatgtgccgatgtttcaaggagccttttacagttttaccaactggacaggattgacttacaactacaaatttgtcggcttaaacaactttaagctcctcttcatggatccaaaattcatgaatgcgattggctttaccgcaatcattacgattgccatggtggttggtgagattgcactcgggatcttcattgcgcgtgtcttgaactctaaaatcaaaggccaaaccttcttccgtgcttggttcttcttcccagctgttttatctggtttgacagtggctttgatcttcaagcaagtcttcaactacggtcttccagcgattgggaatgcccttcatattgaatttctccaaaccagtcttttagggactaagtggggagcaatctttgcggctgtctttgtccttctttggcaaggggtggctatgcccatcatcatcttcctagctggtttgcaatctattccaactgagattacagaggcagcaaggattgatggtgcgactagcaagcaagttttctggaacattgaattgccttacttgctaccaagtgtctctatagtctttatcctagccctaaaaggtgggctgactgcctttgaccaagtctttgccatgaccggtggtggtccaaacaatgccacaacctcacttgggctcttggtttataactatgcctttaaaaacaaccaattcggttatgccaatgccattgccgtaatcttgttcttcttaattgtagtgatttcgatcatccaattgagagtatctaagaaatttgaaatttaa

SEQ ID NO: 283 - DNA, 834 bp, Streptococcus pneumoniae
atgaaacaagatgaaagaaaagccctgattggcaaatacattctattgattctaggatcggttctgcttttagtgccgctccttgctaccctctttagttccttcaaacccactaaggatattgtagataatttctttggctttccaaccaacttcacatgggacaactttagccgtctcttagctgatgggattggaggctattattggaactctgtcgtcatcactgtcttgtctttacttgcagtaatgatctttatccctatggcagcctactccatcgctcgcaatatgagtaaaagaaaagcctttaccatcatgtataccctcttaatcctcggaatcttcgtacctttccaagtcatcatgattccgattacggttatgatgagtaaactcggtttggctaatacctttggtttgatcttgctctacttgacctatgcgattccacagaccctctttctctatgttggctatatcaaaatctcgattccagaaagtctggatgaagcagcagagatcgatggggctaatcaatttacaacctatttccgcatcatcttcccaatgatgaaaccgatgcatgcgacaaccatgatcatcaatgccctttggttctggaatgacttcatgttgccactccttgtcttgaaccgggattccaaaatgtggactctgcctttgttccaatacaactacgcaggccaatatttcaacgactacggaccaagctttgcctcttacgtggtcggcattatcagtatcaccattgtctatctcttcttccaacgccatatcatttcaggaatgagcaacggggcagtgaagtaa

SEQ ID NO: 284 - DNA, 1446 bp, Streptococcus pneumoniae
atgatgccaattcaaaataaaaccatgttgattacctattctgatagccttggaaataatcttaaagacttatatgataatttggaagagcattttcgagatgctattggaggagttcaccttttaccatttttcccatcaacaggtgatcgtggatttgcgccagttgactacgacgaagtggactcagcttttggtgattgggaggatgttaagcgtttaggtgagagatattatcttatgtttgattttatgattaatcatatttctcgtcaatccaagtattataaggactatcaagaaaaacatgaagccagtgaatttaaagctctctttttaaactgggataagttttggccagaaaaccgtccgacacagtctgatgtagatttaatttacaagcgtaaggatcgtgcaccaaagcaagagattgtgtttgaagatggttcagtggaacatttgtggaatacctttggtgaggagcagattgatcttgatgtgaccaaagaagtaactatggaatttatccgtaagaccattcagcacttggcaagtaatgggtgtgatttgattcgtctagatgcctttgcttatgcagtgaagaaattggatactaatgatttctttgtggaaccagatatttgggatttattggacaaagttcgagatatcgctactgagtatgggacagagtttttacctgagattcatgaacactattcgattcagtttaaaatagcagaccatgattactatgtttatgattttgctcttccaatggtgacactttatactctttacagttccagaacagagcgtttggctaagtggttaaagatgagcccgatgaagcaatttacgacgctagatacccatgatgggattggagtagtagatgtcaaggatatcctgaccgatgaggagattgactatgcttcaaatgaactctataaggttggagccaatgtcaaacgtaagtactctagtgccgagtataacaacttagatatctaccaaatcaattcaacctactattcagcgcttggagatgatgaagtcaagtattttctcgctcgtctaattcaagcttttgccccaggtattcctcaggtttactatgtgggtctattagcaggcaagaatgacttgaaattattagaagaaactaaagaaggtcgaaatattaatcgtcattactatagcaacgaggaaatagcaaaagaagtgcaacgacctgttgtgaaggcccttctcaatctattttctttccgtaaccgttcagaagcctttgatctagaagggactactgagatagagacaccaacagctcacagcattgtaatcaaacgtcaaaataaagataagtccgtaacagcagtagcagaaattgatttgcaaaatcagacttatcgggtaattgagaatggagttgaagtaacattttga

SEQ ID NO: 285 - DNA, 1194 bp, Streptococcus pneumoniae
ttgaaatcaataggctttattgaaaagctgaaggggttgtctagtaaagagctgattttattgggaattatcctgagtatctttttacccttttatctttttgtagttgtactctgtttatatattatcagtttgatttttacaggagacatgaaaagtattcttcagaaaatgggggagcatccgatgctgcttctttttcttagctatagtactgttatatccattcttgcacaaaattggatgggtcttgtggcttcagtaggaatgtttctatttactattttctttttgcactatcagtcgattttatcccataaattctttcgattgattttgcagttcgtcttgtttggtagtgtcttgtcagctgtttttgccagtttagaacatttccaaattgtgaagaaatttaactatgcttttctttcacccaatatgcaggtgtggcatcagaaccgggcagaagtgaccttctttaatcctaattattatggaattatttgttgtttctgtattatgattgctttctatctgtttacaacgaccaagttgaattggttgaaagtattctgtgtgattgcaggctttgttaatctctttggtttgaactttactcaaaatcgaactgcctttcctgctattatcgctggagcaattatctatctctttacgactattaaaaactggaaggccttttggcttagtattggggtcttcgcgattggtttgagtttcctcttttctagtgatttgggagttcgaatgggtactttagactcttctatggaagaacgcatttctatctgggatgctgggatggccttgtttaagcaaaatcctttttggggtgaagggccattgacctatatgcactcttatcctcggatacatgctccttatcatgaacatgcccacagtctttatattgatacgattctgagttacggaattgtgggtaccattttattagttttgtcttctgttgctcctgttcgcttgatgatggatatgagtcaggagtcggggaaacgtccgattatcggcctttatctatctttccttacagtggttgctgtgcacggaatttttgacttggctctcttctggattcagtcaggctttattttcttgctagttatgtgcagtattccattggagcatcgaatgttggtatcggacatgacggattaa

SEQ ID NO: 286 - DNA, 402 bp, Streptococcus pneumoniae
gctttaggggctgatgaatcagatgattttgaagaactgcatgctgcaagtacacctgctgctaataaaacaagacctgctgtagcagatacaccaatttttttattttctactcccctggttatgggaattatgaatggccacccattatttcaccttattcctttaaaaatcaaacaaattttcagaatatttaggcttgttggcacaaatttttcatttttttttgaatatatgattcaaattgtcgttcgaagtgtcaaagactacagtgaaaataggaaatttgacgcagaaactttggagtttaggaagacatacagtaaaatgaaatacggacggaacaatgtgattttggaattcaaattaaattataacaatattgtagaagtatcattctag

SEQ ID NO: 287 - DNA, 1986 bp, Streptococcus pneumoniae
gtagaaaataaaaaaattggtgtatctgctacagcaggtcttgttttattagcagcaggtgtacttgcagcatgcagttcttcaaaatcatctgattcatcagcccctaaagcttatggctatgtttatacagcagacccagaaaccttggactacctgatttcaagtaaaaatagtacaacagtagtgacttcaaatgggattgatggtttattcactaacgataattacggtaatcttgctcctgcagttgcagaggattgggaagtctctaaggatggtttgacctacacttataagattcgtaaaggggttaaatggtttacctctgatggagaagaatatgcagaggtgacggctaaagatttcgtgaacggtttaaaacacgcagcagataaaaaatcagaagctatgtatttagctgaaaattcggttaaaggcttggcagattatctatcaggaacttcaacagatttttcaacagttggtgtcaaggcggttgatgattatacgttacaatacactttgaaccagcctgaaccgttctggaactctaagttgacctattctattttctggcctctgaatgaagaattcgaaacatcaaaaggaagcgattttgctaaaccaacagatccgacatccttgctttataatggtccattcttgttgaaagggttgactgcaaaatcttctgtagagtttgtaaaaaatgagcaatattgggataaagaaaatgtccacctagatactatcaatctagcttactatgatggatcagatcaggagtcgctagagcgtaacttcactagtggagcttatagttatgcccgtctttaccctaccagctccaactattctaaggttgcagaagaatacaaggacaatatctattacacacaatcaggctctgggattgctggtctgggtgtgaatattgatcgccaaagttacaactatacttctaaaactacagattcagagaaagtagctactaagaaggcattgcttaacaaagatttccgtcaagccttgaattttgctcttgatcgctcagcttactcagctcaaatcaatggtaaagatggagcagctttagcagttcgtaatttatttgtaaaaccagactttgtttcagctggtgagaagacctttggtgatttagtcgctgctcaacttcctgcttatggtgatgagtggaaaggtgtgaatttagctgatgggcaggatggtttattcaatgctgacaaggccaaggcagagtttgcgaaagctaagaaagctttagaagcagacggcgttcagtttcctattcatctggacgttccagtagaccaagcatcaaaaaactacatatctcgtattcagtcctttaaacaatctgtagaaacagttcttggtgttgaaaatgtcgttgttgatattcaacaaatgacaagtgatgaattccttaatattacttactatgctgccaatgcttcatctgaggattgggatgtatcaggaggagtttcatggggtccagactatcaagacccatctacttacctggatattttaaaaacaactagcagtgaaactacaaaaacatatttaggatttgataatccaaatagcccttcagtagttcaagttggtttgaaagaatacgataaattagttgatgaagctgccagagagacaagcgacttgaatgtccgttatgaaaaatatgcagcggctcaagcatggttgacagatagttcactctttattcctgctatggcttcttctggtgcagcaccagtgctttcacgaattgttccatttactggagcttctgcgcaaacaggctctaaggggtcagatgtttacttcaaatatttgaaattacaagataaagtggtgactaaggaagagtatgaaaaagctcgtgaaaaatggttgaaagaaaaagctgaatcaaatgagaaagctcaaaaagaattggcaagtcatgtgaagtaa

SEQ ID NO: 288 - DNA, 1497 bp, Streptococcus pneumoniae
atgaaaaaatatatttttatgcgtgttttgcggtcattggtttcgattttcttagtaacgactttgacctacacgattatctataccttggttcctcgaaaattgattttcaagcaggatcctaactataataaaattgcgacaacggctgataaacgtgataactatgaaaatactgtgtttgagcgtatgggctacattgagtattacgatactagagagttgcaagaaaaggcaagtagcatggattcttctgtaacagtagaagcaaatgcgaccaataaagctatttatgaaaagtacatcaatcaattaggtcatggttggactttgggagaatttactgaaagtggtcaattctatgctactcgtgaaattccaatttttgaacgtgtttttcacttctatgctaacttgattgacattgaccatacaaataaaatccaagaccctgaaaatccagacttgaaacgctaccttcgttttgaaaatgatccagctatcggatggtcattggtcggttcaggaactaaacataaatatctcttgtactttaacagtcagttcccatttgttcatcaaaactttgtgaacttgaatttaggtgactcttacccaacctatgctaatacaccagttcttcaggttattactcaaggtcaaggacaaaccaaaactgcccaagttcagttcccaacaggtaagaaaacgtcttctgtaaatatttactcaagaacctacaagtcacctagtcaggctgactctcgtgaagtagctagctatgggaaagatgatccttatacagcgactgaaagtaattaccaatatccatctatgattgtcagctctgctattactggtttgattggtttggttcttgcctatgctcttgccgtgccacttggttcagccatggctcgtttcaagaacacttggattgatagcctctcaacagggactttgaccttcttgcttgctcttccaacgattgccttggtttacatcgttcgattgattggatcatctattgcccttccagattcattccctatcttgggagctggagattggcgttcttacgttttaccagcagtcatccttggtttgttgggtgctcctgttacagccatttggattcgtcgttacatgattgacttgcaatctcaagactttgttcgtttcgctcgtgcaaaaggtttgtctgaaaaagaaatttcaaacaaacacatctttaaaaatgccatggttccgctggtttcaggaattcctggtgccattattggggttatcggtggtgcaacccttactgaaacagtcttcgccttcccaggtatgggtaaaatgttgattgactctgtaaaagcatctaataactctatggtcgttggtcttgtcttcatctttacatgtatttctatcttctcacgtcttttgggagatatttggatgactattattgacccacgtattaaattgactgagaaaggaggcaaataa

SEQ ID NO: 289 - DNA, 927 bp, Streptococcus pneumoniae
atgtctacaatcgataaagaaaaatttcagtttgtaaaacgtgacgattttgcctctgaaactattgatgcgccagcatattcttactggaaatcagtgtttaaacaatttatgaagaaaaaatcaactgtagtcatgttgggaatcttggtagccatcattttgataagtttcatctacccaatgttttctaagtttgatttcaatgatgtcagcaaggtaaacgactttagtgttcgttatatcaagccaaatgcggagcattggttcggtactgacagtaacggtaaatcgctctttgacggtgtctggttcggagctcgtaactccatcctcatttctgtgattgcgacagtgattaacttggttatcggtgtttttgtcggtggtatttggggtatttcaaaatcagttgaccgtgtcatgatggaagtttacaacgtcatctcaaacatcccacctcttttgattgttattgtcttgacttactcaatcggagctggattctggaatctgatttttgccatgagcgtaacaacatggattggtattgccttcatgatccgtgtgcaaatcttgcgctatcgtgacttggaatacaacttggcgtcacgtactttgggaacaccaaccttgaagattgttgccaaaaatatcatgcctcaattggtatctgttattgtgacaaccatgactcaaatgcttccaagctttatctcatacgaagccttcttgtctttcttcggtcttggattaccgattacagtgccaagtttgggtcgtttgatttcggattattcacaaaacgtaacaaccaatgcttacttgttctggattccattgacaacccttgtcttggtatccttgtcccttttcgtagttggtcaaaacttagcggatgctagtgatccacgtacacatagatag

SEQ ID NO: 290 - DNA, 1068 bp, Streptococcus pneumoniae
atgacaaaagaaaaaaatgtaattttgactgctcgcgatattgtcgtggaatttgacgttcgtgacaaagtattgacagccattcgcggcgtttcccttgaactagttgaaggagaagtattagccttggtaggtgagtcaggatcaggtaaatctgttttgacaaagaccttcacaggtatgctcgaagaaaatggtcgcattgcccaaggtagtattgactaccgtggtcaggatttgacagctttatcttctcacaaggagtgggaacaaattcgtggtgctaagattgcgactatcttccaggacccaatgactagtttggaccccattaaaacaattggtagtcagattacagaagttattgtaaaacaccaaggaaaaacagctaaagaagcgaaagaattggccattgactacatgaataaggttggcattccagacgcagatagacgttttaatgaatacccattccaatattctggaggaatgcgtcaacgtatcgttattgcgattgcccttgcctgccgacctgatgtcttgatctgtgatgagccaacaactgccttggatgtaactattcaagctcagattattgatttgctaaaatctttacaaaacgagtatcatttcacaacaatctttattacccacgaccttggtgtggtggcaagtattgcggataaggtagcggttatgtatgcaggagaaatcgttgagtatggaacggttgaggaagtcttctatgaccctcgccatccatatacatggagtctcttgtctagcttgcctcagcttgctgatgataaaggggatctttactcaatcccaggaacacctccgtcactttatactgacctgaaaggggatgcttttgccttgcgttctgactacgcaatgcagattgacttcgaacaaaaagctcctcaattctcagtatcagagacacattgggctaaaacttggcttcttcatgaggatgctccaaaagtagaaaaaccagctgtgattgcaaatctccatgataagatccgtgaaaaaatgggatttgcccatctggctgactag

SEQ ID NO: 291 - DNA, 339 bp, Streptococcus pneumoniae
atgatatctccattacttgtatcatttagaccgatgatagcacgaccaatagttgttttcccactaccggactcacctacaagcgagaaagtttctcccttgttgataaagaagttagcatttttaaccgcgacaaacttcttacttccttcaccgaaggaaatttctaaatctttgatttctactaatttttcagacatttccttcctcctagtcagccagatgggcaaatcccattttttcacggatcttatcatggagatttgcaatcacagctggtttttctacttttggagcatcctcatgaagaagccaagttttagcccaatgtgtctctga

SEQ ID NO: 292 - DNA, 927 bp, Streptococcus pneumoniae
atgtctgaaaaattagtagaaatcaaagatttagaaatttccttcggtgaaggaagtaagaagtttgtcgcggttaaaaatgctaacttctttatcaacaagggagaaactttctcgcttgtaggtgagtccggtagtgggaaaacaactattggtcgtgctatcatcggtctaaatgatacaagtaatggagatatcatttttgatggtcaaaagattaatggtaagaaatcgcgtgaacaagctgcggaattgattcgtcgaatccagatgattttccaagaccctgccgcaagtttgaatgaacgtgcgactgttgattatattatttctgaaggtctttacaatcaccgtttatttaaggatgaagaagaacgtaaagagaaagttcaaaatattatccgtgaagtaggtcttcttgctgagcacttgactcgttaccctcatgaattctcaggcggtcaacgtcaacgtatcggtattgcccgtgccttggtcatgcaaccagactttgttattgcagatgagccaatttcagccttggacgtttctgtacgtgcccaagtcttgaacttgctcaaaaaattccaaaaagagctcggcctgacctatctcttcatcgcccatgacttgtcggttgttcgctttatttcagatcgtatcgcagttatttacaagggtgttattgtagaggttgcagaaacagaagaattgtttaacaatccaattcacccatatactcaagccttgctttcagcggtaccaatcccagatccaatcttggaacgtaagaaggtcttgaaggtttacgacccaagtcaacacgactatgagactgataagccgtctatggtagaaatccgtccaggtcactatgtttgggcgaaccaaaccgaattggcacgttatcaaaaaggactaaactag

SEQ ID NO: 293 - DNA, 1257 bp, Streptococcus pneumoniae
atggaacaattacattttatcacaaaattactagacattaaagaccctaatatccagattttagacatcatcaataaagatacacacaaggaaatcatcgccaaactggactacgacgccccatcttgccctgagtgcggaagtcaaatgaagaaatatgactttcaaaaaccttctaaaattccttatcttgaaacgactggtatgcctactagaattctccttagaaagcgtcgattcaagtgctatcagtgctcaaaaatagcggtcgctgagacttccctcgtcaagaaaaatcaccaaatccctcgtatcatcaaccaaaagattgctcaaaagttgattgaaaagatttctatgactgatattgcccatcagctttccatctcaacttcaactgttattcgtaagctcaatgattttcactttaaacatgatttttcttgtcttcctgagattatgtcttgggatgagtatgcttttacaaagggaaagatgagcttcattgcgcaagattttaacaatctcaatatcatcactgttcttgagggaagaacacaagctatcattcgaaatcactttcttaaatatgatagagccgtccgatgtcgcgtcaaaattattactatggatatgtttagcccttactatgacttagctagacaacttttcccgtgtgctaaaatcgtgttggatcgctttcacattgtacaacatcttagccgtgctatgagtcgtgtgcgtgttcaaatcatgaatcaattggatcgaaagtctcatgaatacaaggctatcaagcgctactggaaactcattcaacaggatagccgtaaactgagtgataagcgattttatcgtcctacttttcgtatacatttaaccaataaagagattttaaacaagcttttgagttattcggaagacttgaaacaccactatcagctctatcagctcttgctttttcacttccagaataaggaaccagagaaatttttcgggcttattgaggacaatctaaagcaggttcatcctctttttcagactgtctttaaaaccttcctcaaagataaagaaaagattgtcaacgcccttcaactacactattctaatgccaaactggaagcgaccaataatctcatcaaacttatcaagcgcaatgcctttggttttcgaaactttgaaaacttcaaaaaacggatttttatcgctttgaatatcaaaaaagaaaggacaaaatttgtcctttctcgagcttag

SEQ ID NO: 294 - DNA, 288 bp, Streptococcus pneumoniae
atgagctttattgcgcaaaattttgaaaagctcgatatcatcactgttcttgaaggtagaacacaagctgtcatccgagatcactttcttaaatatgatagagccgtccgatgtcgcgtcaaaatcattactatggatatgtttagcccttactatgacttggctaaacagcttcgctttcaaatttctaggctcaggctgaaacagtctcctagactgtttcactcccgaatgctaaaatcgttcttgatcgctttcacattgtacaacatcttagccgtgctatga

SEQ ID NO: 295 - DNA, 519 bp, Streptococcus pneumoniae
atggaacaattacattttatcacaaaattactagacattaaagaccctaatatccagattttagacatcatcaataaggatacacacaaggaaatcatcgccaaactggactatgaagctccatcttgtcctgagtgcggaagtcaaatgaagaaatattactttcaaaaaccttctaaaattccttatcttgaaacaactggtatgcctactagaattctccttagaaagcgtcgtttcaagtgctatcattgttctaaaattatggttgctgaaacttctatcgtcaagaagaatcatcaaatccctcgtatcatcaaccaaaagattgctcaaaagttaattgaaaagatttctatgactgatattgcccatcagctttccatctcaacttcaactgtcattcgaaagctcaatgacttccactttgagtgtaattttagaaatctgcctaagattatgtcttgggacgttgaaacagtccggggagtgactgtttcaatcgggagatggagatga

SEQ ID NO: 296 - DNA, 711 bp, Streptococcus pneumoniae
atgaagaaataccaacaattatttaagcaaatccaagaaaccattcaaaacgagacttacgctgtcggagatttccttcctagcgagcacgaccttatggagcaatatcaagtgagtcgtgataccgtccgaaaggccctgtctctcctccaagaggaaggattgatcaaaaagataagagggcaaggttctcaagtcgtcaaagaagaaaccgtcaatttccctgtatccaacctaaccagctaccaagaactagttaaagaacttggactgcgctctaaaaccaacgtggtcagtctggacaagattattattgataaaaaatcctcgctgataaccggtttcccagagtttcggatggtttggaaggtggtccgccagcgtgtggtggatgatctggtatccgttctggatacagactatctggatatggaactaattccaaatctcactcgccaaattgctgagcagtctatctattcttatatagaaaatggcctcaaactccttattgattatgctcagaaggaaatcaccattgaccactcaagcgaccgagacaagattctcatggacattggcaaagacccttatgtcgtttcgattaaatcaaaagtctatctccaagacggacgccaatttcagtttaccgaaagtcgccataagttagaaaaatttagatttgtagattttgcaaaacgcaagaaataa

SEQ ID NO: 297 - DNA, 1968 bp, Streptococcus pneumoniae
atgggaaaatttgaacaagaagccaaagatctgcttcaggcaattggaggcaaagaaaatgtgactgccgtaactcactgtgcgacacggatgcgctttgttttaagagatgataagaaggctaatgttaaagctatcgagtcaattccagctgttaaaggaacttttacaaatgcaggtcaatttcaggtaatcattggaaatgacgtgcccatcttttataatgattttacagccgtttcaggtattgagggtgtttccaaagaagcaaccaagtctgcagctaagagtaatcaaaacgtggttcaaggtgttatgaccactctggcggaaatctttactccgattattccagccttgattgttggtggattgatcctcggtttccgtaatgtcttggaaggtgtccattggtcgatgttggatggcaagaccatcacagaatcctctcagttttgggcaggggttaatcacttcctctggttgcctggtgaagctatcttccagttcttaccagtagggattacttggtctgtttctcgtaagatgggaaccagccaaattttgggaattgttctcggaatctgtttggtatcgcctcagttgctcaatgcctatgcggttgcttcaacgccagcagctgatatcgcagcaaactgggtttggaattttggttattttactgttaatcgtattggttaccaagcccaagttatcccagccttgcttgcaggtttgagtctgtcttatcttgaaattttttggcgcaaacatatcccagaagtcatttccatgatttttgtaccttttttgtcattgattccagccttgattttggctcatactgtcttggggccaatcggttggacaattggacaaggactttcatcagttgtattggcaggtttaacgggtcctgtaaaatggctcttcggtgcaatttttggtgccctctacgctccatttgtcatcacaggtctgcaccacatgaccaatgccattgatacacaattgattgcggatgctggtggcactgccctctggcctatgattgctctttctaatattgctcaaggctcagccgtgtttgcctattatttcatgcatcgccatgatgagtgtgaggctcaggtttcacttcctgcaaccatttcagcctatctcggtgttacagaaccagctctttttggggttaacgtaaaatatatttatccatttgttgctgggatgactggttcagcccttgcaggcatgttatccgttacttttaatgtaactgcggcttctattggtatcggtggtttgccaggtattctctctattcaacctcaatacatgctgccatttgcaggaactatgctagttgcgattgttgttccaatgctcttgactttcttctttcgcaaggctggtctcttcacaaaaatagagggcgatacgaacttgcaggcagaattcgttgctcaagaagaagcagaatttgtgagccatgaaccagtagaacttacttcggtagaaattatcagcccactaactggccaagtgaaagaattgagtcaagcgacggatcctgtttttgcatcaggtgtcatggggcaaggtctggtcattgaaccaagccaaggtgagttgacctctccagttaatggaacagtgacggttcttttccctaccaagcatgccatcggcattgtctctgacgagggagttgaattgctcatccacatcggtatggatacagtaggtcttgatggcaaaggttttgaaagtcttgtagtccaaggagatcacgttatagttggccagcaactgattcgttttgatatggatgtcattaaggctgcaggtctggtgacagaaactcctgttatcatcaccaaccaagatgcttatacagcgactattactggaacttatccgacaacgatccaagctggagcatctctcatggtcgctacacgaatctaa

SEQ ID NO: 298 - DNA, 1626 bp, Streptococcus pneumoniae
atgacacttgataaaggaaaagtagtctatcaaatctatccaaaatcttacaaagacaccactgaaaacggtattggggatttccgtgggattatcgaaaaaattccctatttagccaaactaggtgtggatatggtctggctcaatccattctatccaagccctcaacgggataatggttacgatatttcagattatatggcagtggatcctctttttggtgatatggctgattttgaggaaatggtgtgtgtcggtaaagagcacaagattgactttatgctggacatggtacttaatcattgttcgacagagcatgaatggtttcagaaagccctagctggtgataagtattatcaagactttttcttcatccaagaccaaccaacagattggcagtctaagtttggtggttctgcatgggcgcctttcggggatactgggaaatactatcttcacctatttgatgagacccaggctgaccttaactggcgcaatcccaatgtccgtaaggagcttttcaaggttgttaatttctggcgcgacaagggtgtcaaaggttttcgatttgatgtgatcaatttgatcggtaaggacgaggtttcagtggactgtcctgaaaatgaagggaagccagcttatacagacaaacccatcgttcataactatttgcgtatgatgaaccaagccacttttggatctgacgatagctttatgacagttggggaaatgtcttctaccaccatggaaaactgtgtcctctattcgtcgcctgatcgtcaggaattatccatgacctttaattttcatcacctcaaggtggactataaggatggacaaaagtggaccttggctccctttgattttgaagagttgaagagtctttaccatagttggggtaaggaaatgagtgataaagacggttggagtgccctcttttggaacaatcacgatcaaccacgtgccttgaaccgttttgtcgatattcaaaacttccgcaaggaaggagccactatgctagcagccagcattcacctgtcacgtgggacaccttatatctacatgggtgaggaaatcgggatgattgacccagactatgattctatggctgattatgtggatgtcgaatcgcttaatgcctatcagatgctcttagaagaaggaaagagtcagcaagaagccttccagattattcaagctaagtcgcgtgataattcacgcattcccatgcagtgggatgcttcggaaaatgcaggattttcaacaggcactccttggttgaaagctggtaaatcctataaatacatcaatgtagaaaatgaaatccagggtccgatttttaccttctatcaagacttgattcgactgcgtaaggaaatgccaatcatttcagaaggaagttacaaaccagcctttgaagatagcaaacaagtctacgcttttgaacgccagtttgaggatcaaaagttactagtgctcaataacttttatgctaaagaagtggaaatcgacttgccagcagtctaccaaaatggacagattttgatatcaaactatgaagatgcagaagtgtctgagaaaattctactcaaaccctatcaaacactggctatttatgtaaattaa

SEQ ID NO: 299 - DNA, 180 bp, Streptococcus pneumoniae
attaatactcttcgaaaatctcttcaaaccgtgtcagttttatctgcaacctcaaagcggtgctttgagcaacctgtggctagcttcctagtttgttctttgattttcattgagtataaacttagcaaggagacctctttttcagaaaagcagggttctttttgctgtctattccatccc

SEQ ID NO: 300 - DNA, 252 bp, Streptococcus pneumoniae
atgatggatttacttttagcaattgtattgattgtgctagcttttctaggaggagctctaggaggaatgtacttggttcgtaagcaaatcgaaaaagaatttgctgacaacccacgtttgaatgctgaagcagttcgtactcttttgagtgcaaatggtcaaaaaccaagcgaagctaaggtacaacaagtttaccaccaaatcatccgccaacaaaaggcagcccttgctaacaataaaaagaaaaaataa

SEQ ID NO: 301 - DNA, 795 bp, Streptococcus pneumoniae
atggataatcgaccaattggttttttggattcgggtgtcgggggcttgaccgttgtgcgcgacgtcatgcgccagcttccccatgaagaaatcgtctatattggagattcggcgcgggcgccctatggcccccgtcctgctgagcaaattcgtgaatatacttggcagctggtcaactttctcttgaccaaggatgtcaaaatgattgtcattgcttgtaacactgcgactgcggtcgtctgggaagaaatcaaggctcaactagatattcctgtcttgggtgtaattttgccaggagcttcggcagccatcaagtccagtcaaggtgggaaaatcggagtgattggaacgcccatgacggtacaatcagacatataccgtcagaaaatccatgatctggatcccgacttacaggtggagagcttggcctgtcccaagtttgctcccttggttgagtcaggtgccctgtcaaccagtgttaccaagaaggtggtctatgaaaccctgcgtcccttggttggaaaggtggatagcctgattttgggctgtactcattatccactccttcgccctattatccaaaatgtgatggggccaaaggttcagctcatcgatagtggggcagagtgcgtacgggatatctcagtcttactcaattattttgaaatcaatcgtggtcgcgatgctggaccactccatcaccgtttttacacaacagccagtagccaaagttttgcacaaattggtgaagaatggctggaaaaagagattcatgtggagcatgtagaattatga

SEQ ID NO: 302 - DNA, 819 bp, Streptococcus pneumoniae
agaatggctggaaaaagagattcatgtggagcatgtagaattatgacaaataaaatttatgaatataaggatgaccaggactggtatgttgggtcttatagtatttttggtggcgttaacagtttgagcgactataagacagattttcctctgtttgaattctccaaaatatttggagatgaagagtatggtttcccgctttcagttactgttttacgttatggttctacctaccgtttgttctcttttgtggtagacatgcttaatcaagatatgggacgaaacttggaagttattcaacgtcatggggccctgctcttggttgaaaatgggcaactcttgtatgtagaattgcctaaagaaggggtcaatgttcatgatttctttgagacaagcaaggtcagagaaaccttgttgattgcgactcgtaacgaaggtaaaaccaaggaattccgagctatctttgataagttaggctacgatgtggaaaatcttaatgactaccctgacctgcctgaagtagcagaaacaggtatgacctttgaagaaaatgcccgccttaaggcagaaaccatttctcaattaacgggcaagatggttttggcagatgattctggtctcaaagtcgatgtccttggtggcttaccaggcgtctggtcagctcgtttcgcaggtgtgggagcaactgaccgtgaaaataatgccaaactcttgcacgaattggccatggtctttgaactcaaggaccgctcggctcagttccacacaaccctagtcgtagccagcccaaataaggaaagtttagtgttgaacaccaga

SEQ ID NO: 303 - DNA, 195 bp, Streptococcus pneumoniae
tggtcaggttatattaactttgaacctaagggtgaaaatggctttggctatgatcccctcttccttgtaggagagacaggtgagtcatcagctgaattaaccctggaagaaaaaaatagtcaatctcaccgtgccttagccgttaagaaacttttggaggtatttccatcatggcaaagcaaaccatcattgtaa

SEQ ID NO: 304 - DNA, 522 bp, Streptococcus pneumoniae
atggcaaagcaaaccatcattgtaatgagcgattcccatggcgatagcttgattgtggaagaagtccgtgatcgctatgtgggcaaagtcgatgccgtttttcataacggcgattctgaactacgtccggattctccactttgggagggcatccgcgttgttaaagggaacatggacttctacgccggctacccagaacgtctggtgactgagcttggttcgaccaagattatccaaactcatggtcacttgtttgacatcaatttcaactttcaaaagttggactactgggctcaggaggaagaggccgctatctgcctctatggtcacttgcatgtgccaagtgcttggatggaaggcaagatcctctttctaaatccaggttctatcagccaaccacgaggtaccatcagagaatgtctctatgctcgtgtggagattgatgatagttacttcaaagtggactttttgacacgagatcacgaggtgtatccaggtttgtccaaggagtttagccgatga

SEQ ID NO: 305 - DNA, 462 bp, Streptococcus pneumoniae
atgattgccaaggagtttgagactttcttgttggggcaggaggaaacttttttgacccctgctaaaaatctagctgtgttgattgatacccacaatgcggatcatgcgaccctcttgcttagtcagatgacctatacccgtgttcccgttgtgacagatgaaaaacagtttgttgggacgattggactcagagatattatggcttatcagatggagcatgacttgagccaagaaatcatggcggatacggatatcgttcatatgacaaaaacggacgtagcggttgtttcgcctgatttcaccattacggaggtcttgcacaagctagtagatgagtccttcttaccggttgtggatacagagggtattttccaagggattattacgcgcaagtccatcctcaaggccgttaatgccctcttgcatgattttagtaaggaatatgagattcgatgccaatga

SEQ ID NO: 306 - DNA, 741 bp, Streptococcus pneumoniae
atgccaatgagagacagaatttcagcctttttagaggaaaagcagggcttgtctgtcaattccaagcagtcctataagtatgatttggagcaatttttagacatggtaggtgagcggatttctgagaccagtctcaagatttaccaagcccagctagccaatctaaaaatcagcgcccagaagcgaaagatttcggcctgtaaccaatttctatactttctctatcaaaaaggagaggtggacagcttttaccgcttggaattagccaaacaagctgaaaagaagacggaaaagccagagattctatacctagactctttttggcaggaaagcgaccatccagagggccgcttgctagcgctcttaatcctagaaatggggctcttgcccagtgagattttagccatcaaggttgcggacatcaatctggattttcaggtgctgcgaatcagcaaggcttcccaacagaggattgtcaccattcccacggccttgctttcagaattggaacccttgatggggcagacctatctttttgaaagaggagggaaaccctattctcgtcagtgggcctttcgtcagttagaatcttttgtcaaggagaaaggttttccatccttatcagctcaagtcttacgtgaacagtttattctaagacaaatagaaaacaaggtcgatttgtacgaaattgcaaaaaaattaggattaaaaacagtcctgaccttagaaaaatatagataa

SEQ ID NO: 307 - DNA, 729 bp, Streptococcus pneumoniae
atggatattaaattaaaagattttgaaggacccctggacttactcttgcatctggtttctaagtaccagatggatatctacgatgtgcccattacggaagtcatcgaacagtatctagcctatgtctcaaccctgcaggccatgcgtctggaagtgacgggtgagtacatggtcatggctagtcagctcatgctgattaagagtcgtaaactccttccgaaggtagcagaagtgacagacttgggggatgacctggagcaggacctcctctctcaaatcgaagaatatcgcaagttcaagctcttgggtgagcacttggaagccaagcaccaagaacgggcccagtattattccaaagcgccgacagagttgatttacgaagatgcggagcttgtgcatgacaagacgaccattgacctctttttggctttttcaaatatcctagccaagaaaaaagaggagtttgcacaaaatcacacgacgatcttgcgggatgagtataagattgaggacatgatgattatcgtgaaagagtccttgattggacgagatcaattgcgcttgcaggatttgttcaaggaagcccagaatgtccaagaggtcatcaccctctttttggcaaccctagagttaatcaaaacccaggagctgatcctcgtgcaagaggagagtttcggagatatctatctcatggaaaagaaggaagaaagtcaagtgcctcaaagctag

SEQ ID NO: 308 - DNA, 570 bp, Streptococcus pneumoniae
atgagtactttagcaaaaatagaagcgctcttgtttgtagcgggtgaagatgggattcgggtccgccagttagctgaactcctctctctgccaccgacaggcatccagcaaagtttaggaaaattagcccagaagtatgaaaaggacccagattccagtttggctttgattgagacaagtggtgcttatagattggtgaccaagcctcaatttgcagagattttgaaggaatactctaaggcgcctatcaaccagagcttgtctcgggctgcccttgagaccttgtccattattgcctacaaacagccgattacgcggatagaaattgatgccatccgtggagttaactcgagtggagccttggcaaagttgcaggcttttgacctgataaaggaagacgggaaaaaggaagtattggggcgccccaacctctatgtgactacggattatttcctagattacatggggataaaccatttagaagaattaccagtgattgatgagcttgagattcaagcccaagaaagccaattatttggtgaaaggatagaagaagatgagaatcaataa

SEQ ID NO: 309 - DNA, 723 bp, Streptococcus pneumoniae
atgagaatcaataagtatattgcccacgcaggtgtggccagtaggagaaaagcagaagagctgattaagcaaggcttggtgacggttaacggccaagtggtgcgtgaactagcaaccactatcaagtcaggcgacaaggtcgaagttgaaggtcaacctatctacaacgaagaaaaggtctactatctgcttaacaaaccacgcggtgtgatttccagtgtgacagatgataagggtcgcaagacggttgtcgacctcttgcccaatgtcaaagagcgtatttaccctgtgggtcgtttggactgggatacatcaggtgtcttgattttgaccaatgatggggactttacagacgagatgattcaccctcgtaatgagattgacaaggtttatgtcgcgcgtgttaaaggtgtggccaataaggacaatctccgccccttgacccgtggtcttgagattgatggtaagaaaaccaagccagctgtttatgaaattctcaaagtggacccagtcaaaaatcgctctgtggtgcagttgaccatccatgaagggcgtaaccatcaggttaaaaagatgtttgaagctgttggtctccaagtagataagttgtctcggactcgtttcggacacctagacttgacaggactccgtccaggagaatcccgtcgtcttaataaaaaagaaatcagccaactacacaccatggctgtaactaagaaataa

SEQ ID NO: 310 - DNA, 243 bp, Streptococcus pneumoniae
atgaaacgaattttaatagcgcctgtgcgcttttaccaacgttttatctcaccagtctttccaccctcttgtcgctttgagctgacttgttccaactacatgattcaggctattgaaaaacatggttttaagggggtattgatgggcttggctcggattttacgttgtcatccctggtcgaaaacaggtaaggaccccgttccagaccacttttcccttaaacgaaatcaagaaggggaatga

SEQ ID NO: 311 - DNA, 525 bp, Streptococcus pneumoniae
gtggcttatttcaaagctttttgtatgtcttcaatcatgagttttgttgattcaagtccgcctccgcttagataccagaggtctggtgttagttggataatcttaccatttttagcagcaggtgtttcagcgataagggcattttctaggacaccgttgttgctagagttgtccccaccgatggcaagggtacggttgatgacaaagaggatgtcagggttgatttctttgacactttcaaagctgacttcttgtccgtggcgtgagtcttcaaatgttgtatcagttggtttgaatttcaaggtttggtacaagaaagagaaacgagatttggcaccaaaggctgccatttttccttcattaaggaggatcgcaagggcctttttgtcagagctttcatttttagtagcgacttcttggatgctcttgtctagcttggccaattcttccttggctttctgtgtaccagtttcgccgaaggcacttgctaaggattcgatattagccttggtagaagtccagtag

SEQ ID NO: 312 - DNA, 966 bp, Streptococcus pneumoniae
atgaaaacatctcttaaactttatttcactgccctagtggccagcttcttgctcctacttggtgcatgtagtacaaactcaagcactagtcagacagagaccagtagctctgctccaacagaggtaaccattaaaagttcactggacgaggtcaaactttccaaagttcctgaaaagattgtgacctttgacctcggcgctgcggatactattcgcgctttaggatttgaaaaaaatatcgtcggaatgcctacaaaaactgttccgacttatctaaaagacctagtgggaactgtcaaaaatgttggttttatgaaagaacctgatttagaagctatcgccgcccttgagcctgatttgattatcgcttcaccacgtacacaaaaattcgtagacaaattcaaagaaatcgccccaaccgttctcttccaagcaagcaaggacgactactggacttctaccaaggctaatatcgaatccttagcaagtgccttcggcgaaactggtacacagaaagccaaggaagaattggccaagctagacaagagcatccaagaagtcgctactaaaaatgaaagctctgacaaaaaggcccttgcgatcctccttaatgaaggaaaaatggcagcctttggtgccaaatctcgtttctctttcttgtaccaaaccttgaaattcaaaccaactgatacaacatttgaagactcacgccacggacaagaagtcagctttgaaagtgtcaaagaaatcaaccctgacatcctctttgtcatcaaccgtacccttgccatcggtggggacaactctagcaacaacggtgtcctagaaaatgcccttatcgctgaaacacctgctgctaaaaatggtaagattatccaactaacaccagacctctggtatctaagcggaggcggacttgaatcaacaaaactcatgattgaagacatacaaaaagctttgaaataa

SEQ ID NO: 313 - DNA, 753 bp, Streptococcus pneumoniae
gtgaaactggaaaacattgacaaatccattcaaaaacaggatattttgcaaggcatttcgcttgaagtcagtcctcaaaaactgacagcctttattggtccaaatggtgctggaaaatcgactctcctctccatcatgagcagactaaccaagaaagatcagggagttctcagtatcaaaggacgtgaaatcgagagctggaattcgcaagaactggcccaagaactaaccatcctaaaacagaaaatcaattaccaagccaaattgactgttgaagaactggtcagttttggacgttttccctacagccgaggtcgacttagatcagaagactgggaaaaaatccgagaaactctgaactatttggaactgaccaacttaaaagaccgctacatcaatagcctgtcaggggggcaactccagcgcgtctttatcgctatggtactggcccaggatacggactttatcttgctggacgaaccactcaataatctcgatatcaagcaaagcgtcagcatgatgcaaattcttcgacgactggtggaggaactcggcaagaccattatcatcgtcctccacgatatcaacatggccagtcagtatgcagatgaaattgtcgccttcaaggacggtcaggtctttagcaagggaagcaccgatcaaatcatgcaggctgacctgctcagccaactttatgagattcccatcacgctagctgatatcaatgacaaaaagatctgtatctatagctag

SEQ ID NO: 314 - DNA, 201 bp, Streptococcus pneumoniae
atgttgatatcgtggaggacgatgataatggtcttgccgagttcctccaccagtcgtcgaagaatttgcatcatgctgacgctttgcttgatatcgagattattgagtggttcgtccagcaagataaagtccgtatcctgggccagtaccatagcgataaagacgcgctggagttgcccccctgacaggctattgatgtag

SEQ ID NO: 315 - DNA, 957 bp, Streptococcus pneumoniae
atgcagactaaaagcaaacataccaagctcttctggattctcattattcttgccatcggagcttgtcttctctacttttggcccatcactcacttgtcagcctttgcttggaagttgcgttcccaaaagatcatcgtttatctcttggtagccatcgcgactgggatttcgaccattagttttcaaaccctgacggaaaatcgcttcctgacgcctagtattttgggaattgaatccttctacgtcctactacaaaccctactactggtttttgaaagcaagtttcttcaacttggcaaatcccctatcttagaattcctagtcttacttcttgtccagtccctcttctttctcgccttacaaggttacttgaagacactgatgaagcaagacctggtcttcatcctgctgatctgtctagcgctcagaagtctctttcgaaatatcagcaccttccttcaagtcctaatggatccaaacgaatacgataaactgcaaaatagtctttttgcctcctttcaacatctcaacacttccatcctagccatcggttctctgatcatcctcgctttgacaatctttttctttcgaaaagcagtcgttctagatgtcttgcacctgcaaagagaaacggctcagatattgggactcgatgttgaaaaagaacagaaagagctcctctggggaatcgtgcttttgacctcaacggccactgccttggtaggacctatggccttcttcggctttatgctggccaacctcacctacctgattgtcaaagactatcagcacaagttactctttatagtggccattctgattggatttattagcttaaccttggggcaagccttgattgaacgagtctttgcactggaaattcgtatcagtatgatcattgagagtgtgggtggcttcttattctttatcttactatataggagggctcgtcagtga

SEQ ID NO: 316 - DNA, 960 bp, Streptococcus pneumoniae
atgaaactttctcattatttaattggcttacttctactcctagtctttctctctattagcattgggaccagtgatttttcatggggaaagctatttgatttcgaccagcagacctggctcctctttcaagagtcccgtctcccaagaactatcagtattctcctgactgcctctagtatgagtatggcaggccttctcatgcagactattacccaaaatcagtttgctgcaccgagtacagttggaacgactgaagccgccaaactgggaatggtgctgagcctttttgtctttccatcggctagtctgacccaaaagatgctcttcgcttttgtttcatccatcgtattcaccctcttcttcctagcctttatgaccatttttactgtaaaggaaaggtggatgttgcctctgattgggatcatctatagcgggattatcggctcagtcacagaagttatcgcctatcgtttcaatctggttcagagtatgactgcctggacccagggctccttctccatgattcagacccatcagtatgagtggctcttcttaggcctcatcatcctgataaccgtttggaaattatcccaaaccttcaccatcatgaatctagggaaagaaaccagcgagagtttggggatttcctactccctacttgaaaaactggccctctttctggtggcgctaacgacaagcgtcaccatgattaccgtgggtggcctaccatttctcggagttatcgttcccaatcttgttcgcaagtgctatggagataatctaagtcaaaccaaactcatggtcgcactggttggtgccaatctagttctggcttgcgatatcctatcccgagttctgattaggccctatgagttgtctgtcagtctcttgctaggaatcatcggtagtctcgtctttatcctacttctctggagagggggacgaaaagatgcagactaa

SEQ ID NO: 317 - DNA, 408 bp, Streptococcus pneumoniae
  unsure (62),(115): n at each above location is unknown.
atgaaccagtttctcaaagtcttatctgaagttggcattcaaaaaatcatgttctttttgantgttcttttttatggaaataactgtattgacaagccggtgattgaagataccntgtttgaccctgtcaacccttatgcagagacaaaactgatgggcgaacgaatgatttactggatggccaatcgctacgactggaaatatgttattttccgttactttaatgttgctggggctgaaatggatgcttcaaacggtctgcgtgtgaaaaatccaactcacatcattccaaatatcaacaagaccgcattgggacaaaatgatagcttaaaaatatttggagatgactacgatacacgtgacggttcatgtattcgagattacatttatgtcttggaccttgcatag

SEQ ID NO: 318 - DNA, 243 bp, Streptococcus pneumoniae
atgaccaaaacaattcttgttacaggtgggactagctacattggctcccataccgttaaagctcttttaaatgctggctatcaggtgcatgtcctcgataatctctccacaggaaatcgagcggctgtggatagtcgtgctagctttaaagaactggatgtttatgatgctagcgccttaaaagcttacttaaaaaaaaatcaaattgatgctgtcttcccttttccagttgaaattttttga

SEQ ID NO: 319 - DNA, 1062 bp, Streptococcus pneumoniae
atgacaacattattttcaaaaattaaagaagtaacagaacttgctgcagtctcaggtcatgaagcgcctgtccgtgcttatcttcgtgaaaagttgacaccgcatgtggatgaagtggtgacagatggcttgggtggtatttttggtatcaaacattcagaagctgtggatgcaccgcgcgtcttggtcgcttctcatatggacgaagttggttttatggtcagcgaaatcaagccagatggtaccttccgtgtcgtagaaatcggtggctggaaccccatggtggttagcagccaacgtttcaaactcttgactcgtgatggtcatgaaattcctgtgatttcaggttctgttcctccgcatttgactcgtggaaaggggggaccaaccatgccagccattgccgatatcgtttttgatggtggttttgcggacaaggctgaggcagaaagttttggcatccgtcctggtgataccattgtaccagatagttctgcaattttgacagccaatgaaaaaaatatcatctcaaaagcttgggataaccgctacggtgtcctcatggtaagcgagctagctgaagctttatcgggtcaaaaactcggcaatgaactctatctgggttctaacgtccaagaagaagttggtctgcgtggcgctcatacctctacaaccaagtttgacccagaagtcttcctcgcagttgattgctcaccagcaggtgatgtctacggtggtcaaggcaagattggagatggaaccttgattcgtttctatgatccaggtcacttgcttctcccagggatgaaggatttccttttgacaacggctgaagaagctggtatcaagtaccaatactactgtggtaaaggcggaacagatgcaggtgcagctcatctgaaaaatggtggtgtcccatcaacaactatcggtgtctgcgctcgttatatccattctcaccaaaccctctatgcaatggatgacttcctagaagcgcaagctttcttacaagccttggtgaagaaattggatcgttcaacggttgatttgattaaacattat

SEQ ID NO: 320 - DNA, 297 bp, Streptococcus pneumoniae
atggtagaaccaaacctagaaagccttataaaagatctttacaatcatgctcgacatgatttgagtgaagatttagttgctgctctcctagagactactaaaaaactgcctactacaaatgagcaattgcaggcagttcgtctctcaggcctggtcaatcgtgaattgctcctaaatcccaaacatccagcacctgagttgctcaacttggctcgctttgtcaaaagagaagaagccaagtacagaggaactgcgacttctgcgcttatgtatgaggaactttttaaaatgctttga

SEQ ID NO: 321 - DNA, 189 bp, Streptococcus pneumoniae
aagatttctataaattcatttgattttcctaatcaatttgttcatatcttatttcattccgctataatttcaccttaccctatctttttcgtagcacccttcaaacagcctatcccctaccgtttgacgattcctcacttcactccacttccattacagaagtttcttcactactatggtctcggctga

SEQ ID NO: 322 - DNA, 444 bp, Streptococcus pneumoniae
atgaaagatagtcatttgctagcccatcatattcgtttgttgaatgggcggatttttcaaaagttactgagtcaagatcctgaggctctttataggggtgaacagggcaagattttagcggttttatggaatagtgaaactggctgcgcaactgcgacagatatcgcgcttgcgactgggcttgcgaataatacgctgacgactatgataaaaaagctagaggaacaaaagcttgtaattgttagtccgtgtggaaaagacaagcgtaagaagtatttagttttaacggagttaggcaagtcccagaaagaagtggggcatcgtgtcagtcagaaattggatactatcttttacaaaggattttcagaggaagaaattcaccaatttgaaggttttcaagaaagaattttggcgaatctgaaagagaagggaaatgaggtttag

SEQ ID NO: 323 - DNA, 765 bp, Streptococcus pneumoniae
atgtcacaacaagtgaaaaatgctcacaacctatacatccatgccattcaagacgggcgagttgctgaggctcaagcccagtctgtaggggatacctatatccaacattcgacaggtgttcctgacgggaaagaaggatttgcagccttctttgcagatttctttgagcgtcatccagagcgtcagattaagattgtccgcaccattgaggatggcaatctggtctttgttcatgttcatcaatatctgaatggtggagaagctcaatgggtgacgacggatactttccgtgaggatgagaatggttgtattgttgagcattgggatgtcattgactactatcgaacacctgaaaatgaccaactagatcaaatttttggagattttgaaatcaaggatttggataagaaagcagaaaataaaaagctggttcgccgtttcttgacagaaattttccaaaatggggagctagagcagtggagtgattatgtggcagacgatttgattcagcataatcatgagattggacaaggaagtgctgcttataaaaactatgtggctgaatatagtgtcacttttgactttgttttccaactcttaggacaaggaaactatgtggttagctatggtcagactcagattgatggcgttgcttatgcccagtacgatatcttccgtttagagaacgggaaaattgtggagcattgggataataaggaagtcatgcctaaggtagaagacttgactaatcgagggaagttttaa

SEQ ID NO: 324 - DNA, 729 bp, Streptococcus pneumoniae
atgattgaatacaaaaatgtagcactgcgctacacagaaaaggatgtcttgagagatgtcaacttacagattgaggatggggaatttatggttttagtagggccttctgggtcaggtaagacgaccatgctcaagatgattaaccgtcttttggaaccaactgatggaaatatttatatggatgggaagcgcatcaaagactatgatgagcgtgaacttcgtctttctactggttatgttttacaggctattgctctttttccaaatctaacagttgcggaaaatattgctctcattcctgaaatgaaggggtggagcaaggaagaaattacgaagaaaacagaagagcttttggctaaggttggtttaccagtagccgagtatgggcatcgcttacctagtgaattatctggtggagaacagcaacgggtcggtattgtccgagctatgattggtcagcccaagattctcctcatggatgaacccttttcagccttggatgctatttctcgcaagcagttgcaggttctgacaaaagaattacataaagagtttgggatgacaacgatttttgtgactcatgatacggatgaagccttaaagttggcagatcgtattgctgttttgcaggatggagagattcgtcaggtgtcgaatcctgagactattttaaaagctcctgcaacagactttgttgcagacttgtttggaggtagtattcatgactaa

SEQ ID NO: 325 - DNA, 222 bp, Streptococcus pneumoniae
ccaatcatagctcggacaataccgacccgttgctgttctccaccagataattcactaggtaagcgatgcccatactcggctactggtaaaccaaccttagccaaaagctcttctgttttcttcgtaatttcttccttgctccaccccttcatttcaggaatgagagcaatattttccgcaactgttagatttggaaaaagagcaatagcctgtaaaacataa

SEQ ID NO: 326 - DNA, 933 bp, Streptococcus pneumoniae
atgactaatttaattgcaacttttcaggatcgttttggtgattggttgacagccctatctcaacatttgcagttgtcacttttgaccttgttactagctattttgcttgcgattcccttggctgtttatcttcgctatcatgagaagttggcggattgggtcttacagattgcagggattttccagaccatcccgtctctggccttgttgggactctttattcccttgatgggaattgggactttaccggcattgacagctctagtgatttatgcgatttttccgattttacaaaatactattactgggctgaagggaattgatccgagtcttcaagaggctgggattgcctttgggatgaccagatgggagcgtctcaagaagtttgaaattccacttgccatgcctgttatcatgtctggaattcggacggcagcggtcttgattatcggtacggctaccttggcgaccttgattggggcagggggactgggttcctttatcctgttgggaattgaccgtaataatgccagtttgattttgattggggccctttcttctgcagtgctagctattgcctttaacttcctactaaaagtaatggaaaaagcgaaattgcggacgattttctctggttttgccttggtggctttattactgggtctgtcttatagtccagcccttttggctcaaaaagagaaggaaaacttgattattgctgggaaaataggcccagaaccagaaattttggctaatatgtataaattgctgattgaagaaaataccagcatgactgcgactgttacaccgaattttgggacgacaagtttcctttatgaagctctgaaaaaaggtgatattgacatttatcctgaatttaccggtacggtgactgaaaagtttgcttcaaccatcacccaaggtgagtcatga

SEQ ID NO: 327 - DNA, 630 bp, Streptococcus pneumoniae
ctgaaaagtttgcttcaaccatcacccaaggtgagtcatgagccagagcaggtttatcaagtggcgcgtgatggcattgccaagcaggatcatctagcctatctcaaacctatgtcttatcaaaatacctatgctgtagctgttccgaaaaagattgctcaagaatatggcttgaagaccatttcggatttgaaaaaagtggaagggcagctgaaggcaggctttacgcttgagtttaacgaccgtgaagatggaaataagggcttgcaatcaatgtatggtctcaatctcaatgtggcgactatgcagccagctcttcgttatcaggcaattcagtcaggggatattcaaatcacggatgcctattcgactgatgcggaattggagcgttatgatttacaggtcttggaagatgacaagcaactcttcccaccttatcaaggggctccactcatgaaagaagctcttctcaagaaacacccagagttggaaagagttcttaatacattggctggtaagattacagaaagccagatgagccagctcaactaccaagtcggtgttgaaggcaagtcagcaaagcaagtagccaaggagtttctccaagaacaaggtttgttgaagaaatga

SEQ ID NO: 328 - DNA, 810 bp, Streptococcus pneumoniae
atgatgcatacttatttgcaaaagaaaattgaaaatatcaaaacaaccctaggtgaaatgtcaggtggttaccgtcgtatggttgcggctatggctgatttaggattttcaggaactatgaaggctatctgggatgacctctttgcccatcgtagttttgcccagtggatttatttgctggttttaggaagttttcctctctggctggagttggtttacgaacatcgtattgttgactggattgggatgatttgtagcttgacagggattatctgtgtaatctttgtatcggaaggtcgagcaagtaattatctttttggcttgattaactctgttatttaccttattttggccctacagaaaggcttttatggtgaggtgctgacgacactttacttcacagtcatgcagccaattggacttctagtttggatttatcaggcacagtttaagaaggaaaagcaggagtttgtcgcgcgtaaactggacggcaagggctggacaaagtatctttccattagtgtgctttggtggttggcctttggcttcatttatcagtctattggtgccaatcgtccctatcgtgattcaatcacagatgcaaccaatggggtagggcaaatcctcatgacagctgtttaccgtgaacagtggatattctgggcggctaccaatgttttttcaatctatctctggtggggagaaagcctgcaaattcaagggaaatatctaatttatctcattaacagtctagttggttggtatcaatggagcaaggcagctaagcagaatactgatttacttaactag

SEQ ID NO: 329 - DNA, 537 bp, Streptococcus pneumoniae
atgactaacattgaccgccgtatcagcaaaaccaaaaaagccatctatcaagcttttatacaacttttgaatgctaagggctacgaggccactactgttcaggatatcattgatctcgcagatgtgggacgatccaccttttactgtcactatgagagtaaggagcttcttctggaccagctctgccgctacctcttccatcatctttttgaaagagagcaagccatttcaaccgaggactacctcgcccacctctttctccattttcataaaaaccaagaccatatcaccagtctgctattttccaaaaatgactacttcctccgtcaactccataaagagctagaacaccatgtctattccgtgctagctgataatttaaaagaagcccaccctaatatgcctacttcttacctccaacacttggtcgtgtccaactttatcgagacattgacctggtggctcaaaaaaggtcaagatttcacaggccaggaagttgtccaattttatctagaccttctcattcctaaaaattga

SEQ ID NO: 330 - DNA, 900 bp, Streptococcus pneumoniae
atgagaaatatgaaggcaaaatatgctgtttgggtggcttttttcttaaatttgacttatgccattgttgagtttattgcaggtggaatatttggttctagcgctgttcttgctgactctgtgcatgacttggtagatgcgattgcaattggaatatcagcttttctagaaacaatctccaatcgtgaagaagacaatcagtacaccttgggctataagcggtttagcctgctaggagccttggtaacagctgtgattctcgtaacgggctctgttctagtcattttggaaaatgtcacgaagattttgcatccgcaaccagtcaatgatgaggggattctctggttaggaattattgcgattactatcaatctgttagcgagtctggtggttggtaagggaaagacaaagaatgagtctattctgaatctgcattttctggaagatacgctagggtgggtagctgttatcctgatggcgattgttcttcgatttacggactggtatatcctagatcctcttttgtcccttgtcatttctttctttattctttcaaaagccctttcacgtttttggtctacactcaagattttcttggatgctgtgccagaaggtcttgatatcaagcaagtaaagagtggcctggaacgattggataatgtggccagccttaatcagcttaatctctggactatggatgctttggaaaaaaatgccattgtccatgtttgtctaaaagaaatggaacatatggaaacttgtaaagagtctattcgaattttcctaaaagattgtggttttcaaaatattaccattgaaattgatgctgacctagaaactcaccaaacccataagcgaaaggtgtgtgacttggaacggagttatgagcatcaacattag

SEQ ID NO: 331 - DNA, 354 bp, Streptococcus pneumoniae
gtgaatattaaatctgccagtgatttgttgggaatttcagcggatacgattcggtattatgaacgggttggtcttgtgccaccgattactcgtactgctactgggattcgtgattttcaagatcaggatatcgaagcgctggaatttattaagtgttttcgttcggcgggtgtctctgtagatagtttagttgactatatgtcgctctaccaaaagggagatgaaacgagagaggagaggcttggtattttagaagaggaaaagcaaaaattagaggagcgcttgtctcagctacagacagctttaaatcgtttaaatctcaaaattaaactttataaggaaggaaaattttaa

SEQ ID NO: 332 - DNA, 1038 bp, Streptococcus pneumoniae
atgaaatcagcagtatatacaaaggcaggtcaggttggacttgctagcattgaacgtccgcaaataatagaagcggatgatgtgattattcgtgtggttcgtgcgtgcgtttgtggttcagatttatggaggtaccgtaatccagaaacgaaagctggacataaaaatagtggacacgaagcgattgggattgttgaagaagctggggaagccattacgacggtgaaaccaggtgattttgtgattgtcccttttacacatggatgtggtgagtgtgatgcctgtcttgctggatttgacggttcttgcgacaatcatattggtaataatttggggggtgattttcaggcagaatatattcgcttccactatgcaaactgggcgctggttaaaatccctggtcaaccttctgattatacagaagggatgctcaagtcccttttgactcttgcagatgtcatgccgacaggctatcatgcagcgcgtgttgcaaatgttcaaaaaggggacaaggttgttgttatcggtgatggggctgttggtcaatgtgctgtcatcgcggctaagatgcgtggagcatcacaaattatccttatgagccgtcatgaagaccgtcaaaagatggctatggagtcaggtgcgacagctgttgttgcagaacgtggtcaagaaggaattaccaaggtgcgtgaaatcctcggcggaggagcagacgcagcacttgaatgtgttggtacggaggctgctatagaacaggcgctaggtgttcttcataatggagggcgtatgggctttgtaggagtcccacactataataatcgtgctcttggttcgacatttatgcaaaatatctctgtagcaggtggggcagcttctgctacaacatacgataagcaatttttactaaaagccgtccttgatggtgatatcaatccaggtcgcgtctttacttcaagttataaactggaagatatcgaccaagcctataaagatatggatgaacgtaagacaattaagtctatgattgtaatcgaataa

SEQ ID NO: 333 - DNA, 1008 bp, Streptococcus pneumoniae
atggctaccttaaaagacattgcacagctagcctctgtctctatcgcgaccgtatcccgcgtcctcaaccgcgaccagagcctatctgttacagaagaaaccagacaccgtattttaaccgttgctgaagagctgggctacaccaagcacctcaagacaggcgagtcccataaacccaagcaaaagattgccattattcaatgggtcagcgaacaaggggagctagacgacctctactactaccagattcgcctaggaatagaaaaaagagcccaagagttggactacgatatcttgcgctattttaatgaccatccttttaccttaagcgaggaagtgattgggattctctgcatcggaaaatttagccgagctcagatttctgcctttgaagaataccaaaaacccctggtctttctagacagtgatacactttccctcggacatacctgcattattacggacttttacactgccatgaaacaggttgtcgattatttcctcagtcaagggatggaccgtatcgggattctaacaggccttgaagaaacaactgaccaagaagaaatcattgaggataagcggctggaaaatttcagaaactacagtcaagcaaaaggaatctatcatgatgaactggtctttcaaggaagatttactgcccagtctggctatgacttaatgaaggaggccattcagagcttgggagaccaacttccgccagcatttttcgcagccagcgatagtttagctatcggtgccctccgtgccctccaagaagctggaatcagcctgccagatcgcgtcagcctcatttcctttaacgacactagtctgaccaaacaggtctatcctcccctctctagtattacagtttatactgaagaaatgggccgagcaggtatggatattcttaacaaggaagtcctccacggtcggaaaatccctagcctgaccatgctgggaaccagactgacattaagagaaagtaccctaaatcaagaatag

SEQ ID NO: 334 - DNA, 1179 bp, Streptococcus pneumoniae
atgacacaacatcttactgctgaaactcttcgcaaagactttcttgctgtttttggtcaagaagcagaccaaattttcttttcaccaggtcgtatcaatttgattggtgaacacacagactacaacggtgggcacgtttttcctgctgctatttccttgggaacttacggtgcagctcgtaagcgtgacgaccaagtcttgcgtttctactcagctaactttgaggacaagggcattatcgaagtgcctctcgctgacctcaagtttgaaaaagagcacaactggaccaattatccaaaaggtgtccttcatttcttgcaagaagctgggcacgtgattgacaaaggttttgatttttatgtttatgggaatatcccaaatggtgctggtttgtcttcttcagcatcccttgaactcttgacaggggtagtggcagagcatctctttgatttaaaattagagcgtctcgatttggttaaaatcggaaaacaaacagaaaataactttatcggagtaaattctggcattatggaccaatttgctattggtatgggggctgaccaacgtgctatttacttagataccaatactttagaatacgacttggtgccacttgatttgaaggacaatgtcgttgttatcatgaacaccaacaaacgccgtgaattggcggactctaaatacaatgaacgtcgtgctgagtgtgaaaaagcagtggaagaattgcaagttgccttggatattcagaccctgggtgaattggacgagtgggccgttgaccaatatagctatctgattaaagatgaaaatcgtttgaaacgtgctcgccatgctgtgcttgaaaaccaacgtacccttaaagctcaagcagcccttcaagcaggtgatttggaaacatttggtcgtttgatgaatgcgtcacacgtttctctggagcatgattatgaagtaactggtttggaattggatactcttgttcacacagcttgggcacaagaaggagttctcggtgctcgtatgacaggggctggttttggtggctgtgccattgccttggttcaaaaagatactgttgaggcctttaaggaagctgtaggcaaacactacgaggaagtagttggatacgctccaagcttctatatcgctgaagttgcaggtggcactcgcgtccttgactag

SEQ ID NO: 335 - DNA, 1482 bp, Streptococcus pneumoniae
gtgatcttagtagataaatttgtaacacatgtcatttctgaaagttcatttgaggaaatggatcgaatctacctgaccaaccgtgttttggcacgagtgggagaaggtgttttggaagttgagaccaatctggataaattgattgacctcaaggaccagctagttgaggaagccgttcgattagagatgattgaggatagtcagactgcgcgtgaaatccttggtactgaactgatggacttggtgactccttatccgagtcaggtcaatcgtgacttctgggaagcctatgtccactctcctgagcaagcgatagaggatttttatcaactcagtcagaaaaatgactacatcaaactcaaggccattgctaaaaatatcgcttatcgtgttccatctgattatggagaacttgaaattaccatcaatctctctaagcctgaaaaggatccgaaagagattgcggtagccaagttggtgcaagctagtaattatcctcagtgtcaactttgtttagagaatgagggttaccatggtcgggtcaaccacccagctcgcagcaaccaccggattatccgttttgaaatggttggtcaggaatgggggttccagtattcgccctatgcttactttaatgagcattgtatttttttagatggccagcatcgtcccatggccattagtcgtcagagttttgaacgtctgttggctatcgtagagcagtttccaggatattttgctggatctaatgccgacctgccgattgtggggggctctattctaactcacgatcattatcagggaggccgtcacgtatttcctatggaattggctcccttgcaaaagaccttccgatttgctggttttgagcaggtcaaggctggaattatcaagtggccaatgtctgtcctacgcttgacttcggattccaaagaggatttgattaacttagctgataagattttccaggaatggcgtcagtattcagattctagtgtgcagattttagcagagacagacgggacaccgcatcacaccatcacaccaatagcgcgtaagcgtgatggacagtttgagttggacttggtcttgcgagacaatcagacttcagcagagcatcctgatggcatctatcatccccacaaggatgtccaacatatcaagaaggaaaatatcggcttgattgaggtcatgggcttggcaatcttgccaccacgtctgaaagaagaagtggagcaagtcgctagctatcttgtaggagaagctgttacagttgccgattatcatcaggagtgggcagaccaactcaaatcccaacatccagacctaacggataaagaaaaagcccttgcaatcgtcaaggactctgtgggtgctatctttgtgcgtgtacttgaggatgcaggagtctacaagcagacagaacaagggcagacagcctttatgcgctttgtggaacaggtcggaatttcactagactag

SEQ ID NO: 336 - DNA, 405 bp, Streptococcus pneumoniae
atgaaagactttcattttgacgctatatctgcctttgaaaattacgaaattgaaaaaatgagagatggtcacgttgtggtgacgaccaaagtagtgaactcgtcgctcaactactatggcaatgcccatggtggctatctattcacgctatgtgaccaaatcagtggtttggtggttatctcgctgggacttgatggggtgacactccaatcctctatcaactaccttaaggcaggaaaactcgacgatgtattgaccattaaaggagaatgtgtccatcaaggtcgtacaacctgtgtgatggatgtggatatcaccaatcaagagggcagaaatgtctgtaaagcaacctttaccatgtttgtcacaggccaaaggtctgaggaaagacgggtaagtatataa

SEQ ID NO: 337 - DNA, 888 bp, Streptococcus pneumoniae
ttgtgttttaatttctatggtataattaaaagcatgaagataaaagaaataaagaaagttactttacaaccgttcacgaaatggacaggtggtaaaagacaattattgcctgttattagagaattaatacctaaaacctataacaggtatttcgaaccttttgttggaggtggagctttattttttgatttggctcctaaagatgcagttattaatgattttaacgctgaactaataaattgctatcaacaaattaaggacaatcctcaagaattgattgaaattttgaaagttcatcaggaatataattcaaaagaatattatttagatttacgttctgcagatcgtgatgaaagaatagatatgatgtccgaagtacaaagagctgcacgtattctatatatgttgagagtgaactttaatggtctatatcgtgtgaattctaagaaccaatttaatgttccatatggacgttataagaatcctaaaattgttgatgaggaattgatatctgctatttcagtttatctaaataacaatcaactagaaattaaagtgggagattttgaaaaggcaattgtagatgttcgaacaggagattttgtgtattttgaccctccatatattccattgtctgagacgagtgcatttacgtcttatactcatgagggattctcttttgcagatcaagtaagattaagagatgcctttaagagattgagtgatacaggagcttatgttatgttatcaaattcttctagtgctttagtagaggagttgtataaggattttaatatacattatgttgaagctacccgaactaatggagcaaaatcttcaagtcgaggaaaaatttctgaaattatagtcacaaattatgaaaaataa

SEQ ID NO: 338 - DNA, 771 bp, Streptococcus pneumoniae
atgacaaaaccatactacaataaaaataagatgattcttgttcattcagatacgttcaagttcttatcaaaaatgaaaccagaaagtatggatatgatttttgctgatccaccttattttttaagtaatggtggaatatctaattctgggggacaagttgtttctgttgataaaggagattgggataaaatttcttcattcgaagaaaaacatgagtttaatcgtaaatggattcgcctagcaaaagaagttctgaagcctaatgggacggtatggatttcaggtagtttgcacaacatatactcagttggaatggcattagaacaagaaggttttaaaattctgaataatattacttggcagaaaacaaaccctgcccccaatttatcttgtcgttattttacccattctactgaaaccattttatgggccagaaaaaatgataaaaaagctcgtcattactacaattatgatttaatgaaagaattgaatgatggaaaacaaatgaaagatgtctggaccggttctttaacaaagaaagttgaaaaatgggctgggaaacatccaactcaaaaaccagagtatttgttagaacgcattattttagcctctactaaagagggtgactatattctagacccatttgttggtagtggcactacgggtgttgttgcgaagcggttaggtagaagatttataggtatcgatgctgaaaaagaatatttaaaaattgcaaggaagaggttggaggcagaaaatgaaacaaactag

SEQ ID NO: 339 - DNA, 867 bp, Streptococcus pneumoniae
atgaaacaaactagaaattttgatgagtggttgtcaacgatgaccgacacagtagctgactggacttattatacagattttcctaaggtttataaaaatgtatctagtataaaagttgctctaaatattatgaatagtcttattggtagtaaaaatatacaagaggattttttagacttatatcaaaattatccagaaattttgaaagttgtgcctctacttattgctaaacgtttgagagatacgattattgttaaggatccgataaaagatttctattttgattttagtaaacgaaactatagtattgaagaatatactatgtttttggaaaaatcaggtatatttgatttattgcaaaatcatttagtatcaaatttagttgactacgttacaggtgttgaggttggtatggatactaatgggcgcaaaaatcggactggagatgcgatggaaaatattgttcaaagttatcttgaagctgaagggtatattttaggagagaatttatttaaagagattgaacaaaatgaaatagaggaaattttttctgtcgatttatctgctattacgaatgatgggaatactgtgaaacgttttgattttgtcataaaaaatgaacaagtgctttatctgattgaggttaatttttattcaggaagtggttcaaaattaaatgagacggctagatcttacaaaatgattgctgaagaaactaaagctattcctaatgttgagtttatgtggattactgatggacaaggttggtataaggctaagaataatttacgagaaacatttgatattttaccattcttatataatattaacgatttggaacataatattttaaagaatttgaaatag

SEQ ID NO: 340 - DNA, 357 bp, Streptococcus pneumoniae
  unsure (28): n at each above location is unknown.
agactggctaccaatttaataacgcagntggtttcttggttctccttggactctttccttaagtttggcgcccttgcccaaatcattccaagccctgtcctcggtggtgccatgctggtgatgtttgtttttgtatcgattcaagggatgcaaatcctcgcccgtgttgactttgctaacaatgaacacaacttccttatcgcagctgtttcaatcgctgcaggtgtcggactcaataacagtaatctctttgtcagcatgccgacagccttccaaatgttcttctcaaacggaatcgtcgtagccagcctactcgctattgtcctcaatgccgtattaaatcataaaaagaaataa

SEQ ID NO: 341 - DNA, 849 bp, Streptococcus pneumoniae
atgcaaactcaagaaaaacactcgcaagcagccgttcttggcttgcagcacttactagccatgtactcaggatctatcctggttcccatcatgattgcgacagcccttggctattcagctgagcagttgacctacctgatttctacagatatcttcatgtgtggggtggcaaccttcctccaactccaactcaacaaatactttgggattggactcccagtcgttcttggagttgccttccaatcggtcgctcccttaattatgattgggcaaagccatggtagtggcgctatgtttggtgcccttatcgcatctgggatttacgtggttcttgtttcaggcatcttctcaaaagtagccaatcttttcccatctatcgtaacaggatctgttattaccacaattggtttaaccttgatccctgtcgctattggaaatatgggaaataacgttccagagccaactggtcaaagtctcttgctttcagctattactgttctgattatcctcttgatcaacatctttaccaaaggatttattaagtctatctctattttgattggtctggttgttggaactgccattgctgctagcatgggcttggttgacttctctcctgttgcagcagcaccggttgtccatgtcccaactccattctactttgggatgccaacctttgaaatctcatctattgtcatgatgtgtatcatcgcaacggtgtctatggttgagtcaactgggttgtttatctggccttgtctgatatcacaaaggatccaatcgacagcaccgcctgcgcaacggataccgcgcagaaggtttggcctaaatttttggggggatttttaa

SEQ ID NO: 342 - DNA, 582 bp, Streptococcus pneumoniae
atgaaattattagaagatcgcatcctcaaggatgggcatatcttgggtgataacatcctcaaggtagattcctttttaacccaccaagttgactttagcttgatgcgagagattggtaaggtttttgcggaaaaatttgctgctgccggcattaccaaggtcgtaaccattgaagcgtcgggtattgccccagccgtttttacagctgaagccttaaatgttcccatgatttttgccaaaaaggctaaaaacatcaccatgaacgaaggtatcctaactgcccaagtctactcctttaccaagcaagtgaccagcaccgtttctatcgctggaaaattcctctcaccagaggacaaggtcttgattatcgacgatttccttgctaatggccaagctgctaaaggcttgattcaaatcatcgaacaggccggtgccacagtccaagctatcggtatcgtgattgagaaatccttccaagatggtcgtgatttgcttgaaaaagcaggctaccctgtcctatcacttgctcgcttggatcgttttgaaaatggtcaggtcgtatttaaggaggcagatctctaa

SEQ ID NO: 343 - DNA, 174 bp, Streptococcus pneumoniae
atgccttttatgatggaaaaatcttctaatactcttcgaaaatctcttcaagccacgtcaacgtcgccttaccgtaggtatatgatactgactctgtcaattctatccacaacctcaaaacagtgttttgaggttgtggatagcttcctagtttgctctttgattttcatttag

SEQ ID NO: 344 - DNA, 240 bp, Streptococcus pneumoniae
atgttagaggagggaacaaaggatcaactagctgaactgacctacccctttggtcgtggagtcaatctctcctttggcataaaggatgttccaaaactctatcaaaaagtgatggaggcaaactatcctatttatcgtctcttgaccaaaagaaagtttcgtgtcagtgatccctatatctatcctcataaatttgcagttttggatccagatggctattttttaagatttagcgagtag

SEQ ID NO: 345 - DNA, 828 bp, Streptococcus pneumoniae
atgaaacttatctcatggaatattgattccctaaacgctgccctaactagtgactcagctcgtgccaaattgtcccaagaagtcctacaaaccttggtcgctgaaaatgctgatatcattgctatccaagaaaccaagctttctgccaaaggacctacaaagaaacacgtggaaattttagaagaactcttcccaggctacgaaaacacatggcgctcttcccaagagcctgcccgtaaaggctatgctggaaccatgttcctttataagaaagaacttacgcctacgatcagttttccagaaatcggtgccccttctaccatggacttggaaggccgtatcatcactctagaatttgatgcatttttcgtaacccaagtttacactccaaacgctggtgacggtctcaaacgcttggaagaacgccaagtctgggatgttaaatatgctgagtatttggctgaactagacaaagaaaaaccagtccttgcgaccggtgactacaacgtagcccacaatgaaatcgaccttgcaaatcctgctagcaaccgccgttcacctggatttactgacgaggaacgtgctggatttaccaaccttttggcaactggatttacagacaccttccgccatgttcatggcgatgttcctgaacgctacacttggtgggcacaacgcagcaaaacttctaaaatcaacaatacaggctggagaatcgactactggctcacaagtaaccgtatcgctgacaaggtcactaaatctgatatgattgactcaggtgctcgccaagaccatacaccgattgtcttggaaattgacttgtaa

SEQ ID NO: 346 - DNA, 228 bp, Streptococcus pneumoniae
atgaaattctactcttatgactatgtactcagccaaatcggtcagcaaaatggtatcatggttggctttgggattgttctattagctgtgacagttttttttgctttcaaggcataccatgataaaaagggaaccgaatttcgtgagttggtcatgatttcagctctggccttatttagctctgcttttggtcagcatcacgacttatcaaaacaatcaagtttctaa

SEQ ID NO: 347 - DNA, 270 bp, Streptococcus pneumoniae
ttggtcagcatcacgacttatcaaaacaatcaagtttctaacaataaatttcaaacttcacttcatttcatcgaggttgtttccaaagatttgggagtagacaagtcagaagtctatgttaatacttccacaaacacagatggcgcacttatcaaggtgggagatcgctattatcgtgccctaaacggaagtgagccagacaagtacctgttagagaaagtcgaattgtataagacagacgcaattgaactggtggatgtgaacaaatga

SEQ ID NO: 348 - DNA, 531 bp, Streptococcus pneumoniae
atgacacttaattatatcgaaattttaatcaaactggtcttgactctcaaatggctcaacaacaatgttcactttgtgaaacgtttgattgatggtaagccaactctccttatcaaaaatgggaatattgacccagaagcctgtcgttcagttggtttgtctgcatcggatgtagccctcaaacttcgtagccaagggattttccagatgaagcaagtcaaacgagctgtgcaagagcaaaatgggcaacttatcgttgtgcaaatgggagatgaaaatcctaagtatccagttgtgactgacggtgtgattcaagtagatgtcttggaatcgattggtcgtagcgaagagtggttgcttgataacctcagtaaacaagggcatgacaatgtagccaatatctttattgctgaatatgacaagggtgctgttacagtcgtaacttatgaaaaagaaaaacctggggtcttgtactcttcgaaaatctcttcaaaccgcgtcaacgtcgccttgccgtatgtaggttactga

SEQ ID NO: 349 - DNA, 237 bp, Streptococcus pneumoniae
tggggtcttgtactcttcgaaaatctcttcaaaccgcgtcaacgtcgccttgccgtatgtaggttactgacttcgtcagttctatctacaacctcaaagcagtgctttgagcagcctgcggctagtttcctagtttgctctttgattttcattgagtattggcctcaggtttccatttgcaatcagaaagggattttatgtccattattcaaaaactttggtggtttttcaagttag

SEQ ID NO: 350 - DNA, 1746 bp, Streptococcus pneumoniae
atgtccattattcaaaaactttggtggtttttcaagttagaaaaacgccgttatctagtcggaattgtggccctggtcttggtttccgtcctcaatctcattcctcctatggttatggggcgggttattgatgccatcacatcggggcaattaacccagcaggacctccttcttagcctattttacttgctacttgcagcctttggtatgtactatttgcgctatgtgtggcgtatgtatatccttgggacctcttattgcttgggacagatcatgcggtctcgcttgtttaagcatttcacaaaaatgtcgtcagccttttatcaaacctatcggacgggtgatctgatggcacacgcaaccaatgatatcaatgccttgactcgtttagcaggtggcggtgtcatgtctgcggtggatgcctctatcacggctctggtgactttgttgaccatgctctttagcatctcatggcagatgactcttgttgccattctccccctacctttcatggcctatgcgactagtcgcctagggagaaagactcataaggcctttggcgaatcccaagctgctttttctgaactcaataacaaggtacaggagtccgtatcaggtatcaaagtgaccaagtctttcggttatcaggcagacgagttgaagtcttttcaggcagtcaatgaattaaccttccaaaagaacctgcaaaccatgaaatatgatagtctctttgaccctatggttctcttgtttgttggttcgtcctatgttttaacgcttttggttggctccttggtggttcaggaagggcagattacagttgggaatctagtcacctttatcagctatttggatatgctggtctggcctcttatggccatcggcttcctctttaatactactcagcgagggaaggtttcttaccagcggattgaaaatcttttgtctcaggaatctcctgtacaagacccggagtttcctctggatggtattgaaaatgggcgtttggagtatgccattgacagctttgcttttgaaaatgaggaaacactgacggatattcactttagtttggcaaaagggcaaacactgggcttggttgggcagacaggctctgggaaaacgtccttaatcaagctcctcttgcgtgaatacgatgtggataagggcgccatttatctaaacggtcacgatattcgggactatcgtctgacagaccttcgcagtctcatgggctatgttcctcaggaccagtttctttttgcgacttcaatcctagacaatatccgctttggtaatcctaacttgcccctttcagcggtcgaggaagctactaagctagcccgagtttaccaagatattgtagacatgcctcaaggatttgatacgctgattggtgaaaaaggagtcagtctttctggtggtcaaaagcaacggttggctatgagtcgggctatgattttagaccctgatatcttgattttggatgattccttatccgccgtagatgccaagacagagtatgcgattatcgacaacctcaaggagacgcgaaaggacaagacaaccattatcactgcccatcgcctcagtgcagttgtccatgcagatttgattttagtcctgcaaaatggtcaaattatcgaacgaggcaggcacgaagacttgctagctttggatggctggtatgcccaaacctaccagtctcagcagctggaaatgaagggagaagaagatgcagaataa

SEQ ID NO: 351 - DNA, 882 bp, Streptococcus pneumoniae
atgcagaataaacaagaacaatggactgtattgaagcgcttgatgtcctatctcaagccttatggactccttacctttttggcactcagttttctcctagcgacgacggtcattaaaagtgtcattccccttgtggcttcccactttatcgaccagtatctcagcaatcttaaccaactagccgtgaccgttttgctggtctactatggtctctacatcctacaaactgtagttcagtatgtcggcaatcttctctttgcgcgcgtgtcttacagtattgttagggatattcgtcgggatgcctttgccaatatggagaaactgggcatgtcttactttgacaagacgccagcaggttctatcgtttctcgtttgaccaacgataccgagacgattagtgatatgttttctgggattttatccagctttatctcagcagtttttatctttctgacaaccctttataccatgttggtgctggattttcgtttgacagcattagtcttgctctttctccccttgattttccttttggtcaatctctatcgaaaaaagtcagtgaaaatcatcgagaaaaccagaagtctcttgtcagatatcaatagtaagctggcagagaatatcgagggaatcaggattattcaggcttttaatcaagagaagcgcctgcaggcagaatttgatgaaatcaaccaagagcacttggcctatgccaaccgttctgtagccttggatgccctctttttgagacctgccatgagtttgttgaaacttctaggttatgctgtcttgatgacctattttggctatcgtggtctttctatcgggataacggccgggaccatgtatgcttttatccagtacatcaaccgccctctttga

SEQ ID NO: 352 - DNA, 207 bp, Streptococcus pneumoniae
atgcttttatccagtacatcaaccgccctctttgaccctttgattgaggtgacgcaaaacttttcaacactgcaaacgtctatggtttctgcaggccgtgtctttgccttaatcgatgagagcacctatgagccccttcaagaaaatgggcaagccaaagtcaaggagggcaatatcagttttggaacatgtgtgtatctcgtatga

SEQ ID NO: 353 - DNA, 792 bp, Streptococcus pneumoniae
atgagagcacctatgagccccttcaagaaaatgggcaagccaaagtcaaggagggcaatatcagttttggaacatgtgtgtatctcgtatgacggtaaacatccgattctggatgacatttctttctctgttaataagggtgaaaccattgcctttgtaggtcatacaggttcagggaaatcgtctattatcaatgtcctcatgcgcttttatgaattccagtcagggagagttctcttggatgatgtggatatcagggatttcagtcaagaagagctgagaaaaaacatcggtttggttttacaggaacccttcctctatcatggaactattaagtccaatatcgccatgtaccaagaaatcagtgatgagcaggttcaggctgcggcagcctttgtggatgcagattcctttattcaagaacttcctcaggggtacgactcccctgtttccgagcgtggttcgagcttctctactgggcagcgccagctttttgcctttgctagaacagtcgccagccagcctaaaatcctgattttggatgaagcgacagccaatattgactctgaaacagaaagtttggttcaagcttctctggcgaagatgagacagggccgaacaactattgctatcgctcaccgcctttctactattcaagacgccaactgcatctatgtcttggataagggacgcattatcgagagtggaacccatgaggaactcttgactctgggaggaacctatcacaagatgtatagtttgcaggcaggggccatggcctatactctttga

SEQ ID NO: 354 - DNA, 696 bp, Streptococcus pneumoniae
atgctgaaatgggaagacttgcctgtggaaatgaaatcaagcgaggttgagtcttactaccagcttgtctctaaaaggaagggttcgctgattttcaagcgttgcttggactgggttttggccttggtgcttacatgggttctaacttctcccatctttctcatcttgagcatttggatcaagttggatagcaaggggccagtgatttacaagcaagagcgtgtgacccagtacaaccgtcggttcaagatttggaagttccgtaccatggtgacggatgcggataaaaaaggaagtctggtgacttctgctaacgatagccgtattaccaaggttggaaatttcatccgacgtgtccgtttggacgaactgcctcagttggtcaatgtccttaaaggtgagatgtcctttgtcggtacacgacctgaagtgccacgttatacagagcagtatagccctgaaatgatggcaaccttgctcttgcaagcaggaattacctctccagccagcatcaactacaaggatgaggacaccatcatcagtcaaatgacggagaaaggtctgtcagttgatcaggcctatgtggagcatgttcttcctgaaaagatgcgctataacctcgcctatctccgagagtttagtttctttggggacatcaaaatcatgtttcaaaccgtgtttgaggtactaaaataa

SEQ ID NO: 355 - DNA, 1227 bp, Streptococcus pneumoniae
atgccaaattacaatattccattttcaccgcctgatatcacagaagcagaaattgctgaagtagcggataccctgcgttctggttggatcacaacaggtcctaaaacaaaagaactggagcgccgcttgtctctttacacacagacacctaagactgtttgtctcaactctgcgacagccgctctggagttgattttacgcgttttggaagtgggacctggtgatgaagtcatcgttccagccatgacctatacggcttcatgtagtgtcattacgcacgtgggagcaacccctgtcatggtggatatccaagcagatacgtttgagatggactatgacctgcttgagcaagctatcactgagaaaactaaggtgattatcccagtagagctcgcagggattgtttgcgattatgaccgtttgttccaagtcgtggagaaaaaacgtgacttctttaccgcttcaagcaagtggcaaaaggcctttaaccgtattgtcattgtctctgatagtgcccacgctttgggatctacttataaaggacaaccttctggttctatcgctgattttacttccttctcattccatgccgttaagaactttacaacggcagaaggtggaagtgcgacttggaaagccaatccagtgattgatgacgaagagatgtacaaggaattccaaatcctttcccttcacgggcaaactaaggatgctcttgccaagatgcaactggggtcatgggaatacgatatcgttacaccagcctataagtgcaacatgaccgatatcatggcttcacttggtttggtacaattggaccgctatccaagtttgttgcaacgccgtaaggacattgtggaccgctatgatagtggttttgcaggttctcgcatccatcctttggcacacaagactgaaactgtcgaatcttcacgccacctctacatcacccgtgtagaaggagcaagcctagaagaacgcagcctcatcatccaagaattggctaaagcaggaattgcaagtaatgttcactacaaaccgcttcctctcttgacagcctataagaatcttggatttgatatgacgaactatcctaaggcctatgccttctttgagaatgaaattaccctccctcttcatactaaattaagcgatgaagaagtagactatatcattgagactttcaaaacagtttctgaaaaagtgctaactttatcaaaaaaatga

SEQ ID NO: 356 - DNA, 189 bp, Streptococcus pneumoniae
ggcctctttctcctcagagagagaatttttataggattttcctttcttgtgggagtcccgtggtttgaaataagatgtgagcaatttggtgtagcatttagaatccttactagacatcatttagaaaatctagtgtcttgttctagttttcaattcaccctattttttgaaagacgtgagtttccatga

SEQ ID NO: 357 - DNA, 267 bp, Streptococcus pneumoniae
gaaatatattgtagtgttttagtttcaatccgccatatgagcgatattaaggtaaatatccctggcgaatgcttgtatgacaaggtatttgttctttcatttataatttacaacatatcaataaatttaaatatagtaaatgggatattttatattcaagctaagaaagatagcatcacttttgaatggaaggctaaagagcaaactaggaagttggccatagatagctcaaaaccctgctttgaggttgtagatatagtaaaatga

SEQ ID NO: 358 - DNA, 2127 bp, Streptococcus pneumoniae
atgaaatattttgttcctaataaggtattcagtattcgtaaattaaaggtgggaacttgctcggtactattggcaatttcaattttggaaagccaaggtattttatcgaataaagttgttactagttcttcaccgatggctacaaaagagtcttctaatgcaattactaatgatttagataattcaccaactgttaatcagaatcgttctgctgaaatgattgcctctaattcaaccactaatggtttagataattcgttaagtgttaatagtatcagctctaatggtactattcgttccaattcacaattagacaacagaacagttgaatctacagtaacatctactaatgaaaataagagttataaggaagatgttataagtgacagaattatcaaaaaagaatttgaagatactgctttaagtgtaaaagattatggtgcggtaggtgatgggattcatgatgatcgacaagcaattcaagatgcaatagatgctgcagctcaagggctaggtggaggaaatgtatattttcctgaaggaacttatttagtaaaagaaattgtttttttaaaaagtcatacacacttagaattgaatgagaaagctacaattctaaatggtataaatattaagaatcacccttccattgtttttatgacaggtttatttacggatgatggtgcgcaagtagaatggggcccaacagaagatattagttattctggtggtacgattgatatgaacggtgctttgaatgaagaaggaactaaagcaaaaaatctaccacttataaattcttcaggtgcatttgctattgggaattcaaataacgtaactataaaaaatgtaacattcaaggatagttatcaagggcatgctattcaaattgcaggttcgaaaaatgtattagttgataattctcgttttcttgggcaagccttacccaaaacgatgaaggatgggcaaatcataagtaaggagagcattcagattgaaccattaactagaaaaggttttccttatgccttgaatgatgatgggaaaaaatctgaaaatgtgactattcaaaattcctattttggcaaaagtgataaatctggggaattagtaacagcaattggcacacactatcaaacattgtcgacacagaacccctctaatattaaaattttaaataatcattttgataacatgatgtatgcaggtgtacgttttacaggattcactgatgtattaatcaaaggaaatcgctttgataagaaagttaaaggagagagtgtacattatcgagaaagcggagcagctttagtaaatgcttatagctataaaaacactaaagacctattagatttaaataaacaggtggttatcgccgaaaatatatttaatattgccgatcctaaaacaaaagcgatacgagttgcaaaagatagtgcagaatatttaggaaaagtatcagatattactgtaacaaaaaatgtaattaataataattctaaggaaacagaacaaccaaatattgaattattacgagttagtgataatttagtagtctcagagaatagtatattcgggggtaaagaaggaattgttattgaggattcaaagggtaaaataaccgttttaaataaccaattttataatttatccggtaagtatatatcattcatcaaatctaatgcaaatgggaaagaacctgttatacgtgatagcgatggtaatttcaatattgtaacggagaatgggctttacaaaattgtaacaaataatttaagtgataaaaacgaaaaagaaaaaaacaaagaggaaaaacaatataattcaaataatgtaattgatagtaaccagaagaacggagagtttaactcaagtaaagataatagacaaatgaatgacaagatcgacaataaacaagataataagacagaagaagtaaactataaaatagttggagatggcagagaaactgaaaatcatattaataaatctaaagaaatagtagatgtaaaacaaaaattaccaaagagaggttcgtacaagattatggaactatttttaacagtgacaggaattggtttacttttgacactaaaagggttgaagtattatggtaaagataaataa

SEQ ID NO: 359 - DNA, 246 bp, Streptococcus pneumoniae
ggagatattgtaggttcacaaaatcagtatttttggattattggtggagctacagatttatataattctaaagaggagataggttattcagtctcagaagttgtacatattttatcagaaagtttgtcggttaattgtaaagaatcaaaaactcttaaacaaatatttgaaactgctttactcgaggttaaagatgaaatcggtttaaactcatataaattaacagagtatagtaaaatgaaataa

SEQ ID NO: 360 - DNA, 207 bp, Streptococcus pneumoniae
ttgttagaaatcgatttgactgtcctgattgatttgtcctattattatttcattttactatactctgttaatttatatgagtttaaaccgatttcatctttaacctcgagtaaagcagtttcaaatatttgtttaagagtttttgattctttacaattaaccgacaaactttctgataaaatatgtacaacttctgagactgaataa

SEQ ID NO: 361 - DNA, 285 bp, Streptococcus pneumoniae
gacaaatcaatcaggacagtcaaatcgatttctaacaatgttttagaagtagaggtgtactattctagtttcaatatactatattatcgcttaccaatatttgctaaactttcagaaaaaaagttggagtatatgatgctaggtgactgcgtcatgttagtaaacgaaatggaaataactgatcatagagtagataacttatttgaaaaagggaaaaatgagataaaagattcatgtagtagatttagcaataggacatataaaagctttagaaaaagtatctga

SEQ ID NO: 362 - DNA, 288 bp, Streptococcus pneumoniae
aagattcatgtagtagatttagcaataggacatataaaagctttagaaaaagtatctgaaaaaacagatgtttatatctataacctaggctcgggagaaggcactagtgtattacaacttgtaaatacatttgaaagtgttaataagatccctattccttataaaatagttccaagacgttcaggagacgttgcaacttgttatgcaaatgcagacaaagcatataaggaattaaattggaggacaacaaaatcgattgaagacatgtgtagagatacatggaattag

SEQ ID NO: 363 - DNA, 198 bp, Streptococcus pneumoniae
gtttttcatataaagaccttcttttttatatttgacatcggtgtcattatgtttacattatacaatgaaaccgtttcctttgtcaagcgctgtcaaacattttttttaatttatctttcattaaatatgcatttcattaaaaggttaagtaatttttccaaaatacagcactcatatagacagtatcatcaattatag

SEQ ID NO: 364 - DNA, 660 bp, Streptococcus pneumoniae
atgaaaaacttaacaaaaattaagttcaaagagaatggggaatttaatcatttccctgggaatacagttgtagcaaatctttatactaaacaagatttgatggaagttgttgatattattcaatcacgttatagagaattaccatttatcgataagtttactttaactccaaggaattctattcacatgactgtaattgaattgttgtgccatgaaaatcgtgaaacggagttttggagcagtaatcttcctctagatacacctttacaggaaatacatgattactttgctaaacaacttgaaatttttccattgttggatgaagaaattcatatgcgtataactgaaatgggaaaacaaaacatactagttgaacctgcagatgaagcttctgcaaagagattagaagaaattcgtacttatgtctcagaaaaagcaggtgtttgtttccctaatcatgatagatatcaattccatatttcaattgggtatcttcggattcctctaaccgaagaggaggaagaagagtttactaaagtcagagcagaattaactgaaattttattagagaagattccaactattactgtaaaccgtattgactatactgtatttgaagatatgagacaatttgttccatatcacgaaaaatttaaataa

SEQ ID NO: 365 - DNA, 1068 bp, Streptococcus pneumoniae
atgaaaaaaatgaaagtttggtctactgtacttgcaacgggagttgctcttactacacttgctgcttgctctggaggttcaaattctacgactgcttcttcatctgaagaaaaagctgataaaagtcaagaattagttatctattcgaactcagtctcaaatggtcgtggtgattggttaactgctaaagcaaaagaagctggttttaatataaaaatggttgatatcgctggcgctcaattagcagaccgtgttattgctgagaagaataatgcagttgcagatatggtatttggaattggtgctgttgactcaaataaaattagagatcaaaaattactagtacagtacaagcctaaatggttagataaaattgatcaatctttatcagataaagataattattataatcctgtgattgttcaaccattagttttaattggggcgcctgatgtaaaagaaatgcctaaagattggactgaattaggtagtaagtataaaggtaaatattcaatttatggtcttcaaggtggtacaggacgggcaattctagcaagtatcttagttcgttaccttgatgaaaaaggagatttaggcgtatcagaaaaaggatgggaagttgcaaaagaatactttgcaaatgcctatactcttcaaaaaggtgaaagctcagttgttaaagcgttagataaagaaagcccaattcaatacggtatgatctggggttctggagcgttaattggacaaaaagaacaaaatgttgaattcaaagttatgactcctgagattggtgtaccatttgtaactgaacaaactatggttttaagcactagtaaaaaacaagcgttagctaaagaatttattgattggtttggtcaatcagaaattcaagtagaatatagtaaaaaatttggatctattcctgcaaataaagatgccctaaaagagttacctgaagatacgaaaaaatttgttgatcaagtgaaaccacaaaatattgactgggaagctgttggaaagcatttggatgaatgggtagaaaaagctgaattagaatacgtaaaataa

SEQ ID NO: 366 - DNA, 1011 bp, Streptococcus pneumoniae
atgattaaatttgataatattcaaattaaatatggtgattttgttgcaattgataatctgaatttagatatacatgaaggggaattctttacatttcttgggccttcaggatgtggtaaatcaactactttgagagcattggtaggttttttagatccatcatcaggaagtattgaagttaatggaacagatgtcactcatttggaacctgaaaagcgtgggattggtattgtatttcaatcttatgcgctatttccaactatgactgtttttgataatattgcatttggtttaaaagttaagaaggtagctccagatgttattaaagctaaagtatcagcagtggcagcaaaaattaagatctctgatcaacagttacagcgtaatgtatcagaattatctgggggtcaacaacaaagggtagcattggctcgtgctctggttcttgaacctaaaattctttgtctagatgaaccattgtcaaaccttgacgcaaaattacgtgtagatttgagaaaagagttgaaaagacttcaaaaagagttaggtattactactttatatgttactcatgatcaagaggaagccttgactttatctgatagaattgcagtctttaacaatggatacatcgaacaggtcggtacaccagtagagatttatcataattctcaaactgaatttgtatgtgattttattggagatattaatgttttgaccgatgaaacagtccacgaagtattattgaaaaatacaagcgttttcttagaggataaaaaaggatacattcgattagagaaagttcgattcaatcgtgaaactgaacaagattttattctaaaagggacaattattgatgttgagttttctggagttacaattcactatacaataaaagtttctgaaagtcagattcttaatgtaacaagtattgatagtcaggctgctattagatctgtcggagaaagtgtggaattatttatcacaccatcagacgttctgcaattttaa

SEQ ID NO: 367 - DNA, 1692 bp, Streptococcus pneumoniae
atgcgtcataaattaaatttaaaagattggcttattcgtttagggttaatctggttcttagtaacatttattatttatccaaactttgatctagtagtgaatgtatttgtaaaaggaggagaattttcccttgatgctgtacatcgtgttctaaaatctcagagggcacttcagagtattatgaacagttttaagttagcattttcactcattattacagttaatgtcgtaggtattctttgtgttctatttacagagtactttgatattaaaggtgctaaaattttaaaattaggttatatgacctctttaatttatggaggagtggttttagcgactggatataaatttgtctatggtccatatggattgattacaaaatttttacaaaatgttatcccttctttagaccctaactggtttattgggtatggtgcagtcttattcattatgacattttcaggaactgctaatcatacattgtttttaacaaatacaattcgaagcgttgactatcacactattgaggctgctcgaaatatgggagcaaaaccatttactgttttccgaaaagtagtgttaccaaccttaattccaactctatttgcacttactattatggtttttcttagtggtttatctgcagtagcagcacccatgattgttggtggtaaagaatttcaaactataaatccaatgattattacatttgcagggatggggaattctcgtgatttagctgccttacttgcaattattttaggtattgcaactacaattttgcttactatcatgaataagatagaaaaaggaggaaattatatttctatctctaagactaaagcgcctcttaaaaaacaaaaaattgcgtctaagccttggaatatcattgctcacattgtagcatatggattgttcacagttttcatgcttccactaatttttatagtattatactcatttacagatccagttgcaattcaaacaggtaacttaacattatcaaactttactttagaaaattatcgcttattctttagtaatagtgcggcattctctccattcttggtcagctttatttattctattattgctgcgacaacagcaacaattctcgcagttgtatttgctcgtgttgtcagaaaacataaatctcgttttgatttcttatttgaatatggtgctctacttccttggttactaccaagtacacttttagcagtaagtttattatttacttttaatcagccacaatttcttgtcttgaatcagattttggtaggtagtttggtaattctacttattgcatatatagttgtaaaaatcccattttcttatagaatggtacgtgctattttatttagtgttgatgatgagatggaagatgcagcaagaagtatgggtgcttcacctttttatactatgatgaaggttatcattccatttattttaccggttgttctctctgttattgctttaaactttaactctttattaactgacttcgacttatctgtattcctttaccatcccctagctcaaccattaggtattacgattcgatctgcaggtgatgaaacagcaacatctaatgcacaagctctggtatttgtttatacaattgttctgatgattatttctggaacggtattatacttcacacaaagaccggggcgtaaagtaaggaaataa

SEQ ID NO: 368 - DNA, 711 bp, Streptococcus pneumoniae
atgacagccactagtcttgggttatcaaatattgaaatagttgtcaggattgttttatcagtagtcattggtagtataattggtttagagagagggagcaaatcccagcctgcaggcatccgaacttatagtattgtttgtctagctgcatgtttgattatgatgacgaatgaatacgtatcttataaatttgggacaggagatcctacacgattaggagctcaagttatatcaggtgtgggttttctaggcgctggaacgattcttattacagataaaaagaaaattacaggtctgacaactgcagcaggcatttgggcttcggcaggaattggattagctattggagtaggtttttatgagggagctcttttagtagccatttctgtttggggtgtgatatccatgttccaaccactaaaaaaatatctgcaaaatcgttctaaaatgattgaattgtatatagtagttaaatctacagaagcctataatcgtgtattggtttattgtgcagaaaatggtatcagaatgaccgattcaagaacagcgtttggagatgttaattctgacagaattgaatactttgatgttccggacaaaaaaatagcgtcatttattactctggaattatcaggtagatttgaacatcttcgactgatggaagaaattgctaatattgtaggtgttatttatgtcgaagaaattagctga

SEQ ID NO: 369 - DNA, 309 bp, Streptococcus pneumoniae
ttgatacaagtatacaaatttatttctttttatgatatttgtgaaatggtgtttgcctttcatttacctcctgatgagttgataacaaatgttatctttaaagaaaaaattaactctatgttaaaatgttacattgacaggctattatatgtttttataaatcctacacattttactgaaaaagttaatctacaattttatggtagttttttctcatatgaatttatttgtcgtgaagttggaaacattcttaaaaataaaggtgtgaaatgcaatttaaacttttttgaaggggaagaatatttgtaa

SEQ ID NO: 370 - DNA, 1002 bp, Streptococcus pneumoniae
atgaaaaatataaatgggaaaaaggtaactatttatgatattgcacgtttatcaggtttttctccaaaaacagtttcacgagttattaatggtggagtaaatgttaaagaagaaacttatcaagcgattcaaaaagttatagaggaattgtcgtatattccaaatgcgtatgcaaaaaatttaactaaaaaagaagctataaatatattgatttctgtaaaaaaaatcgactcttttcctttaatttggtttcatacgctgttagataaagtgttacggacgtgtaaagaatttggtgttaatgctatagttgagtactttggagaggaggatacaattagtaattcaattatatcaagcacaggtagcctagtagatggtgttattgttttttatgaaagtgtagatgatatcagaattcagtatttaaagaagaaccatatgccttttcttgttttcggtgaatctcaaacgtctggagtagtctatgtatctaataataattttcaagctacttatgatatgatgaaagctgtaactgaagaaaaatttaaaaatatgtggttgcttatgggaggagaatcccatgttaataaggatcgtgaaagaggtgtgcgttcttttctgaatgataaaaattactttatggatttaaaagtcatttatggcttatctacaattgattcagtttattcttatgcaatgcagcacttgactagccaaaattatccggacattatttttgtttcaggagatgaaaaggttcagggcttgattcgtgcgtgctatgagaaaggaattcttattccagatgatatttctatcattggatttgataatattcctatttctcagtattatactccagctttgtctacaattgctcccaattatgttaaattggctaaagaaatgatagagggtgttttagcgattattaaaggggaaagtgtcacatctgttgaagtttctcctaaatttgttaggagacagagtttctag

SEQ ID NO: 371 - DNA, 198 bp, Streptococcus pneumoniae
ggtggcaccgcgttaccaacgccctcacacggaagtatattctgtgtgtgggcttttttctatccgtcgtttgctttatcttttattagggccttaagtcgctttgatgaacttgagttctatctacagctcttgcctcctactaaaagtaaacaaaaaggctggactaatacgaaaaaagctagtaatactcaatga

SEQ ID NO: 372 - DNA, 207 bp, Streptococcus pneumoniae
atgaaaatcaaagagcaaactaggaaactagccgcaggctgctcaaaacactgttttgaggttgcagatagaactgacgaagtcagctcaaaacactgttttgaggttgcagatagaactgacgaagtcagtaaccatacctacgataaggcgacgttgacgcggtttgaagagattttcgaagagtataaaggtgtaccgagatga

SEQ ID NO: 373 - DNA, 1464 bp, Streptococcus pneumoniae
ttgaggtggcaccgcgaatttcgtcctcacgcaagttattttgcgtggggatttttcatacagtcgctacgaactagaattagaactgaaagggaaattacaatggaacgaatcattcatggagatgtcttatcaccaatcttggcttatatgcgcttaaaggggcaacacaaggttatcttagagagtattccgagagacaaggaaacagctcgtttttctatcctagcctataatcctgtttttgagattaagtttgaaaatggagttctttatcaaaatggtcaagtgattgatcgggatcccttggatttcctttatgaagtgattcataagagtcagcaccattcagagctaccttttggtggtggagccattggttttgtgggttacgatatgatttcgctttatgaagaaattggtcaaatccctgaggatacaattgggacgccagacatgcatttctttgtctatgagagctatatagtctttgaccacaagaaggagaagatacatgtcatagaggatgcactttatagtgagcgcagtcaagaggccttggaaaaatccttgaaccaagtgcttgaggaattacgcattcctgctccaaatgaatttgaagacttggatttatcaccacttgacttcaaaccgcatatcgctccacataagtttgagggaatggtagaaacagctcgtgacttgattcgtaacggcgatatgttccaatgtgtactcagccagcgtttctcagcagaagttactggaaatccatttgacttctacagaaatctccgcgtaactaatccttctaattacctttatttctatgattttggggattatcaaatcatcggagctagtccagaaagtttggtttctgtcaaaaatggcatcgtgacaaccaatccgattgcagggacgcgaccaagaggggctacggatgaagaagacaaggccttggcgactgacctcctctctgatgagaaggaaacagcagaacatcgaatgttggtagacttggggcgtaacgatattggccgcatctctgaaacggccagtgtccaagttactaagtatatggaggtggagctcttccgctacgtcatgcatttgaccagtgtggtcaagggacgtttgcttgcagaactcactgccatggatgccttgaaagcaacgcttcctgctggaaccgtttctggagcgccaaagattcgagcgatgagacgtatctatgaactggaaacggaaaaacggggagtatacgctggggcaatcggctacttgtctgcgacgggtgatatggatttggccatcgccatccgaaccatgattctcaaaaatcaaagagcctatgtgcaggctggggcagggattgtctacgactctatcgcccaaaacgaataccaagaaaccattaacaaagcaaaatctatgactagaattggagaactaagaccatga

SEQ ID NO: 374 - DNA, 201 bp, Streptococcus pneumoniae
atgcggccaatatcgttacgccccaagtctaccaacattcgatgttctgctgtttccttctcatcagagaggaggtcagtcgccaaggccttgtcttcttcatccgtagcccctcttggtcgcgtccctgcaatcggattggttgtcacgatgccatttttgacagaaaccaaactttctggactagctccgatgatttga

SEQ ID NO: 375 - DNA, 567 bp, Streptococcus pneumoniae
atgattttattgattgacaactatgattcttttacctataacttggcccaatacattgggaattttgcagaagttcaggttctgagaaatgatgattccaagctgtatgaagaagctgaaaaagcagatggtctggtcttttctcctggtcctggttggccagttgatgctggaaagatggaagacatgattcgtgattttgcaggcaagaagccgattctagggatttgtttgggtcaccaagccattgcagaagtctttggtggtaagctaggtttggctccaaaagtcatgcatgggaaacagagcaatattaactttgaagcgccatctgttttgtatcaaggtattgaggatggccgtgcggtcatgcgttatcacagtattttgattgaggaaatgccagaagactttgaagtgacagctcgttcgactgatgaccaagccatcatggggattcaacataaaaacctaccgatttatggcttccagtaccatccagagagcattggaacgccagacggcttgtcttctattcggaattttatcgagaaggttgtaaagtga

SEQ ID NO: 376 - DNA, 1005 bp, Streptococcus pneumoniae
atgaaagagattattgaaaaactagcaaaatttgaaaatttatcaggtgtggaaatgacggatgtcattgagcgtatcgtaactgggcgtgtaactgaagcgcagattgcttctctcctcttagctcttaagatgaagggggaaacacctgaagaacgcacagccattgcccaagtcatgagaggacatgcccagcatattccaactgagattcatgatgccatggacaactgtggtacaggtggggacaagtctttcagttttaatatttccacaactgcagcctttgtcttggctggtggcggtattcacatggccaagcatggtaatcgctcgatttcttctaaatctggttccgcagatgtcctcgaagccttgggaatcaatcttgacctcaaaccagctgaactaggtaaggtctttgataaaactggaatcgtctttctcttcgctaaaaatatgcacccagctatgaaatacatcatgccagctcgtttggaattgggaattccaacgattatgaacttgactggtccactgattcatccaatggctttagaaacacagcttcttggaattagtcgtccagaactcctagaaagtacagctcaggttttgaaaaatatgggtcgcaaacgtgccatcgtggttgctggaccagaagggttggatgaagctggcttgaacggaacaaccaagattgcacttcttgaaaatggcgaaatcagcttgtcaagctttactccagaggatttgggaatggaaggctatgctatggaagatattcgtggtgggaatgctcaggaaaatgcagaaattttgcttagcgttctgaaaaacgaagcaagtccattcttggaaacgacagtcttgaatgctggtcttggtttctatgctaatggtaagattgatagcatcaaggaaggagttgccttggcccgtcaagtgattgctagaggcaaggcccttgaaaaactcagactgttacaggagtaccaaaaatga

SEQ ID NO: 377 - DNA, 768 bp, Streptococcus pneumoniae
atgagtcaggaatttttagcacgaatcttagagcagaaggcgcgtgaggtggagcagatgaagctggagcaaatccagcctctgcgccagacctatcgcttggcagaatttttgaagaatcatcaggactgcttgcaggtaatcgctgaggtcaagaaagctagccctagtttgggagatatcaatctcgatgtggatattgtgcaacaggcccagacttatgaagaaaacggagcagtgatgatttcggtgttgacagatgaggttttctttaaagggcatttggattatctacgggaaatttccagtcaggtagagattccgacgctcaacaaagactttatcatagatgaaaagcaaatcatccgcgctcgcaatgcaggtgcgacagttatcttgcttattgtggcagccttgtccgaagaacgcctcaaggaactgtatgactacgcgacagagcttggtctggaagtcttagtggagactcacaatctagctgaactagaggtagcccacagacttggtgctgagattatcggggtcaacaaccgcaacttgactacctttgaggtcgacttgcagaccagtgtagatttagccccttactttgaggaaggtcgctattacatttctgaatctgccattttcacagggcaggatgcggaacgactagccccatactttaacggaattttggtagggacagctcttatgcaggcagaaaatgtggcccagagaatcaaggagttgcagattgacaaaggttaa

SEQ ID NO: 378 - DNA, 630 bp, Streptococcus pneumoniae
atgtggcccagagaatcaaggagttgcagattgacaaaggttaaaatttgtggactatcgaccaaagaagcggtggaaacagccgtttcagcaggagccgactatatcggttttgtctttgcacctagtaaaagacaggtgactttagaagaggcagctgagttggcaaagcttattcctgcagatgtgaaaaaggttggagtatttgtttcaccaagtcgggtagaactgctggaagcgattgacaaagttgacttggacttggttcaagttcacggtcaggtggcagatgatttatttgagaatttgccttgtgccagtattcaggctgtgcaggtagatggaaatgggcatgtccccaattctcaggcagattatctactctttgatgcccctgtggcaggaagtggccagtcctttgattggggtcaactggatacgactggactagcacagcccttctttatcgcaggtggccttaatgaagataatgtagtaaaagcaattcaacattttactccctatgcagtagatgtatcgagcggagtggagacagatggacaaaaagatcatgaaaagattagaagatttatagagagggtaaagcatggcatatcaggaaccaaataa

SEQ ID NO: 379 - DNA, 1224 bp, Streptococcus pneumoniae
atggcatatcaggaaccaaataaagatggattttacggaaaattcggcggacgttttgtcccagaaacattgatgacagcagttttggagttggagaaggcctaccgtgaaagtcaggcagacccaagtttccaagaggaattaaaccaacttttgcgccagtacgtgggacgtgaaactcccctttactacgcaaaaaacttgacccagcatatcggcggagccaagatttatctcaaacgggaagaccttaaccatacaggagcccacaagattaacaatgccttaggacaagtttggcttgccaaacgcatgggtaaaaagaaaattatcgcagaaacgggtgctggtcagcacggtgtggcaactgcaactgctgcggccctctttaacatggaatgtaccatctacatgggtgaggaagatgtcaaacgccaagccctcaatgtcttccgtatggagcttttgggagctaaggtcgaggccgtgacagatggttcgcgcgtgctcaaggatgcggtcaatgcagcccttcgttcatgggtggctaatatcgatgatacccactatatccttggttctgccttggggcctcatccatttccagaaattgttcgtgacttccaaagtgtcattggtcgagaggctaaacaacagtaccgtgacttgacaggacaaaatctgccagatgccctagtagcctgtgttggtggtgggtcgaatgccatcggtctcttccatccctttgtagaagatgagtcagtagccatgtatggagctgaagcggctggacttggtgtggatacggagcaccacgcagctaccttgaccaagggtcgtccaggtgtccttcacggttccctcatggatgtgctccaagatgcccatggtcaaattcttgaagccttctctatctcagcaggtttggactatcctggtatcggtccagagcattctcactaccacgatatcaaacgtgccagctatgtccctgtgacagacgaagaagctttggaaggatttcaactcttgtctcgtgtggaagggattatcccagccttggaatctagccatgctatcgcctttgcggtgaaattggccaaagaacttggaccagaaaagtctatgattgtctgcctatcaggtcgtggggacaaggatgtggttcaagtcaaagaccgcttggaagcagatgcagcaaagaagggagaagctcatgcctaa

SEQ ID NO: 380 - DNA, 834 bp, Streptococcus pneumoniae
atgtggttcaagtcaaagaccgcttggaagcagatgcagcaaagaagggagaagctcatgcctaagacactaacagaaaaattgaatgctataaaagcaactggaaaaggaatttttgttccctatatcatggctggtgaccacgagaaaggtttggacggtcttgctgaaacaattcactttttagaagatttgggtgtctctgcaattgaagtgggtattcccttttcagaccctgttgcagatggacctgttatcgaagaagctggcttgcgcagtttagcccacgggacctctacccaggctttagttgaaaccttgaaaaccattgaaacagagattccactggtcatcatgacctacttcaatcccctctttcagtacggtgtggagaactttgtcaaagatctggctgatacagctgtgaagggcttgattatcccagacttgcctcatgaacatgccaactttgtagaaccatttttggcagatacagatatcgccttgattcctttagtaagcttgaccacaggaattgagcgccagaaagagttgattgaaggggcggagggattcatctatgccgttgccatcaatggagtgacagggaaatcaggcaattaccgtgcagatttggacaagcacttggcgcaacttcatcaagtggccgacatcccagtcttgacaggttttggtgtatctagtcaagccgatctggaacgcttcaatgcggtgtcagatggtgttatcgtcggttcaaaaatagtaaaagctctccaccaaggagagccgattcaggattttatcagacaagcagtagcttaccaaaaataa

SEQ ID NO: 381 - DNA, 204 bp, Streptococcus pneumoniae
aatcaattaaaaactgaacaaatttattgggaaattcaaatcactttcttaaaatattttaggaaccgtagtgtaatattccagattcaattcactataaaactagcctttctcctgcaaaagaaaaaggaaagacttcctttcgtgcctttcctcttacttgctacttgtttgattatttttggtaagctactgcttgtctga

SEQ ID NO: 382 - DNA, 732 bp, Streptococcus pneumoniae
atgttgaatcaggatctctttgattcgcttgaggcacaaaaaattgtagatactttgatgaaagggcaaaaagattatgtagatgaacgtctagaaaaaagagagacaatgatagtgtcgaatggttatgcatggacgcgacctaatcatattgatactgcatttgcatcagcagatttgtttgagtataaattacaattagcaggacagacttggggatatttagaatttgaaacaaatacagaaaaatatgggaaagtattgttaattataaagggtaagaagcgacttacgaaccaatttcctttggtacaaaaaaataagagtggctacttatttgaatatgctcagatgaatacactttatcttaatcaacattcttcctacaaaaatgatgaagatagtcattcctttccaattcagatggagttagtttctgatgaaatgattcaagaaattgaacaagctactaaaaattcgaatatcgaaaaatttatgattttaacttatgaggcggactcagaaaacaatattatatctgtagatgttgttatgcctgatgcacgaactggtcagttacacttgattcaagatttgtctgagtatattcaatcaagttcgtaccatttcgaagaagctaaatatcaagatattcctaatttttcagaattatcggaaacagaagattttgaaattattccaagaatagaaaaacaagaaggtcaaaagtag

SEQ ID NO: 383 - DNA, 1152 bp, Streptococcus pneumoniae
atgtttaatggtcgggtattgaaagaattacggctgttaaatggtttaagtagagcagaattagctcagagaattaatttaacggaacaagccatttggcagtttgagtccaacgaaacgaaacctaaattatcaaccaaaatgcatttggccaaccaatttcatgttgatttaacttattttgaacaggaagaagagagcattcgatttgattcttctgtaattgcctttagaaatgcagacctagcaacacggaaaacaatagatattcaaactatgtatttacataaggtagatagtttgattgattattttgaaagttttgtaattatacctaatattataattcatgacctaagtaatgtagtgagtgaatcttatcataagggagaatccattgaggaattggctctttatgccagggaaaaattaggtatttcaaaagataatcatgatttgctttataaattagaacgttcaggcatctatatcgtggaacgattaattaatggccaagctgatgcttatagcgcatggtcaaaattgggaagaccttatattgtgttgggaacgaataaatcatctgtacgtcgaaattttgacttagctcatgagctaggacatattcttttacataaatataaagatatgaatgaagatggcgatcgtttggagcaagaagcaaattattttgcatcatgttttttattgccaaaagaagagtttttagtcaaatttgaagagagggttggcaagcgtgtcagcaatcctgatagttatattttattgaagtcggatttgaatgtttcgatacaggctttagagtatcgagcttttaagttaggattattgactccaaagcaacattcttacttttatcgtcaaattgcgcaaaaaggttacaaaatgattgaacctttggatgatcaaatttttgttaaaaaaccaagcaaagtaaagagtattctggacgtcgttttgagtaatcatctagtcagtctagcgactataatgtctaaacaaagtattcgtttacagtttataagcgaaatattttcagtcgaaatgaaattttttgatcagtatcaagaagatagaagaacagatcgatttgataacatcatccctttgtacaaaagaaataatttataa

SEQ ID NO: 384 - DNA, 660 bp, Streptococcus pneumoniae
atgattgatttttatttttttctcgtcgggagcattctcgcttcctttcttggtttggtcattgaccgttttccagagcaatccattatcagttcagccagtcactgcgattcctgtcagactcgcttgcgtcccttagatttgattccgattctctcacaggtcttcaatcgctttcgctgtcgctactgcaaagttcgctatcctgtctggtatgccctctttgaattagtcttaggactcctctttctgctttactcttgggaattgctttccttggggcaagtcgtcctaatcaccgctggtttgaccttgggtatctacgactttcaccatcaggaatatcccttactggtctggatgactttccacctaatcctaatagcttcctctggctggaatctggtcatggtctccttccttgctcttggaattttggctcattttatcgatatccgcatgggcgcaggagatttcctctttttagcttcttgtgctctagtctttagcgtaacggagttactgatcttgattcagttcgcttctgcgacgggtattctggcctttctcctgcaaaagaaaaaggaaagacttcctttcgtgcctttcctcttacttgctacttgtttgattatttttggtaagctactgcttgtttga

SEQ ID NO: 385 - DNA, 447 bp, Streptococcus pneumoniae
atgacaattcgttttgaagaaaaggtgagtatagaaaacgctcaatttgtatgccagtggtccaactccctaggcaaatcctttcaagaacaatggatgggaccaaggattccttttctactgacccttcaagccttggaaggagtcttttcaatctttgatgaacaagagtttgtgggacttatccagaaaatcaggctagaagacagcaatcttcatatcgggagattttttatcaacccccagaaacaggagcaagacttaggtagccaggctttaaggaaatttgttagtttggcctttgaaaatgaagatatagatagtatttctctaaatgttttcgaggcaaatcaaagagctcagaatctttaccaaaaagaaggatttgaaatcgttcaaatggttgaagcacctgtacgaaaatatagtagattgaaactagaatag

SEQ ID NO: 386 - DNA, 312 bp, Streptococcus pneumoniae
aaagcaaacagccttgaaatcaatgttgactgcgattatgaacctgaatcagcccctcaaaagggactgtatatgaatgaacgttaccagtgtttaaaaactaaagaatatcaggcacttttatcttccaagggtagacaaattttcgctaaacgtaagattgatatgaaatctgtctttgggcagataaaggtttgtttgggttataagagatgtcatctgagaggtaagcgtcaagtgagaattgacatgggattcgtactcatggccaacaacctgctgaaatataataagagaaagaggcaaaattaa

SEQ ID NO: 387 - DNA, 204 bp, Streptococcus pneumoniae
atgtcagtagaagaaaaattaaatcaagctaaaggttctattaaagaaggtgttgggaaagccatcggtgatgaaaaaatggaaaaagaaggagcagctgaaaaagttgtttctaaagtaaaagaagttgccgaagacgctaaagacgctgtagaaggtgctgtagaaggtgttaaaaacatgttgagtggcgacgataaataa

SEQ ID NO: 388 - DNA, 609 bp, Streptococcus pneumoniae
atgtcaaacgaaaaaaacacaaacactaacgtagaaaagaaagatgctactgttgtagctcacgaaatcaaaggggaacttacttacgaagataaagttatccaaaaaatcattggtctttcactagaaaacgtttcaggtcttttgggaatcgatggtggtttcttctcaaatcttaaagaaaaaatcgttaacagcgatgacgtaacaagtggtgttaacgtagaagttggtaaaacacaagttgcagttgacttaaacgttattgttgagtaccaaaaaaatgttccagctttatattcagaaatcagagaaatcgtatcttcagaagttgctaaaatgactgacttggaaattgttgaaatcaacgtaaacgttgtcgacatcaaaactaaagaacagcatgaagcagactcagtaagccttcaagatcgcgtatctgacgttgctgaatcaacaggagaattcacttcagaacaattcgaaaaagctaaatctggtcttggatctggtttctcaactgttcaagaaaaagttagcgaaggtgtagaagctgttaaaggtgcagcaaatggtgtagtatctcacgaaaacactcgtgtaaactaa

SEQ ID NO: 389 - DNA, 573 bp, Streptococcus pneumoniae
ttgtatatgtcaaaagcaaagaaaatatgtttcattattttctgtattttaatcttgacaattttccttcctgttttgatagattatcatcaagttagtgatctaggtattcatctacttagctggagacagaactccgtagttgaattctatcttgctagatatgtcttttgggggacagtggttctatcaactttagttttattatccattttagttgtgatgttttatcctaaacgttacttggaaatccaacttgaaactaaaaacgatacattaaaattaaagaattcggcaatcgaaggttttgttagaagtttggtgagtgatcatagattgatcaagaacccaactgttcatgtaaatttacgaaaaaataaatgtttcgttcatgtagaaggtaaaattcttccttcagacaacatcgctgacagatgccaaataattcaaaatgaaataactaatggattgaagcagttttttggtattgagcgtcaagtaaaacttgaagttgcagtaaaaaattaccaaccaaaacctcaaaacaaaaagactgttagtcgtgtgaagtaa

SEQ ID NO: 390 - DNA, 1539 bp, Streptococcus pneumoniae
ttgtggtataattgcaagaggtttaatccgataatttataaagagagaaagatattcatgagagatttattatctaaaaaaagtcataggcaattagaattattagaattattatttgaacataaacgttggtttcatcgttctgaactagcagagttattaaattgtacagaacgtgcagtcaaagatgatctatcccatgttaaatctgcttttcctgacttgatttttcattcttctactaatggtatacgcattattaataccgatgatagtgatattgaaatggtttaccatcatttctttaaacattcaactcatttttcgattttagaattcatcttctttaatgaaggttgtcaagctgagagtatttgtaaagaattttatatcagttcatcttcgctctatcgtattattagccaaatcaataaagtgattaaaaggcaatttcaatttgaagtcagtctgacccctgttcaaatcattggaaatgagagagacattcgttacttttttgcacaatatttttcagaaaaatattatttcctagaatggccatttgaaaatttttcatcagagccactatctcaattgttagaattggtttataaggaaacaagctttccaatgaatttgtcaacgcatagaatgctaaagttgctcctagttacgaacctatatagaataaagtttggtcattttatggaagtagataaagattcttttaacgaccaaagtttggattttttaatgcaggcagaaggaatagaaggtgttgctcagagttttgaatcagaatacaatatctctttagatgaagaagttgtttgccaattatttgtgtcttactttcaaaaaatgtttttcatagatgaaagtctctttatgaaatgcgtaaaaaaggatagttatgttgaaaaatcttaccatctattgagtgattttattgatcagatttcagtcaagtatcagattgaaatggagaataaggataatctgatttggcatctgcataataccgcacatctgtatcgtcaagagttgtttactgagtttattttatttgatcaaaaagggaatacaatcaggaactttcaaaatatttttccaaaatttgtttcagatataaaaaaagagatttctcactatttagagactcttgaggtttgttctagttcaatgatggtaaatcatctatcttataccttcatcactcataccaaacatttggtgattaatttgctacaaaatcagcctaaactaaaggttttggttatgagtaattttgatcagtatcatgcaaaattcgttgcagagacactttcttattactgtagcaataattttgaactggaagtttggaccgaattagaattatcaaaggaatctttagaagattcaccttatgatatcattatttccaattttattattcctcctattgaaaataagagactcatctattcaaataatataaacacggtctcactcatatatttgttaaatgccatgatgtttattcgattagatgagtaa

SEQ ID NO: 391 - DNA, 1002 bp, Streptococcus pneumoniae
atggtagaacaaagaaaatcaattaccatgaaagatgttgctttagaagcaggagttagtgttggaactgtttcacgtgtaattaataaagaaaaaggcattaaagaagtaactttgaaaaaagtggaacaagcgattaaaactttgaattacattccagattactacgctagaggaatgaaaaaaaatcgaacagaaacgattgcaatcattgtaccaagtatctggcatcccttcttttcagaatttgctatgcatgtggaaaatgaagtctataagagaaataacaaattactcttatgttctatcaatggtacaaatagagagcaagactatctggagatgttgcgtcataataaagttgatggagtggttgccattacctatagtccaattgaacattacttgacgtcaggaattccctttgttagtattgaccgcacatactcagatattgccattccttgtgtttcatcagataatgatgcaggtggaagagaagcagctaaacaattaattagtaaaggatgtcagcatttagcctttgtgggcggacataatacaaccattaatgaaaccaaacgtcgtagaatttcatttgaaaagtatgtccaagagcataaaatacctcttagtatttttgatttggatgagacagttactgactattatggaaagctagagagtttcttggaagaaaattcttctatagatggaatttttacaatcaacgattttacagctttggatgtgattgaaatactagaaaaaaatggtaaacgtattcctcatgatgtccaaattattggatacgatggaattaaaatggctggagatagagattatctactttcaactattgaacaaccattggaagaaatggcaaaagaagcggttcgtattttgtttgatataattgatggaaagactgttaatttgcagacaatcctaccagtaaaatttgttgaaggaaaaacaacaaaaaatgaaaataagtcttga

SEQ ID NO: 392 - DNA, 945 bp, Streptococcus pneumoniae
atgaaacgtttcaaaaaggaggttgctatgaatagcaaagcgaagcaagtttctctttgggaaagaatcaagaaacaaaaactcttgttattgatgactgtccccggtttagttttaacctttatctttaaatacatccctatgtatggggttttaatcgcatttaaagattacaatcctttaaaaggaattttagggagtgattggattggtttttctgagtttacaaaattcatatcctctcccaactttggtatcttgttagccaacacattaaaattaagtatctatggtttattgcttggctttttaccaccaatcattcttgctattatgctcaatcaactcttgagtgaaaaagtcaaaaaacgaattcagctcattttatacgcaccaaactttatctcagtcgttgttattgtcggtatgattttcctcttcttttcagtgggaggaccaatcaacaattttctttctatgtttggaatgaaggctgacttcttgacaaatccagacttctttagacccttatacatctttagtggtatctggcaaggaatgggctgggcttcaacgctctacacggcaacattggtaaatgtagatccagccttagtagaagcagcccgactggatggagccaatatcttccaacgaatctggcacattgatattccagctcttaagcctattatggttatccaatttgttttagctgcaggtggaattatgaatgtcggatatgaaaaagcattcttgatgcagacatcgttaaatttgccaacttctgaaattatctcgacatatgtctataaagttggtcttgtatcaggagactattcttactcaacagcggttggtttgtttaatgcagtgattaacgtagtattgcttgttgcagttaaccaaatcgttaaacgcatgaataatggtgaaggaatttaa

SEQ ID NO: 393 - DNA, 918 bp, Streptococcus pneumoniae
atggtgaaggaatttaaggagggaagtatgaaaaattcgattatggatacaaaatttgatagacgtatcttactcttaaataaaatcattattgtctttatcgttttgatgactttgcttcctttactttatatcgtcgtagcatcctttatggatcctaaggttctggttagtagagggattagctttaatccagccgattggactgtagaaggttatcagcgtgtattcagtgaccaatctattctaagaggttttatcaattctctactatactcttttggatttgcagctttaacagtcttgctatctgtgtttacagcttatcctctttctaagaaagacttggttggacgtcgttggattaactacttcttgattgtaactatgttctttggtggtggtttagtcccaacttacttgctcgtaaaagaattgggaatgctcaatactccatgggcaatcattgttccaggtgctgtcaatgtttggaatattattcttgctagggcctatttccaaggattgcctgaagaattagttgaagctgctgtcattgatggtgcaaatgatttacagattttcttcaaaatcatgcttcctcttgcaaaaccaattatgtttgttctcttcctctatgcttttgtaggacagtggaactcatactttgatgcaatgatttatatcaaggatccaaacttggaaccattgcaacttgtacttcgtaaaattctcattcagagccaaccaggtcaagacatgattggagcacaagcggctatgaatgaaatgaaacgtttagctgaattgattaaatacgcaactattgtcatttccagcttgccattgattgttatgtatccattcttccaaaaatactttgataaaggaattatggctggttcacttaaaggataa

SEQ ID NO: 394 - DNA, 1617 bp, Streptococcus pneumoniae
atgaaattcaaaacattctcaaaatcagcagttttgttgacagctagtttagcagtacttgcagcctgtggctcaaaaaatacagcttcaagtccagattataagttggaaggtgtaacattcccgcttcaagaaaagaaaacattgaagtttatgacagccagttcaccgttatctcctaaagacccaaatgaaaagttaattttacaacgtttggagaaggaaactggcgttcatattgactggaccaactaccaatccgactttgcagaaaaacgtaacttggatatttctagtggtgatttaccagatgctatccacaacgacggagcttcagatgtggacttgatgaactgggctaaaaaaggtgttattattccagttgaagatttgattgataaatacatgccaaatcttaagaaaattttggatgagaaaccagagtacaaggccttgatgacagcacctgatgggcacatttactcattcccatggattgaagagcttggagatggtaaagagtctattcacagcgtcaacgatatggcttggattaacaaagattggcttaagaaacttggtcttgaaatgccaaaaactactgatgatttgattaaagtcctagaagctttcaaaaacggggatccaaatggaaatggagaggctgatgaaattccatttacatttattagtggtaacggaaacgaagattttaaattcctatttgctgcatttggtataggggataacgatgatcatttagtagtaggaaatgatggcaaagttgacttcacagcagataacgataactataaagaaggtgtcaaatttatccgtcaattgcaagaaaaaggcttgattgataaagaagctttcgaacatgattggaatagttacattgctaaaggtcatgatcagaaatttggtgtttactttacatgggataagaataatgttactggaagtaacgaaagttatgatgttttaccagtacttgctggaccaagtggtcaaaaacacgtagctcgtacaaacggtatgggatttgcacgtgacaagatggttattaccagtgtaaacaaaaacctagaattgacagctaaatggattgatgcacaatacgctccactccaatctgtgcaaaataactggggaacttatggagatgacaaacaacaaaacatctttgaattggatcaagcgtcaaatagtctaaaacacttaccactaaacggaactgcaccagcagaacttcgtcaaaagactgaagtaggaggaccactagctattctagattcatactatggtaaagtgacaaccatgccagatgatgccaaatggcgtttggatcttatcaaagaatattatgttccttacatgagcaatgacaataactatccaagagtctttatgacacaggaagatttggacaagattgcccatatcgaggcagatatgaatgactatatctaccgtaaacgtgctgaatggattgtaaatggcaatattgatactgagtgggatgattacaagaaagaacttgaaaaatacggactttctgattacctcgctattaaacaaaaatactacgaccaataccaagcaaacaaaaactag

SEQ ID NO: 395 - DNA, 423 bp, Streptococcus pneumoniae
atgttcttcaggcttatattgagtattaacgagatgtttattttctgctataaaacgattggctttttctactgtgtatttcttatctcccataatcaacctctagtttttgtttgcttggtattggtcgtagtatttttgtttaatagcgaggtaatcagaaagtccgtatttttcaagttctttcttgtaatcatcccactcagtatcaatattgccatttacaatccattcagcacgtttacggtagatatagtcattcatatctgcctcgatatgggcaatcttgtccaaatcttcctgtgtcataaagactcttggatagttattgtcattgctcatgtaaggaacataatattctttgataagatccaaacgccatttggcatcatctggcatggttgtcactttaccatagtatga

SEQ ID NO: 396 - DNA, 1320 bp, Streptococcus pneumoniae
atgggagataagaaatacacagtagaaaaagccaatcgttttatagcagaaaataaacatctcgttaatactcaatataagcctgaagaacatttttcagctgagattggttggatcaatgatccaaatggatttgtctattttcgtggagaataccatctcttttatcaattctatccatatgatagtgtttggggacctatgcactggggacatgctaaaagtaaggacttggtgacttgggagcacttgccagtggcacttgctcctgaccaagattatgaccgaaatggttgtttctcaggctctgccattgtcaaggatgatcgcctctggctcatgtacactgggcatatcgaagaaaaaaccggtgtccgccaagtgcaaaatatggcattttcagatgacgggattcactttgaaaagatttcccaaaatccagttgtaactggaacagacttgccagatgagttgattgctgctgatttccgtgatccaaaactctttgaaaaagatggacgctattactccgtagtagctgtcaaacacatggataatgtgggctgtatcgttctactagggtccgataacctagtagaatggcagttcgaatccatctttttaaaagggggagaacaccaaggctttatgtgggaatgcccagattacttcgagttagatgggaaagattgccttattatgtcacccatgcgttatcagcgtgagggagactcatatcataacatcaactcatcgcttttgttcacgggtaaggtagattggagagaaaaacgttttatcccagaatcagttcaagaaattgatcatggccaagacttctatgcgcctcaaacattgttggacgatcaaaatcgtcgtatcctgattgcttggatgcagacatgggggcgtacccttccaacccatgaccaagaacacaaatgggcatgtgccatgactttacctagaattctaagattggaagatggcaaactaagacaattccctgttaaaaaaggccaatatcaaatccaaatagataaagattgtcattaccacttaggaaatgatatagattatcttgaatttggttatgacagtaatgcgcagcaagtttacattgatcgtagccatcttattcaaaaaattctaggtgaagaagaacaggacactagtcgacggtatgtagatattgaagctaaagaattggaagttgttctagataaaaattccatcgagatttttgtcaatcaaggtgaagcaagcttgactgcaacttattacttaacggtgccagctgagctatcacgaattgattaa

SEQ ID NO: 397 - DNA, 1272 bp, Streptococcus pneumoniae
atgccagacaatctcgcgcttcgcatgcgccctaaaaccatcgaccaggtcatcggtcaggagcatctggtcggacctggaaaaatcatccgccgcatggtggaagccaaccgcctgtcctccatgattctatatggccctcctggaatcggcaaaaccagtattgcctctgccatcgctggaacgaccaagtatgcctttcgaactttcaatgcaacagttgatagtaaaaagcgactgcaagaaatctcggaagaagctaaattttctggtggtctcgtcctattgctagacgaaattcatcgactagataagaccaagcaagacttcctcttgcctctcttggaaagtggactggtcatcatgattggagcaacgactgaaaatcctttcttctctgtcactcctgccattcgtagccgagttcaaattttcgagttggaacctctgtctaaccaagacgtcaaagaggccctgcagatagctctaagtaaccctgaacgtggttttgattttccaatagaactagatgaggatgcgctggatttcatcgcaacctctacaaacggagaccttcgctctgcctttaactcactggacttggctgttctctctacccctgagaatgacgagggcattcgccacatcaccttagacatcatggaaaatagtcttcagagaagctacatcactatggacaaggatggagacggtcactatgatgttctatctgccctgcaaaagtctattcgtggctcagatgtggatgccagtctccactatactgcccgcttgattgaggctggggatctgcctagtctcgctcgtcgcttgactgttatcgcctatgaagatatcggcttagccaatcctgaggcccagattcataccgtgactgctctggatgctgcccagaagattgggttcccagaagcccgcattctcattgccaatgtcgtgattgatttggccctttctccaaaatccaactcagcctatgtagctatggataaggcacttgctgacctcaaaacatcagggcacttgcctattccgcgacacctgcgtgatgggcactacagtggaagcaaggaactggggaatgcccaagactatctctatccacacaactatcctggaaattgggtcaagcaagactatctgccagaaaaaattcgtaatcatcactatttccaagcagaagatactggtaaatatgaacgggctttggctcaaagaaaggaagctatcgaccatttgcgaaaaatctga

SEQ ID NO: 398 - DNA, 222 bp, Streptococcus pneumoniae
atggaaatgatggaactaccaagtcaggaaattttgatttttacaaaacaaattcgtcattggattcttagtgatcaagttatttcagggaaaagaaaacttttcttccgggaagatactccaaaagagattttagatttgtacgaaaacattaaatctaaacttgattttgcttaccaagaagtttattctaataatgggttgaaaaaatatgaaaaatag

SEQ ID NO: 399 - DNA, 180 bp, Streptococcus pneumoniae
ttgaatttgattttcgaagagtatcagtttgtaaaaattggagataaaaaatatagagtacgcagtgttcctatgattcattcaactccgcctcaatctgtcttagatcgagatacttttacaattgactatacagatgatgaattgctcgataaagaagcagtttttactactcattag

SEQ ID NO: 400 - DNA, 252 bp, Streptococcus pneumoniae
aataataagtatcactcctttacaatacgtgtaacacgtgttataatggtgttgtcaggaggtaaaagcgctatgcctatgacacaaaaagagatggttaaactccttacggcccatggttggataaagactagaggcggtaaaggctcccatattaaaatggaaaagcaaggggaaagacctatcacaatccttcatggtaagctgaataagtacactgaaagagggataagaaagcaagctgggttgtaa

SEQ ID NO: 401 - DNA, 453 bp, Streptococcus pneumoniae
atgttagttacgtatccagctttattttattatgacgacacagacggaacagaagcgacttattttgtccatttcccagattttgaatactcagctacacaaggagaggggatttctgaggctttggctatggggtcggagtggctagggataactgttgcagatttgatagagagtgatggagagttccctcagccatcagatatcaatagcttgtctttaattgataatgatccttttaaagatgatgaagatttcgtgtcaacctatgaccttgataaatcttttatttctatggtatctgttgatgtatcagaatacctaggaagtcaggaacccattaaaaagactttgaccataccaaaatgggcagataagttgggacgagaaatgggacttaacttttctcagactttgacagacgctattgcagataagaaagttcaagcctaa

SEQ ID NO: 402 - DNA, 471 bp, Streptococcus pneumoniae
atggcaacatacggatttttagatattttagaggaagagttggacaagaactttccctttgactttgagattagttgggacaagcgtaaccacgcggtagaagtgagttttctattggaagcgcaaaatgctgcaggtgtggagatggtggatgaagacggagaggttttatcagatgacattctttttgaggaagcggtccttttctacaatcctgccaagtcaacagtcaatgaggaagactatttgactgttattccttacctgcctaaaaaaggattttcccgtgaatttttagcttattttgcgcttttccttaaagatactgctgaggttgggctagatgtcctcatggactttttggaagacccagaagcagaggaatttgtcatggaatggaaccaagaagtctttgaagaaggaaaagttggcttggaagagggagaattttacccttatccgagatactag

SEQ ID NO: 403 - DNA, 1089 bp, Streptococcus pneumoniae
atgaagaaaattgggacttatttggtttatgtgctagctgttgtctttattatgctagcttttgcttgtggaacaatcgcatttgcagagttggggtattccgcagttttagcctttacttttggttatgccttcgctcttctaagcatgtatttaatctttattcttcatgagctgggtcatgctttttgtggctacttgacaggctatcggctggtggcttttggattaggacattttattttgaccaaaaagtcaggcaggtttcatcttagtagaacagccattctgaaaaatgttggtgctcaatacattggtttaaaagaggatgaaagcgatcaaagaatcatcctgatgctttcaggaggcttgatggttcatctcggcttgatattattggcgatagtgtttggatttttgacaagaagctggtattttgcagggacttggatttttcttaatttatctttcttcctaaataacattttgtcagtcgacatcaccgatggagcaaaaatttgggaattactacaacaccctgaaaataccaaatacgcctacctggtattgagacattctgctcaaactttgctggctcctcaagaatatgatttgaaagactttgttcaagcagttcctgaggatgcacgagggagttttgcggatggtgtattaggtatgcaaggtgaagtttccattttggaagggaaggaagaagtagctaaacagcagtttcaagcattacttgagaggacaactactccgatgatgcagacagttgcccaactatccctgcttcatatcgccttgttggaaggagattttgagcaagcggagcaatatgctagtattcgacaggtcaaatcgtttctgtctctcaaactgtccaatcttcaagtgatacaagcctggtatcaatttaaggtaaggaaagatgtggttcaaactcacaaggctatgaagattgctagacagaaaatggatagtagtcgaatgttgagggacgagaaacgctattatgaaaacttgttagcagagctggaaaaggaaatgttagaaggaactgaagatggaactagaaatttctga

SEQ ID NO: 404 - DNA, 1035 bp, Streptococcus pneumoniae
atgaaaaaatcagatgttcttgatttaataaagtatcattatgagggcagagagacagaatttagaaatcaatccatagcaattgctcggaacttcaataaacatggtgatacacaaatagcacaatatattatggggttaatgtctcaaagtgatagattcatgccacaaatagaaaatcctagtgagtatttgactcctgctaaactagatattggtcctctcccattgcctctttcaattatgaatgatttaaaaggaataataaacgctgtcaatcatcatattggaataaataaatttttatttgtgggatctacaggtactggaaaaactgaaagtgtaaagcaggtggctagacttattggcaaggaattacttgtagtagatttcagtcacttagtagatagtaagctagggcaaacagtcaaaaacttagcaactctttttaatgaaatcaataatcttcctttcaagcaaaattatatcatcctatttgatgaaattgattccatagtgttggatagggttaatcagaatgatttaagagaaatgggacgagtgacttctgcctttttaaaggagttggataggctgtcaccagaaattgtattaattgcaacaacaaatctttttgaaaatcttgataaagcagttacgagaagattcgatgccataattgactttgaccgttatactgatgaagataaagtagaagtagctactattattttaaatgagttattaaagcaatttaagaatgtagctagagatttaaaattatttaaaaaaattatcaatagtgccaatgtaataccgaatcctggtgatttgagaaactcaataagaacgtcattggcatttagtgatccatcagatccgcatgattaccaaaaacgcctgctaagaagtttgcataatggtagaaatttatctatttctaaattatcgaagctaggttttactgttagagaaattgagattttgacaggtgtttctaagagtagtgtatcacgagagttaagcgaggattaa

SEQ ID NO: 405 - DNA, 2244 bp, Streptococcus pneumoniae
atgaatacattattgacattacgaggtaaaagctttacacaaaaatcaagaaataatggtatgggaccaataactatacccaaaaaaacaataattacattggaacatttgaagtatcttcatttttcattagaagagacgaaaacatattgggagaaaaataacattatcgatggtattttgatcagtatttactataatcgaattgttgccaaaagtaaccgtattaatggctatttcaatgtaggaggagggaatccattccctaatgatactattgtgggagcaaaattcaatgatgagaagacaaaacatattgttactcattatatttctagagatgctcttaataaaacaataaccgttttaagtaagataattgaagtttttgaggaacattttgatagagcgataacatgtgagatgttttctgattcatcaacgtttgcttctataaatttttcggagtatggtatttcaaaaagcaaatttcaacagtatttgagagattcttgctttattgagaattttggagttgagcacactactgtttctgatattcaaaattctatcgtgacattttatgatgtccatacagacatttttagattactgaataaattaaatattgatatttcagaagctaatatcatgaatcagaccacggtcttgcttgatgaaaaaaatattgaattactactatcaaaagcgccctatcttgtctccatgattgtggaagatttttctaagttatctgtagatgatttttctttagataataatgatttaaaaataaatcttccatctccaatgaacgaaccagttgttggcgttattgataccttatttgacaaaagagtttactttaatgagtgggtagaatatcatgattttgtctcacctgatattagcaaagatagccaagattacaagcatgggacagctgtgacttctttaatcgttgatggagccaatttgaaccctaatctggatgatggttgtggaaattttagagtgaggcattttggtgtgtcactacaaagtggatttaattcatttacaatcataaaacagataaaagagattgtttctcagaatgctgatattaaggtttggaatctttctttagggtccaatgatgaaataagagaaaattttatctctgcagagggagcattattagacgaaattcaatttgagaatgatgtaatttttatcatagctgggacaaatgcttcagtaataaatgggaaacgcaaaagaataggtgctcctgctgattcacttaattctataatagtaaattctgttgattttaataatcaatcagtgtcatattcacgagagggtattgttttatcattctttgttaaaccagatgtgtcatattatggaggaggaaatggtgactttataaatgtttgtgaacctctaggattaggtcgtgtagctggaacaagttttgcggcaccttttattgcaaggaaaatggcctatctcattcatattatgggacttagccgagaagaagcgaaggctttgctaattgatgcagcaataccctggaatgataagaaaacattcactgatttatctttgataggaaatggtattgttccaataaaaatggatgatattttatctacacctgatgatgaaattaaatttattgtgtcagatatctctagggcttatgatacctataattatgattttccagtacctatttctagtgagagttatccatatgtagctaaagcaacaatgtgttatttccctaactgctcaagaaaacaaggggttgattatacaaatactgagatgcagcttacttttggtaggttaaagtcagacggtatcaaatcgataaataaagacaaccagcatgccgaagattccccaggatatgtgagagaaaatgctgctagaaatatatttaggaaatgggataatgtcaagcatattggagagtcgtttacttctcgaaagagagctaaagcaattttaaatccatctaatcctcagtgggggatgagtattaaaacaatcgaacgtttgaaaagcggtgatggacaaggagtacgttttggtgtagtagttacattaaaagaattaaatggggttaatcgtattgaagattttattcagcaagctgaattacgcggttggctagttaatagattgcaagtagaagctcaagtagacctctttaatagtttaaatgaagaaattgaatttgaatag

SEQ ID NO: 406 - DNA, 1020 bp, Streptococcus pneumoniae
atgaatattacttatatagttggaaatggtttggatttgcaatatggtttgaaaacaagatatagggatttctacgaattccaaaataaggtttatataagtaggacagagaacgaggaaaaatattcaaatttcatttatgagtctctattttctgataaagtaaatgattatgaaaattggtcagattttgaattgtcaattggtaaattaacaaaagataacgacctcatctcctcaagtatagaaataaaggagaaatttatagatgattttagtgaagtagttgatgatttaagagaatatctacgcatacaacaagaaaaaaatcttgagaaaggtaatgcaattgactttataagcactctagataatatgaggacctctctccctgtaattaatcaacctgctatcgataaaaaatataatgaaaatctatatcaacacgatatcgtgaatatattaactcttaattacacaaatgtaatcgataaattatataatgagtcagcaaaatcatttagcaatcaattacgaactaataattataaatttcacattgcgcctccaattcatgcacatggaacggtagatatttgcacagttttaggagttagtgacgagacacagatttcaaatagttttgatgaagaacaaaaagaatccttaataaaaaatttagttttgaagaactatagagaaaatatggatgttaaaaatagcgatattataaaaaattctgacatcataattctttatggggtttctttgggagagactgatgggtatatctggaatcagattgctgaacaatcaatcagaagttctgttcctgtcataatttaccattatgtacctcattttgatgcaggaaaccccactagagtaaaacgcttatatagaaatgtagaagacaaattcatacaaaatagtggaattgatttagagttagagaagaaattaagagataaccttattgttgttattggaaagactatttttaatctgatggaaaggtaa

SEQ ID NO: 407 - DNA, 951 bp, Streptococcus pneumoniae
atggaaacatggcaagagttaaaagttacagtgaagcgtgagggagaggagttggtttccaatctcttgattgagctgggagcgcaaggtgttgcgattgaagacagtctggactatgtgggaaatgttgaccgcttcggcgagattttcccagaggtcgagcagcaagaagaaatcgtagtgacagcctactaccctgacacggtggatgtgacagtggttgaggcggacttgcaggctcgcatatcagaattgacggattttatggatttgggagagttaaaaataggtacgactgccttggctgaggaagactgggcagataactggaagaaatactatgagccagctcgtatcactcatgatttgaccatcgttccctcttggacagactatgaggcgactgcgggagaaaaaattatcaagctggatcctggcatggcttttggtactggaacccacccaactaccaagatgagcctttttgccttggaacaggttcttcgtggtggcgaaacggtgctagatgtggggactggttcaggggttctctctattgccagctcgcttctgggggctaaagaaattttcgcctatgacctggatgatgtggcggttcgtgtggctcaggaaaatattgagctcaaccctggcatggaaaatatccatgtagcggctggagatttgcttaagggtgtggaaattgaggcagatgtcatcgtggctaatatcttggcggatattctcattcatctgacggaggatgcttatcgcttggtaaaggatgaaggctacctgatcatgagtggcattatcaaggacaagtgggacatggtgcgccagtcggctgagtcagctggatttttcctcgaaactcacatggttcaaggggaatggaatacctgtgtctttaagaaaaccaaggatatctctggtgtgattggaggctag

SEQ ID NO: 408 - DNA, 744 bp, Streptococcus pneumoniae
atgcagcagtattttgtaaaaggcagtgctatctctcctgtcactatcgaggacaaggaaaccagtaagcatatgtttcaggttatgcgcttgaaagaagaggatgaggttaccttagtctttgatgatggcatcaagcgcttggcgcgcgtgctggatatggaaaatcgtcagtttgagttggtccaagaattaaatgacaatgtggaactaccagtccaagtgaccatcgcatctggatttcccaagggagacaagctggagttcatcgctcaaaaagtaaccgaactgggtgctagccaaatctgggcctttcctgcagactggtcagttgccaagtgggatggcaagaaattgggtaaaaaagttgaaaaactagaaaaaattgcccttggagcagccgagcaaagcaagcgtaatattgtaccaagtattaaacttttcgagaaaaaagcagattttctagctcagctggaccagtttgactctatcatagtagcctatgaagaatcagctaaagaaggagaagccgctgcgcttctgcaagcagtcactggtcttgaaacaggagccaaactgctctttatctttggtccagaaggtggtctgtcacctgcagaaatcgaaagttttgaagctaaaggagcagttttggcaggcctaggtcctcgtattttgcgagcagaaacagcaccgctttacgccttatcagcccttagtgttttagtagaattagagaaataa

SEQ ID NO: 409 - DNA, 1797 bp, Streptococcus pneumoniae
atggaacaaaaacaccgttcagaatttccagagaaggaactctgggatttaacagccctataccaagaccgtgaggatttcttgcgtgcaatcgagaaagctcgtgaagacatcaaccagtttagccgtgattacaagggcaatcttcacacttttgaggatttcgagaaggcctttgcggaattggaacagatctacattcagatgagccatattggcaactatgcttttatgcctcagacgacggactatagcaatgacgaatttgccaatattgcccaagctgggatggaatttgaaacagatgccagcgtagccttgaccttctttgacgatgccttggtggtagcagacgaggaagtcttggaccgtttgggtgaattgcctcacttgacggcagctattcgtcaggccaaaatcaaaaaagcccactatctaggggctgatgtggagaaggccttgaccaatctcggtgaagttttctatagtccgcaggacatttatactaagatgcgagctggggattttgaaatggctgactttgaagcccatggcaagacctataaaaacagctttgtcacctatgagaatttctaccaaaatcacgaggatgctgaggttcgtgagaaatccttccgttccttctcagagggacttcgtaagcaccaaaatacggctgcagcagcctatctggctcaggtcaagtctgaaaaactcttggctgatatgaagggatacgactctgtctttgactatcttctagctgaacaagaagtggaccgtgtcatgtttgaccgccagattgacctcatcatgaaggactttgcaccagtcgctcagagatacctcaagcatgttgccaaggtaaatggtcttgaaaagatgacctttgcagactggaaattggacttggacagcgccctcaatcctgaagtgactattgacgatgcctatgatttggtcatgaagtcggtagaacctttggggcaagaatattgtcaggaagttgctcgttatcaagaagagcgctgggtggactttgctgctaacagtggcaaggattccggtggttatgcggcggacccatatcgcgtacacccttatgtactcatgagctggacaggccgtttgagcgatgtctataccttgattcatgaaatcgggcattctggtcaattcatcttttcagacaatcaccaaagctatttcaacgcccacatgtcgacctattatgttgaagcaccgtcgaccttcaatgaattgctactcagtgattacttagagaaccaatctaatgacccacgtcaaaaacgcttcgctctggctcatcgcttgacagacacctacttccataactttatcacccacctcttggaagccgccttccagcgtaaggtgtatacattgattgaagaaggagaaaccttcggagcaagcaaactcaacagcattatgaaggaagttttgacagatttttggggcgatgccattgaaatcgacgacgatgcagctttgacttggatgcgccaagctcactactatatgggcttgtatagttacacttactctgctggtcttgtcatctcgacagctggttaccttcatcttaaaaactcagaaactggagctgaagactggctcaatctcctcaaatcaggtggtagcaagacaccacttgagtcagccatgattatcggtgctgatatttcaacagacaaaccactccgtgataccatccaattcttgtctgacacagttgaccagattatcgcctacagtgctgagttgggggagtaa

SEQ ID NO: 410 - DNA, 678 bp, Streptococcus pneumoniae
atggaaccagatattttcatcatcacaaaactcttatcagacccttctcggatgcacattttagatattctaatggatggaaaagctcacacggttaacgaaattgccagctttaccaaaatcaagcaacatactgtcagctatcacctcaaattacttaccgaagcgcaggtaaccactctacaaacctatggacgttttcattattattctttaaaaagtgctgccattgcagaaatgctggaatttctcagcttctactctcctcagcgtgatgtcaaaagttataaacaacacattcacaaaaaggaattaaaggtcgctcgcacctgctatgaccatattgctggtgagcttggcatttccattaccaattatctcttgcaagaaaatctcctcagcgaatcagaaaaagacttccaactcactgaagctgggaagtcttatttccaaagaaaattacacattgatacggatgaattgaaaaagaaaaaacggaaattttgccctaaatgtttggattggagcgaacgtaaaaatcatgtcggcggagctctcggcaatgctcttttagaatttttcagtgaaaaacaattggtcatccctgcacaaacgccacgttcacttaccattacagagaagggcaaagaattcctcgaaaaggaatgggggatttaa

SEQ ID NO: 411 - DNA, 651 bp, Streptococcus pneumoniae
ttgggtatcttgggaatcaacggtgctggcaaaacatccactttaaagatgatttactcactgacctcaatttcctcaggagagattgatatcttggggcaaaatattgaaaccaatcgtcgtaagagtaaatcttgtctgggtattgtagggcaggaggatatgctggacatgaccttgaatgtttatgataatctttttgctcacggtctatgttatggtatctcatctgtcgaacttaggaagagaatcgattctctcttggattttgttcaactgagcaaacatgcgcaaaagatggtgaatcagctgtcgagtgggatgcgacgacgtcttgtcttggcaagagctctcatcaatcgacctgatattatcattttagatgaaccgacagttggtttagacattcaatcccgcaatattatttgggataaacttttggagttgaaggaattaggtgtttccatcattattacttcccactatatgaatgagattgaatatttgacagatagggtgctgatgctccaccaagggactatcaaagaagaaggaactgtagaagacttgctcatcaagtatgatgctgacaaccttgagacgctttttttggggttgactgggacagagaaggaggacttgcatgtttaa

SEQ ID NO: 412 - DNA, 765 bp, Streptococcus pneumoniae
atgtttaagttatcatttcagtccatcggacacgttgtggtacgcaactacatgagttttagaaatttatttaaaatttcaattgtccccaaccttatcgaccccctcttttatcttttagcaatgggatttggagttggtgcctatttgacgcatgttaacggtatgctctaccgtgattttgtcattacaggtttaattgctgcgactgccatgtctgcggccaccgcagaaacaacggtcaatgcctttatccagtataagattgaaaagacttatgatgctatgttgatgacgccaatcaatacgagtgatattgtggtgggtcaggctatctgggcaggtattcgtgcagtgattttcggtgggattttttggctgatttccatgcttatcacagcgcattttcatgtcttgatgttattgattcctctgattttatttatagtgggttatttgtttggtgttttgggactaatctttacctacttggcgccgtctagggaatttctgaattactacaatgttttggtaatccgtcctctttatatgttttcagataccttctttcccattacttccttgcccccaatacttggtgatttgacttggttttctcccttgtatcatgctactcgcatgattcgtattatatggggaggtgaggtgacaggtttgtatcttcatcttatctggttgatagccttggcgctcttgataacggtgcttcctatgtatatgttacatcgtagatattatagatag

SEQ ID NO: 413 - DNA, 792 bp, Streptococcus pneumoniae
atgtatcaagatttactaagaaaaatagcagaagaaaaaccaaattataaccaggaagaaatccagtggttgtttgatcatttgggaaatccttctccagaaattcgtgatgaccttatttttacaagctttgctaaggggattcaggaagagctatttatacaggagcaatttcatttcattgctgaaggggtttcatctgatgtaggactagataaagagattgataaggtaggcctgccaacactggaacgttcttttagggcacttgtttatgcaaatctcttgtctgcagatgctaaccagcaatcggttttttatcagggattacaatcagaaattcgtgatgatctttcaaatcaaggcttgcactatctttcaaaagaaaaggatacaacaggtttctcaagtcagtatggttgggttcattcttttgcacatggagccgatttactgacagaggtggtttgtcatccagactttcctaaaaacagagttcatgaagtatttgatatacttggccaactatttaaaagaatgtcgattcgctttacagatgatgaggattggcgtttagcaagagtgatctatgaacctattttacaagggaagttggagcaagaacaagtagcttcttggataaaaactgttgattttccgatagaagaaagggaggatttttccaaattttccaactttagatcctgtctggtggaagtctatgtccaacttgaccagagaaatagtttacaagatgagttgaaagaagctatccagtcttttcaatactag

SEQ ID NO: 414 - DNA, 630 bp, Streptococcus pneumoniae
ttgtattcgtcggggacaggagctgttgtttttggaaatggtcttgatggccttggtcaccttggaatcgcctttgcctttggtttggcaatcgtggtggcagcctactcaatcggaactgtttcaggtgctcacttgaacccggctgtttcgattgctatgtttgtaaacaaacgtttgtcatcttcagaacttgtaaactacatccttggtcaggttgttggagctttcatcgcttctggcgctgtcttcttcctcttggctaactcaggtatgtcaactgctagtcttggtgaaaatgccttggcaaacggtgtcactgtctttggtggtttcttgtttgaagtcatcgcaactttcttgtttgtattggttatcatgactgtgacttcagaaagcaagggcaatggcgcgattgctggtttggtaatcggtttgtcattgatggcgatgattcttgtcggattgaagattactggactttcagtaaacccagctcgtagcttggcaccagctgtcttggtaggcggcgcagcccttcaacaagtttggattttcatccttgcaccaatcgctggtggagttcttgcagcccttgttgcaaaaaatttccttggaacagaagaataa

SEQ ID NO: 415 - DNA, 180 bp, Streptococcus pneumoniae
ttgctcaaagcagtgtttgaggttgtcgataaaactgacgaagtcagcttaaaacactgttttgaggttgcagatagaactgacgaagtcagtaaccatacctacgacaaggtgaagctgacgtggtttgaagagattttcgaagagtatcatacgaaaaagccctgttcctcaagatga

SEQ ID NO: 416 - DNA, 573 bp, Streptococcus pneumoniae
ttgcgtgctctgaacatttcccattttggaaggagtactgtgaaacgtcaatcagccttggtcgtctttagtggtggtcaagattcaacaacctgccttttctggggcatgcaacactatgaaacagtcgaagctgtcacctttgcctacggccaacatcatcacctcgaaattcaaattgctagagaaatcgccaaggaacagggcattcgtcaccatatcctcgatatgtctctgctgggacaaatcactgctcaaccagactttgcgacgattcatatttcctacattcctgacaagctctgtgtcgagtcaaaatctctcaaactatatctatttagctaccgaaatcacggagatttccacgaaaactgtatcaacaccatcgggaaagacttggtcaacttgctagaccctcgctatttagaagtctggggaaaattcactccgcgcggtggcatttcaatcgacccctactacaactacggtaagcaaggaactaagtatgagggcttggcagaacaacgcctcttccaacacgacctttatccagagaaaattgacaaccgctaa

SEQ ID NO: 417 - DNA, 315 bp, Streptococcus pneumoniae
atggcaaaagcaattacagatgcaacattcgaacaagaaacaaaagacggtttggtcttagtagacttctgggcaacttggtgtggtccatgtcgtatgcaaggtccaatcttggacaaattgtctgaagaactttcagaagatgtcttgaaaatcgttaaaatggacgttgatgaaaatccaaacacagctcgtgcttttggaatcatgtctattccaactcttctcttcaaaaaagacggccaagttgtcaaacaagttgcaggtgttcacacagcagaacaaatcaaggccatcattgctgaattgagctaa

SEQ ID NO: 418 - DNA, 303 bp, Streptococcus pneumoniae
ttgcgtgcgcaatcatttttcttgacattctcttttataaggagtaaaataaagttagcattaaacaaaggagttttaaatatgattgaaattacctatatagatgccagcaagaacgaaagaactgtgactttcgagtcttatgaagactttgaacgttcacaacaagcttgccttatcggcgtcgcagactactaccctgtccaaaaattaacttacaagggtcataatttggactaccatgggacttatggagatatcttcttctatctcatgaaacaagatttaagccaatataactaa

SEQ ID NO: 419 - DNA, 201 bp, Streptococcus pneumoniae
cttcatctaagcccgagcgcagtttctaggatggtggctcgcttggaagctaaaaattgcggtctactcagtcgcatgtgttgccatcaagatagacgctctagttttatctgcctgacaaatgatgggcaaaagacactggcctcgctacaaaagactgtcgaagaaagcttggaagcaggtttggatttcttgatttaa

SEQ ID NO: 420 - DNA, 225 bp, Streptococcus pneumoniae
atggactttcttctatattatgactctaaaaagaaaggagacactatgacctatttggaaaaatggtttgacttcaatcggcgtcagaaagaaattgaaagtctcttggaagagaccattgcccaacagagcgagcaaagtctgaccttgaaagagttctacctgctctactatctggacttggctgaagaaaaatctctacgccagattgaactggcagattaa

SEQ ID NO: 421 - DNA, 954 bp, Streptococcus pneumoniae
atgtctattagccaacgtacgaccaagctcatcttagctacctgtcttgcctgcctgcttgcttattttctcaatctttcgtcagcagtttcggctggaattatcgctctcttgagcctatctgatacgcgtagaagtactttaaaactggctcgcaatcgtcttttttctatgcttctagctctggctatcggtgttctagcttttcacttgagcggatttcatatctggagtctcggcctctatctggccttctacgttcctttagcctacaagatgggctgggaaattggcatcacaccaagcactgttttggttagccatctcttggttcaagagtcaacctctccagaccttctagtcaatgaattccttctctttgctattggtacaggatttgccttgcttgttaatctctatatgccttcacgagaagaggaaatccagcactaccacacgctggtggaagaaaagttaaaagatatcctccagcgcttcaaatactatttatccagaggagacggacgcaaccgagcacagctggtagcagaattagacacgcttttgaaagaagccctcagactggtctatttggatcactctgaccacctctttcaccagaccgactaccatatccactactttgagatgagacagcgacaaagtcgtatcctgagaaacatggcccaacagattaacacttgtcaccttgccgccagtgaaagcctgatcttagcgcaactcttttcaaaaattgcaggtcaactgagccagaccaatcctgcttctgatttgctagatgaaattgaacgttatctggaagtcttccggaaccgcagtctgcccaaaacaagagaagagtttgaaacccgcgccacccttcttcaactcctacgtgaagccaaaaccttcatccaagtaaaagttgatttttaccaaaaatatagacagtaa

SEQ ID NO: 422 - DNA, 861 bp, Streptococcus pneumoniae
atgatagggactttcgccgctgctcttgtagctgtactagcaagtttcatcgtccctattgaaattaccctaaatagtgccaatactgaaattgcaccaccagatgggattgggcaggtcctcagcaacctcttgctcaaactggttgacagcccagtcaacgccctgcttactgctaactatattggaatcttatcttgggcagtcatttttggaatcgctatgagagaagccagtaaaaatagtaaagaattgctaaaaactatcgctgacgtgacttctaaaattgtcgaatggatcatcaatctggctccatttggaatccttggtcttgtttttaaaaccatttctgacaagggagtcggaagccttgccaactacggtattttattggttccattagtaacgactatgctttttgttgcccctgtggtcaaccctttgattgccttcttttttatgagacgcaatccttaccctctagtttggaactgcctccgtgtcagcggtgtgacagcctttttcactcgtagttctgcgactaacattcctgtcaacatgaaactctgccatgaccttggactcaacccagatacctattctgtttctatcccactcggttctactatcaatatggctggagtagcgattaccattaaccttttgacccttgctgcagttaacactcttggaattcctgttgactttgccacagcctttgtcctcagtgtggtagcagctatctcagcctgtggtgcttcaggtattgccggagttccctccttcttatcccagttgcttgtagccttttcggtatttctaacgatattgccatacaagttgttggggttggttttgtga

SEQ ID NO: 423 - DNA, 225 bp, Streptococcus pneumoniae
ggcaagccttgtcaagcgtatcttgattggtatgctttatggggaatcctaggactgacccttcctaatctctcagggattgggctactcggggatttattcgttggaggtctaaaagctgttgctcctatcctagtctttgccctcgttgccaatgccctttcccaacatcaaaagggacaagatagcaatatgaaaactgttgttttcttgtatatcctatga

SEQ ID NO: 424 - DNA, 420 bp, Streptococcus pneumoniae
atgcaaaaatttattcaggcttatattgaaaagctagatgtgacaaccattatcgagaatattctaaccaaggtcatttctcttttactgcttttgattgtattttatattgctaaaaaaatgcttcataccatggtgcagagaattgtcaaaccttctctaaaaatgtctcgtcatgatgtcggacgccaaaaaaccatctcacgtttactagaaaatgtgtttaattatacgctatatttctttttactctactgcattttgtcgattttaggtttgccagtttctagtttgctggctggagctggtattgctggggtaccgattggtatgggaaccaaggctttctgtctgatgtcatcaatggctttttcatcctctttgaacgtcaactggatgtgggagatgaggtcgttctga

SEQ ID NO: 425 - DNA, 198 bp, Streptococcus pneumoniae
tttgctggctggagctggtattgctggggtaccgattggtatgggaaccaaggctttctgtctgatgtcatcaatggctttttcatcctctttgaacgtcaactggatgtgggagatgaggtcgttctgacaaatggaacgattactgtatcgggtaaaggttgtcagggtgggaattcgtacgacacagcttcgtag

SEQ ID NO: 426 - DNA, 177 bp, Streptococcus pneumoniae
ttgtccctaaccgaaatatcacagttgttagcaatttttcacgcacagactagacctgttattttaagtaatttgtggtacaatagagggagtttaataaggagaaaagatggttttagaaaagcagttgggcaatggttgtacctggatagacctagacctaggaaagttgaataa

SEQ ID NO: 427 - DNA, 909 bp, Streptococcus pneumoniae
atggttttagaaaagcagttgggcaatggttgtacctggatagacctagacctaggaaagttgaataaactagaagacctttctgaaatttacggtttggacaaggaaaccattgaatacgcactggatagaaacgagcgcgcccacatggactaccaccgtgaaagtgggacggttacctttatctataatgtcctagacgtaaaaaaggacaaggcctactatgagacttttcccatgacctttattgtcgagcatcgtcgcctgattaccattagtaataccaagaacgcctatgtcattgaacagatgactcgttatctggagaaccatgacacgctttcgatttataagtttctctttgccagtctggaaatcatcagcaatgcctactatcctgtcattgagcagatggacaagagtagggatgaggtcaatgacctcttgcgccagcgaactaccaagaaaaacctctttgccctgtctgatttggagactggtatggtttatctgacggcagctgccaaacaaaatcggattttgttagagcatattcaaggtcatgccttgtatcgtagttttgatgagattgagagagaacagtttgatgatgccatgattgaggctcatcagctggtatccatgacagacctaatctctcagattttacagcagctttcagcctcttacaacaatattctaaacaataatctgaatgacaatttgacaaccttgactatcatttcagtcttgctagctgttttggcagtcgtgacaggctttttcggaatgaatgttcccttacctttaacagatgagccccatgcttggctctatatcagtttggctagtgcaggtttgtggattgttttatccttgttactaaggaaaattgcgaaaaaaagttaa

SEQ ID NO: 428 - DNA, 528 bp, Streptococcus pneumoniae
atggcgattgaaaattatataccagattttgctgtggaagcagtctatgatctgacagtcccaagcctgcaggcgcagggaatcaaggctgttttggtcgatttggataataccctcattgcttggaacaaccctgatggaacgccagagatgaagcaatggctacatgaccttcgggacgcgggtattggcattatcgtagtgtcaaataacaccaaaaaacgcgttcaacgagcagttgagaaatttgggattgattacgtttactgggccttgaagcccttcacatttggtattgaccgtgctatgaaggaattccactatgacaaaaaggaagtggtcatggttggtgaccagctcatgacagatatacgagcagcccaccgtgcagggattcggtcaattttagtcaaacccttggtccaacatgactcaatcaaaacgcagattaaccgaactcgtgagcgtcgtgttatgagaaaaatcactgaaaagtacggaccgattacatataaaaaaggaatttaa

SEQ ID NO: 429 - DNA, 1107 bp, Streptococcus pneumoniae
atggaagaaattctctgtattggttgtggagcaaccattcagacgacagataaagctggtcttggttttaccccccagtcggcacttgaaaaaggtttggagactggcgaagtctattgccaacgctgtttccgtctccgccactacaatgaaatcacagatgtccagttgacgaacgatgatttcctcaagctcttgcacgaggtgggagacagtgatgctttagtggtcaatgtcattgatatctttgattttaatggatctgtcatcccaggtttaccacgtttcgtctcgggcaatgatgtcctcttggtaggaaataaaaaagatatccttcctaagtcagttaagtctggtaagattagccagtggctcatgaaacgtgcccatgaagaaggtcttcgtccagtcgatgtggtcctaacttcagcacaaaataaacatgccattaaggaagtcattgacaagattgaacactaccgtaagggccgcgatgtctatgtggtcggtgtgaccaacgttggaaaatcaactctaatcaatgctattatccaagaaatcacgggtgatcagaatgtcatcactacttcacgcttcccagggacaaccttggacaaaatagagattccgcttgacgacggatcttatatttacgatacgccgggaattatccaccgccaccagatggctcactacttgacggccaaaaacctcaagtatgtcagtcctaaaaaggaaatcaagcctaagacctatcagcttaatcctgagcaaaccctatttttaggtggtttgggacgctttgactttatagcaggagaaaagcaaggatttactgctttctttgataatgaactcaaactccatcgtagcaagcttgaaggagctagtgctttctacgataagcacctgggaactcttctgacaccaccaaatagcaaggaaaaagaagatttcccaaggctagtccagcatgtctttaccattaaagataagacagacctagtcatctcaggcctaggatggattcgtgtaacaggcacagcaaaagtcgccgtctgggcaccagaaggcgtcgccgtcgtcacacgaaaagcaattatttaa

SEQ ID NO: 430 - DNA, 312 bp, Streptococcus pneumoniae
atgtcattaacatcaaaacaacgtgccttcctcaacagccaggcacacaccctcaaacctatcatccaaatcgggaaaaatggactcaacgaccaaatcaaaaccagcgtccgtcaagctcttgatgcgcgtgaattaatcaaggttactctcttacaaaacacagatgaaaacatccacgaagtagctgaaattttggaagaagaaatcggtgtggatacagtccaaaaaataggacgcatcttgattttgtttaaacaatctagcaagaaagaaaatcgcaagatttctaagaaagtcaaagaaatctaa

SEQ ID NO: 431 - DNA, 615 bp, Streptococcus pneumoniae
ttgactccctttaccaaggtagagttggagccagaaatcaaggagaaaaaacgcaaacaagttgggattttaggggggaattttaaccctgttcacaatgcccatctcattgttgcggatcaagtacggcaacagttgggactggatcaagttctgctcatgcctgaataccaacctcctcacgttgataaaaaggaaaccatccctgaacaccatcgtctcaagatgcttgagttggcaattgagggaattgacggcctagtcattgaaaccattgagttggagcgcaagggtatttcctacacctacgacaccatgaagattttgacagagaagaatccagatacggattattactttatcatcggtgccgacatggttgactatctgcctaagtggtaccgaattgatgaactggttgacatggttcagtttgtgggggttcagcgtccacgctacaaggtagggacttcctatccagttatctgggtggacgtaccgctcatggatatctcgtccagcatggtgcgtgccttccttgcccaaggtcggaaacccaactttctcctacctcagccagtgctagactacatcgagaaggaggggctctactga

SEQ ID NO: 432 - DNA, 594 bp, Streptococcus pneumoniae
atgtcctatcaagactatatcaactgctcccgtgaggctttgttggaaaaaatggcagagcttctacctgagaaacgtctaacccattgtctaggtgtggagcgtgccgctatggaattagctcagcgctttggtgtagatgttgagaaagcaagtctagcaggtcttcttcatgactatgctaaaaagttgtcagatcaggaatttctagacttgattgaccgttaccagctagaccctgacctcaaaaactggggcaataatgtctggcatggtatggtcggaatttacaaaattcaggaagatttggatttgcatgattcagaaatcctgcgagccattgaagtccatacagtcggtgctggtcaaatgacagacctagataaggtcatctacgtcgcagactatatcgagcacaatcgagcctttcctggagtagatgtggcgcgtgagattgcaagtctatcgctcaataaggcggtggcctacgaaacagctcgtaccgtggagtatctagctcatcagggattccccatctatccccaaacccttgaaacctataacgcctttgtgcactatttgaaagaggactaa

SEQ ID NO: 433 - DNA, 501 bp, Streptococcus pneumoniae
atgaagacggcttttataatcattgatgttcagaatgttttagtagaaactgggttccagacaaaaagtctattggaaaaaatttcttatttacaaaaccaggctagaagcaagaatattgaaattatctatgttcaacatattgagaactctgaagctcaaacatcagaagattggcagttatctgcgcttttaaatcgaaaacctgctgaaaaggtctttcagaagaagtataacagtattttcaaagaaactggcttaaaagaatacttggataaacaggggattgaaaaattagttttatgtggtatgcagacagaatattgtgtggatacctctgtcaaggttgcctttgaatatggctatcagcttattgttccagaaggtgctgtcacaacctttgatggggatgacattccagcagaaacgattaatgaattttatgaggacatttgggaggagcgctttgcagatgtcctagattacaaacatattttctaa

SEQ ID NO: 434 - DNA, 354 bp, Streptococcus pneumoniae
atgaacgaaaaagaattactagaactagtcgtgaaagcggctgatgagaaacgtgcggaggatatcctcgcacttgatgtacaagatttgactagtgtgacggactactttgtcatcactagctcaatgaatagccgtcagttggacgctatcgcagctaatatccgtgaaaaagtagctcaagcaggctttaaaggtagccatgtcgaaggcgatgcagctggaggctgggtcttactggacctcggtgctgttgtcgtgcatatcttttcagaagaaatgcgtgcccattataatctagagaagctatggcatgaggcgaattcagtagatatttcagaagctcttgcttag

SEQ ID NO: 435 - DNA, 741 bp, Streptococcus pneumoniae
atggcgacttatgaaacctttgcggcggtctatgatgcggtcatggacgatagtttatacgacaaatggacgaatttttctctgcgtcatttgcctaagaccaaggagagaaagaaactcttggaattggcttgtgggacaggaattcaatcagtgcgcttctctcaggctggttttgatgtgactggacttgacttgagtgcggatatgttgaagattgcggagaagagagcaacttcagccaagcaaaagattgcttttatagaaggtaatatgctgaatttgtccaaggcagggaaatacgattttgtcacgtgttattcggactctatctgctatatgcaggatgaggtggaagtaggggacgtctttaaggacgtgtacaatgcgctgaatgaagagggagttttcatctttgacgtgcactcgacctaccagacagatgaagtattccctggctattcctaccatgaaaatgcggaagattttgccatgctttgggatacatatgaggacgaagctcctcactccatcgtgcatgagctgactttctttatcaaggaggctgacggttcctttagtcgccacgatgaagtacatgaggagaggacctatgagatcttgacctatgatatcttgctggaacaggctggatttaagtccttcaaactctatgcagactttgaggataaggagccaacagaaactagcacccgttggttttttgtggcgcagaagtag

SEQ ID NO: 436 - DNA, 564 bp, Streptococcus pneumoniae
atggccattatgaaaaggattgaactccgcgataatacctgttatggtcatgctaatctcctacttctgcgccacaaaaaaccaacgggtgctagtttctgttggctccttatcctcaaagtctgcatagagtttgaaggacttaaatccagcctgttccagcaagatatcataggtcaagatctcataggtcctctcctcatgtacttcatcgtggcgactaaaggaaccgtcagcctccttgataaagaaagtcagctcatgcacgatggagtgaggagcttcgtcctcatatgtatcccaaagcatggcaaaatcttccgcattttcatggtaggaatagccagggaatacttcatctgtctggtaggtcgagtgcacgtcaaagatgaaaactccctcttcattcagcgcattgtacacgtccttaaagacgtcccctacttccacctcatcctgcatatagcagatagagtccgaataacacgtgacaaaatcgtatttccctgccttggacaaattcagcatattaccttctataaaagcaatcttttgcttggctga

SEQ ID NO: 437 - DNA, 1098 bp, Streptococcus pneumoniae
atgaccataacaggtattatcgcggagttcaatccttttcataatggccataaatacctgctggatcaggcagagggactgaaaattgttgccatgtcagggaatttcatgcagcgtggagagcctgctattgtggataagtggacaaggacccagatggcgctggaaaatggcgcagacttggtagtggaattgccctttttagtcagtgttcaggcagctgatttctttggtcaaggagctatggatatcttggatcgcttgggcattgatagtctagtttttgggacagaggaagttcgagattatcagaaaattgctgacttatacacagagaaaggtgctgagatggagaaatttgtggaaaatctgcctgattccctttcctatccccagaaaacccaagctatgtggaaggaatttgctggtcttgatttttcaggtaatacccccaatcatgttcttgctctggcctatgccaaggcggttgcaggacgaaatatcaagctgcatccgattcagcgtcagggggcaggttaccattctgtgaataaagatgtggactttgcctcggcgacagccctccgtcaacatcagaaggaccaagatttcttagaacgttttatgccttctgttgccctatttgagcaggccagtaaggtgatctgggaagactattttcccttgctccgctatcaaatcttgtcaaatcccgacctaaccaccatctatcaggtcaatcaagaaatggctgtgcgcattaaagaagctattaaaacagcccagtctgtggaagaattggtcgagttagtgactaccaaacgttacaccaaggcgcgtgtcagacgcctattgacctatattttggtgcaggctagagaaaatgtcttgccagaagccattcatgtccttggatttactgaaaaaggcaggcaacatctcaagtctctgaaaggacaggtcaatctagtcagccgaattggcaaagaaccttgggatgctatgactcaaaaggttgaccagatttaccaactaggaaagccaagtatagcagagcaaaattttggcagagtgccgattagaatagaaacaaactaa

SEQ ID NO: 438 - DNA, 189 bp, Streptococcus pneumoniae
ccagttctcttcattataccacaaaataacaagcataaagcggattcaaagataaagattaaggttcatatactaattttctttattgactttttgtcttctgtattagggagtttatcattttccaaaaactttatcttcaatttgttatctaaaatttctacaataaaaaagcctacctttcagtag

SEQ ID NO: 439 - DNA, 2748 bp, Streptococcus pneumoniae
atggaagaaaattataatttatctataactcaaataaagaattctattaaagaaaattccttagttttgtttgttggtgcaggaatatcagctaattctaatctaccaacttggggagaattgattcaatcattaaaaaaagaattgaacataccagaagaaagaacagatagtccactgagaattgctcagtattattatgatacttttgggaaaaatcagtacacaaagaagatagaagaaattttctttaagaagggattgagtaaaccaaatgagttacataaattaatagaaaaaattgcaccaaaacatattattacgacaaactatgattcacttctggagagtcaatttgaaagtggcttgttaaagtacaatgtagtcgctgaggataaagacatcccttatacgagttcggaaagatacttgattaaaatgcatggtgacttcagtaagaaaaatattgttttgaaagaagatgattatttagactatcatttgaacttcccaatgatttctactttaatccagtcattgataatgaatcatactctattgtttgtggggtattctctaagtgattcgacttttaattcaatttttagaatgattcaaaatacatttaaattggatgctaaaaatgcttatttttatactcccgaggaaccgtctatgatcattcgagagtattataagaagcaaggaattttcattatctctaatgaagagaatctaggtcaggagacatcagaaaaacagaacaaattgtattgcaggacaaaagattttttagaggttctatcagaaaaccgaagtcaagatgtaaataatgctgatgatttatggaatcaactggcttttttagatagacttagttttattgatgcgaaagatttttctagatattctgatttaaagaaaagggctttaaactgggatgatgagtattgctggtttggaaatgatcaattaagatttgaaattgatggtcatgaagaattacgaattatggtatctaaaaaatctttattaaatcgctttctagatatggagattggtgagcctagggatttaaaggggaatcgattcttaagtaaggcttttaagttgtatgaagaaaaacaatattctttagcaaaagcaaaatttagagaactagctaatatagcatttcgtcagaaagactattttaatttcttagtttgtgaatttaattttcagcaaattcaaataattgatagatacgaaaaaacacctagttatgcagagccactttatgatggagaattaagcgaattaacagaacaaattcttaactcggttacaggagatgagaaaaagattatagaattttttagagattcaatccttaacttcaattttttatatagaaaattagaaactattaatgaattatttgatgaaattcgtgaagagcatgaaagctatagaagaggaggatggtctgctaataatcatctatttaatgcggagtttacagtaaaaaatctttataactttttaaaattaaattgtttatgtgttgaacattataagatttataaatcaatcattaatagatatttagaaatattattactcagttatgataattcatatgtaaaccctgactcaagtattttcgatagaacatcttcttggcttaaaaatcttgatttggatgatgttaaattaattcttccgaatatagattttaaggttgtaaatttatattttagaaactattcatttggtaaaataaaaattactgaggaagcgaaagactacttgttgaatcgaattacttatcttcaagaaagacttgaaattactgaagatgaaaatcttcgagagcttaaaaatatgctaatttttcttccccttgttgatgatattgacatagaaaaagtaatagaaattttaaataatcaaacactgtattataattggagcgaggaatttaggagaattattaaaattgtcctcgataatatggatgttattgataaagattcattgaaatctaagataattgggattgtaaataaacatttaaatgaaattttggagaaaaatttttctttatataattcagtgtatccgctctattcacagttactagaatactgctcaactgatcaggaaactgcaataatagtactcgaaaaatttaatacagatattttaagaataaaatataaaaatgatgatataaaaaatatcatagaatattctgacttgatatgtcacttatttaagtattttgaaaaggatattaaagatgacattttagatactctaaaagtttatgaagaatcagaaaatattatttaccataaagtaattgatttgatgagttataatgtctatgattttcctcagatacaaaataaaatctaccattatttgattaaaagaattaatgataaaagagttgagggggttaaaactttcccagacccaagagaaaagtctgtatcagatttatacaacttaagtagaaaaggatatttttctgattttgagattttaaaagatattgaagaagatattcgaggactttatcctgaagtagattggacctggttccatgatagaagtgatgatgttatccatcgtctactagaacatagaactcccaataatattaaaacttatttttcaaaaaatgaagaagataataaattgattaatgagtatattttaaaagctttcgatgaggataaattaatacttaagaaataa

SEQ ID NO: 440 - DNA, 1611 bp, Streptococcus pneumoniae
atggaaatcatgtcgcttgcgattgctgtttttgccgtcatcattggtttagtcattggatatgtcagcatctcagctaagatgaaatcatctcaggaagctgcagagttgatgcttttaaatgctgaacaagaagcaactaatttacgtggacaagctgagcgtgaagcggatttacttgttaatgaagccaaacgtgaaagcaagtctcttaaaaaagaagcactattggaggccaaagaagaagccagaaaataccgtgaagaagtggacgctgaattcaaatcagaacgtcaagaactcaaacaaatcgaaagtcgtttgacagagagagctactagccttgaccgtaaggacgacaatttgacgagtaaagaacaaacacttgaacaaaaagaacaaagtatttctgatagagcgaaaaaccttgatgcgcgtgaagagcaattagaggaagtcgaaagacaaaaagaagcagaactagagcgtattggtgctctgtctcaggcagaagcacgagatattatcttggctcagacagaggaaaacttgaccagggagattgccagtcgcattcgcgaagctgagcaagaggtcaaggaacgttctgacaaaatggccaaggacatcttggttcaagctatgcaacgtatcgctggtgaatatgtagcggagtcaacaaactcaacagttcatctgccagacgatactatgaagggacgcattattggtcgtgaaggtcgtaacattcgtacctttgaaagtttgacaggggtcgatgtgattatcgacgatacaccagaagtggtgaccttgtcaggatttgatccgattcgtcgtgagattgcccgtatgactatggaaatgttgctcaaagatggtcgtatacatccagctcgtatcgaagagttggttgagaaaaaccgtcaagagattgacaataagattcgtgaatacggtgaggctgctgcctatgaaattggtgcgccaaaccttcatccagacttgatgaagattatgggacgtttgcagttccgtacttcatatggacaaaatgttttgcgccattcgattgaggttgctaagttggctggtatcatggcgagcgaacttggtgaaaatgcggctcttgcccgtcgtgctggattccttcacgatatcgggaaagccattgaccatgaggttgaaggtagccacgttgaaatcggtatggaattggcccgtaagtacaaggaacccccagttgtggtgaatacgattgctagtcaccacggagatgttgaagctgagagcgtgatagcagttatcgtcgctgcagcagatgccttgagcgcagcccgtccaggtgctcgtagtgagtctcttgaaagctacatcaagcgtctccatgatttggaagaaattgctaacggctttgaaggagtgcaaactagctttgcccttcaagcaggacgtgaaattcgtatcatggtcaatccaggaaaaatcaaggacgacaaagtcacaatcttggctcacaaagttcgtaagaaaattgaaaacaatctcgattatccaggaaatatcaaggtaaccgtgattcgcgagcttcgtgcagtagattatgctaaa

SEQ ID NO: 441 - DNA, 627 bp, Streptococcus pneumoniae
atggcagaccgaggcttactaatcgttttttctggtccttcaggggttggaaaaggaacggttagaagagagatttttgagagttctgaaaaccaatttcaatattctgtatcgatgacgacacgcgcacaacgtcctggagaagtggacggtgttgactatttcttccgtactcgtgaagaatttgaagagctgattcgtcaaggacagatgttggaatacgcagaatatgtcggcaactactatggaactcctctgacctatgtcaatgaaaccttggacaagggaatcgatgttttccttgaaattgaagttcagggtgctcttcaggtcaagaaaaaggttccagatgctgtctttatcttcctgacaccaccagatttggatgaattgcaagatcgcttggtaggtcgtggaacagatagtgcagaagtgattgtccaacgaatcgaaaaggccaaggaagaaattgccctcatgcgtgagtatgattatgcgattgtcaacgatcaggtgcccctagctgctgaacgtgtcaaatgtgtgattgaagcagaacacttctgtgtggatcgtgtcattggtcactatcaggagatgttaccaaaatctccaactacccgataa

SEQ ID NO: 442 - DNA, 315 bp, Streptococcus pneumoniae
atgatgttaaaaccctctattgataccttgctcgacaaggttccttcaaaatattcactcgtaatcttggaagcaaaacgtgcccacgaattggaagcaggtgccccagcaactcaaggtttcaagtctgaaaaatcaactcttcgcgctttagaagaaatcgaatcaggaaacgttacaattcacccagatccagaaggaaaacgtgaagcagtgcgtcgccgtatcgaagaagaaaaacgccgcaaagaagaagaagaaaagaaaatcaaagagcaaattgctaaagaaaaagaagatggtgaaaaaatttaa

SEQ ID NO: 443 - DNA, 2397 bp, Streptococcus pneumoniae
atggccctagctaagattatcgtagatgtgcccttgatgcagacggaccagccctatagttacaggattccggaggaatttgagggaatgctggaagttgggatgcgggttcatgtgccttttggtaagggtaatcgcctgattcaagggattgttcttggtttgaagtcccaatcagatggagaagagatggagcaagatttaaaagatattgcagaggtgctggatttttctcctgttctcacgccagaacaactctggctggctgaggagttacgcaaatctgtcttctcctacaaaatctctatcctcaaggccatgcttccagggtttctgaattctagctatgacaagattctctatcctctggaaggcttgagtcaggaagaacgagtacgcctgtttggttcagaagattcgctagccttttcttcactagaccttgccaagcaagctgaaatgatgcgtttgactagaaaaggcctgcttggtctggaatatcaggcagtcgatcaaaagaaggtcaagacccagtcttggtatgaggttgaccatgcccaattagaaggtgttgagatttctacacgtgccaagaaaaagttggaactgagagattatctgctgtctcatccagagagcgcttccttggctagcttgttagagtcctactcgcgagagcaagtcaacttctttgtggatcaaggtgctgttaccatagtccaaaaggaagttcaacgctcggctgcttattttgaaggaattgaagcaagtagacctttggagttaaatccagaacaaagacaggcgcgtgatgcggttgtgagttctattggcagttctcaacctccctttctacttcaagggattacaggaagtgggaagaccgaggtttacttgcagattatccaaggtgccctggataagggcaagacagctattttgctggtacctgagatttccttgactcctcagatgaccgagcgttttatagcacgttttggggacaaggtagccattcttcactcaggattatccaatggcgaaaagtatgatgaatggcgcaaggtggagcgtggcgatgcccaagttgttgttggtgccagatctgctatctttgctcctctgaaaaatctgggtgtcatgattattgatgaagagcatgaagcggcttataagcaggacagcaatccccgttaccatgccagagaggtagctattttacgggctcagtataatcaagcaactctggtacttggatctgcaacgccgagcttagagagccgggcacgtgctggcaaaggcgtctatcaacacttacgtctaacccaacgtgccaatcctttggctacaatccctgaggttcaagtgattgactttcgagactatatcggacaaaatgagacgtcaaactttacgcctcctttgctagaggctatccaagaccgtctggttaaaaaagagcaggtggttctcatgctcaatcgccgtggttattctagctttgtcatgtgtcgggagtgtgggacggtggatacttgtcccaactgcgatatttctctgaccttgcatatggataccaagactatgaactgccattattgtggtttctcgaaggatattcctcaggtctgtcctaactgtaagagccacagtattcgttactatggaacgggaactcagaaggcttatgatgagctagcagaactctttccccaagctcgcattctgaggatggatgtggatacgactcgaaagaaaggcagtcaccaagccttgcttgaccagtttgggcgaggggaagcggatattttacttggtactcagatgattgcaaagggtttggattttcccaatgttaccctagtcggagttctaaatgcggatacggccttgaatctgcctgatttccgttcttctgagagaaccttccagctcttgactcaggtggcaggtcgatcaggtcgggctgaaaaggcaggtcaagtcttgatacagtcctacaatccgcagcactatgctattcgatttgccaaggatcaagattacgaaggcttttatgcctatgaaatgggaatcagacgacaactcggctatccaccttactatttcacgattggtattaccctttctcacaagaaagaagaagaggttttcaaacgtgcctatgaagtcatgaacattttgcggtcaggcttgtcagagaccagtcccattctggggccaacgccaaaaccgattgcccgtacccacaacctctatcattaccagattttaattaaataccgtttagaagatgagctggggccgaccctcaaccaggttttagccttgactcaagaacgggaaaatagtgagctccgtctcagcattgaccatgagccgcagcaatttttataa

SEQ ID NO: 444 - DNA, 936 bp, Streptococcus pneumoniae
atgacaaaactaatctttatggggacccccgacttttcagcaacagtcttaaaaggacttttgacagatgaccgttacgaaattctagccgttgtgacccagccagaccgtgctgttggtcgtaaaaaagttatccaagaaaccccagtcaagcaggctgccaaggaagcaggactatctatctaccaacctgaaaaattatctggaagtccagagatggaagaacttatgaagctaggagcagatggaattgtgactgctgcttttgggcagtttctcccaagcaaactccttgatagcatggactttgctgtcaacgttcatgcctccctccttcctagacaccgtggtggtgcgcctatccattatgccttgattcaaggggatgaggaagctggtgtgaccatcatggaaatggttaaggaaatggatgcaggagatatgatttttcgtcgcagcattccgatcacagatgaggacaatgttggcaccttgtttgaaaaattggcgctagttggtcgtgatttgcttttggacactctgcctgcctatattgctggtgatatcaaacctgaaccgcaggatacgagtcaggttaccttctctccaaatataaagccagaggaagaaaaactggactgggacaaaaccaatcgtcaactctttaaccaaattggtggaatgaaccctggccctgttgcccatactttccttaagggcgaccgctttaagatttatgaagccctaccagtagaagatcagggaaatccaggtgagattctctctatcggcaagaaagaattgattgtcgcaacggctgaaggggctctatccctcaaacaagtgcagccagctggtaagcctaagatggacattgcttccttcctcaacggagttggacgtacattgactgtaggagaacgatttggtgactaa

SEQ ID NO: 445 - DNA, 528 bp, Streptococcus pneumoniae
ttggtgactaaagtagaaacggctagaagtttagctctagcagtgctagaggatgtttttgtgaatcaagcatattcaaatattgccttaaataaacacctcaaggggagtcagctctctgcagcagacaagggcttagtgaccgagctagtctatggaacggtagcccgtaaactgactctggaatggtacttatcccactttatcgaagacagagaccagttagacagctggctctatgtccttcttctcatgagtgcctaccaactccgctatttggacaagattccagatcatgctgtggtcaatgaagcagtggaattggccaaactccgtaaaaaaggcagtgaaaaattggtcaacgctgtccttcgccgtatcttgcgtgaaggctggccagatattgctagcatcaagcgaaaaaacaagcgtgactccattgcctattctctcccagtttggctagttaccaaactcaaggaagaatacggagaggagagagcaaaagccatctttgaaagcctgtag

SEQ ID NO: 446 - DNA, 417 bp, Streptococcus pneumoniae
ttgaaagcctgtagtctgcgaaacaaagccagtattcgtgtaacagacctaagtcgaaaagaggaaatccaagccttgttggaggcgaatgattcccttttagcaaccactcgtctggttaaggagcaagggcattttgcagggcataatttgtttgcggatggagccattaccatccaagacgagtccagtcagctggttgctccgacgcttgatttacaaggtgatgagcgagtgcttgatcctgtgcggctccaggtggaaaacagcccatatagcctcttatcttacgacaggtcaggttactgctctggacttgtacgaccacaagttggatttaattcaagaaaatgcccaacgtctgggagttgcagatcgggttcaaactcaaaaattggatgccagaaaggtgcatga

SEQ ID NO: 447 - DNA, 699 bp, Streptococcus pneumoniae
caaccactcgtctggttaaggagcaagggcattttgcagggcataatttgtttgcggatggagccattaccatccaagacgagtccagtcagctggttgctccgacgcttgatttacaaggtgatgagcgagtgcttgatcctgtgcggctccaggtggaaaacagcccatatagcctcttatcttacgacaggtcaggttactgctctggacttgtacgaccacaagttggatttaattcaagaaaatgcccaacgtctgggagttgcagatcgggttcaaactcaaaaattggatgccagaaaggtgcatgagttttttgaccaggattcctttgataagattttggtggatgctccttgttcaggaatcggtcttttgcgccgaaaaccagatatcaaatacaataaagaaacggcagatttcgcgtccttgcaggaaattcagttagaaatattaggtagtgtttgtcaaatactaggcaaaggtggtataataacttatagcacctgcactatcgtctcagaggagaattttcaagtcgttaaggcctttttagagagtcatcccgagttcgagcaggtaaaactagaacatgaatgtaaggatatcatgaaagacggctgtatcctcattacacctgaattgtatggaagtgatggattcttcatcagtcaatttcgcaagatatcggattag

SEQ ID NO: 448 - DNA, 741 bp, Streptococcus pneumoniae
atggaaatttcattattaacagatgttggtcagaaacgaacaaataaccaagactatgtcaaccactatgtcaatagagctggacgtaccatgattattttagctgatgggatgggaggtcatcgtgcagggaatatcgctagtgaaatggcggtcacagacctgggtgtagcttgggttgatacccagatcgatacagtcaatgaagtgcgtgaatggttcgcccattacctagaaattgaaaatcaaaagattcaccagcttggtcaggatgaagcttacagaggcatgggaactactttggaagtccttgctattattgataatcaggctatctatgctcatattggtgattcgcgtatcggcttgattcgtggagaagaataccatcagttgacgagcgatcattccttggttaatgaattgctcaaggctggtcaattgacaccagaagaggcagaagctcatccgcaaaaaaatattatcacccagtctattgggcaaaaagatgaaattcagcctgattttgggacagttatccttgagtcaggtgactatctcttgctcaatagtgacggcttgaccaacatgatttcaggcagtgagattcgtgatattgtaaccagtgatattcctttagcagataaaacggagacacttgttcgttttgctaacaatgcaggaggtttagacaacattacggttgcccttgtttctatgaacgaggaggatgaagaatga

SEQ ID NO: 449 - DNA, 1980 bp, Streptococcus pneumoniae
atgatccaaatcggcaagatttttgccggacgctatcggattgtcaaacagattggtcgaggaggcatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggcgaggaagacggtcaacagtatcttgcaatggagtatgttgctggactagacctcaaacgctatatcaaggaacattatcctctttctaatgaagaagcagtccgtatcatgggacaaattctcttggctatgcgcttggcccatactcgaggaattgttcacagggacttgaaacctcaaaatatccttttgacaccagatgggacggccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcagacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatctggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactccttaa

SEQ ID NO: 450 - DNA, 204 bp, Streptococcus pneumoniae
atggaagaatcaaaagaattaaatgccgtcattgatgtgattatgctagcggggactattctccttaaaagtggctcagaaatccatcgtgtagaagataccatgattcgaatcgcgattcgcaggggattgtggattgcaatgtccttgccatgcctgccgctatctttttctctattgaaaataccaatatttcgcgcatga

SEQ ID NO: 451 - DNA, 222 bp, Streptococcus pneumoniae
aagtggctcagaaatccatcgtgtagaagataccatgattcgaatcgcgattcgcaggggattgtggattgcaatgtccttgccatgcctgccgctatctttttctctattgaaaataccaatatttcgcgcatgaagcgcgtgacctcctcttcttataacatcgaaaaaagtctgcgatgtgaaccagatttctcgtcagctagttggggggcagattga

SEQ ID NO: 452 - DNA, 510 bp, Streptococcus pneumoniae
gtgaaccagatttctcgtcagctagttggggggcagattgacttagaaacagcctttaagcaattgacggccttgcaagctcaaccccttccctatactaagttgcaggtaactctggctgcgacctttagtgctcctttcttttcagttatgtttagcggaaatatctacgacgcacttggggcaggagtggcgaccttatttggttttgccttttccctctatgtggaaaaatttatccgaattccctttgtgacagcctttgctggagcctttgtctttgggataattgcccagttttgggctcgctacacaggttttccttcaacggcagatttgattatagctggtgcggtcatgccgtttgtaccaggtattgccttgaccaatgcggtccgtgatattatgaccaaccacataaactctggtatgagtaagatgtttgaatccctgctcattaccctcgctttaggggcaggaacttctgtcgccttggtattgatgaactaa

SEQ ID NO: 453 - DNA, 336 bp, Streptococcus pneumoniae
atgactgtctggctaatctatctcttgctcaaggaaccgaccaatgtcattgtagctaccttcattgcagccattattggttcttgtgtcagccagattttaagtattctttataagacacctgctgtggtctttatcttggccattttggcaccgctggttccaggttatctctcctaccgaacaactgccttttttgtgacaggggactataataaagcactggcaagtgggctcttggttgtcatgttggctctggtaatctctattggaatggctagcggatcagtgattctcagactctatcattatataaaaacacatcgagtatcgtag

SEQ ID NO: 454 - DNA, 201 bp, Streptococcus pneumoniae
gtgcgagaatatcgaacttatgaagaaattgcggctgattttggtatccacgaaagcaacttactccgtcggagccaatgggttgaagtaactcttgttcaaagtggtgttacgatttcaaaaactcatcttagtgctgagaatacggtgattgtggatgcaacagaggtaaaaataaatcgtcctaaaaaaatcaactag

SEQ ID NO: 455 - DNA, 390 bp, Streptococcus pneumoniae
atggaacctcaagcgattgtcaccagccaagaaagaattgtttctttgaatattgcggtgaactattgccacgatatgaagttgttcaaaatgagtcgcagaaatatcggacaagctggtaaaatcttggctgacagtggttatcaagggcccatgaagatatatcctcaagcacaaactccacgtaaatccagcaacctcaagccgctaatagctgaagataaagcctataaccatgcgctatctaaggagagaagcaaagttgagaacatctttgccaaagtaaaaacgtttaaaatgttttcaacaacctatcgaaatcatcgtaaacgcttcggattacgaatgaatttgattgttggtattatcaatcatgaactaggattctag

SEQ ID NO: 456 - DNA, 288 bp, Streptococcus pneumoniae
ttgtctgtaagtctactgaccttgttgtttatcccagtcatggtttctagttcgggctcagagtttcaaagtggatggcaagagcatcaattgattgctgagaaggttagtaaaacacttgacaagacatttgataaggatgtcagagaaattccgaccagtcagttttatcaaaaatttgtagatgagatgggaaggacttactcaggaaatttgatcctccaggagctgataactgtgaatggagcttataaagctacttatatcggtgaactctctagcaactaa

SEQ ID NO: 457 - DNA, 1173 bp, Streptococcus pneumoniae
atgacaatcggtattgataagattggttttgcgaccagtcaatatgtcttgaaattacaagacttagcagaagcgaggggaattgaccctgaaaaattaagtaaaggactcttactcaaggaattgagtattgcgcccctaactgaggacatcgtgaccttggcggccagtgctagtgactctattttaactgagcaagaaagacaagaagttgacatggtcattgtggctaccgagtcaggaattgaccagagtaaggctgcggccgtctttgtgcatggcttgctgggcatccagccctttgctcgtagtttcgagattaaagaagcctgctatggggcgacagctgccctccattatgccaaattgcatgtggaaaattctccggagtccaaggtattggtcattgccagtgatattgccaaatatggtattgaaactccgggagaaccaactcaaggtgctggaagtgtagctatgttgattacacaaaatccacgcatgatggcctttaataatgacaatgtagctcagacccgtgacatcatggatttctggcgaccaaattactcgacaactcctcatgtaaatggtgtctattctacccaacaatacttggatagtttgaaaacgacttggcttgaatatcaaaaacgctaccagcttactttggatgattttgctgctgtttgtttccacttgccttatcctaaattagcgctaaaaggcttgaaaaaaatcatggataagagcctgcctcaagagaaaaaagacctcttacaaaagcattttgaccagtctattctctacagtcaaaaggtggggaatatctacacaggttcacttttccttggacttttgtctctcttggaaaatacagatagcttgaaagctggggataaaatcgccctttatagttacggaagtggagctgtggctgagttcttcagtggtgaattggttgaaggatatgaagcttatttggataaagaccgcttgaacaagctcaaccaacgaactgccctatccgttgcagactatgaaaaggtcttttttgaggaagtaaacttggatgaaacaaactctgcccagtttgctggctatgaaaatcaagattttgccttggttgaaattcttgaccaccaacgccgttatagcaaggttgaaaaataa

SEQ ID NO: 458 - DNA, 1275 bp, Streptococcus pneumoniae
atgaagataagttggaatggattttctaaaaaatcataccaagagcgcctcgagctgctaaaagctcaggcgctccttagtcctgagagacaagctagtctggagaaggatgaacagatgagtgtgactgtggcagaccagctgagtgagaatgtggtgggaactttttctctgccttattcgctggttccggaggtacttgtcaacggtcaggaatacaccgttccctatgtgacagaagaaccctctgtggttgcggcggccagctatgccagcaaaatcatcaagcgtgcaggtggttttactgcacaagtccatcagcgccagatgattgggcaggtagccctttatcaaattgctaatcctaaactagcgcaagagaagattgccagcaagaaagcggagctcttggagcttgccaatcaagcctatccttctatcgttaaacgtgggggtggggcgcgtgatctgcatgtcgagcagataaaaggcgaaccagactttctcgttgtttatattcatgtcgatacccaggaagccatgggtgccaatatgctcaacaccatgctggaagccttgaaaccagtcttagaagaactcagtcagggacagagtctcatgggaatcctgtccaactacgcgactgattctctggtgactgcaagctgtcgcatcgcctttcgctacttgagccgccaaaaggatcaaggacgagagattgcggagaaaattgcgttggctagtcagtttgcgcaggctgatccttaccgagctgctactcataataaaggaatttttaatggtattgatgcgattttgattgccactggtaatgactggcgtgccatcgaagctggggcccatgcctttgccagtcgagatggacgctatcaaggtcttagctgctggacgctggaccttgaaagagaagaattggtcggtgagatgaccctgcccatgcctgtagcgactaagggtggctctatcggcctcaacccacgtgtagctctcagtcatgatctactaggaaatccttctgccagagaattagcccagattatcgtgtccatcggtcttgctcaaaattttgcagccctcaaagccttggtaagtacgggcatccagcaaggccacatgaaactacaggccaaatccctagctctcctagctggggctagtgaatctgaagttgctcccctagtagagcgcctcatctcagataaaacctttaacctagagacagcccagcgctatctcgaaaatttaagatcataa

SEQ ID NO: 459 - DNA, 966 bp, Streptococcus pneumoniae
atggtcgcaaaactaactgatgtcgccaaacttgcaggcgtcagtcctactaccgtttctcgggttatcaataaaaaagggtatctatctgagaaaaccatccaaaaagtcaatgaagccatgcgagaattgggctataaacccaacaacctggctcgtagtctgcaaggaaaatcagctaagttaatcggcttgattttccccaatatttccaatgttttctatgcagaattgattgataaattggaacaccaactcttcaaaaatggttacaagaccatcatctgcaacagtgaacatgattctgagaaggaacgtgaatacatcgaaatgttggaagccaatcaggtggacggcatcatttctggtagtcacaacctaggaatcgaagactacaatcgtgtgacagcgccgattatttcctttgaccgaaacctatcgccagacatccctgtcgtctcctctgacaactatgctggtggggttcttgctgcccaaaccttggtcaagacaggtgcccagtctatcatcatgattacagggaatgacaattccaattcgccaaccggactgcgccacgctggttttgcatccgtactcccaaaagctcctattatcaatgtttccagtgacttttctcccgtcagaaaagaaatggaaatcaagaatatcttgacccgggaaaaaccagatgccatttttgcttcggatgatttgacagctattctggtcattaaaatcgctcaagaattgggcatttctgtcccaaaagagctcaaggtcatcggctatgatgggacctactttatcgaaaattactaccctcaattggctactatcaagcaacctttggaagagattgcttgtctcactattgatcttctcttgcaaaagattgaaggcaaggaagtcgccacaactggttacttcttaccagttacgctattaccaggaaaaagtatttaa

SEQ ID NO: 460 - DNA, 1455 bp, Streptococcus pneumoniae
atggaatggacaactgagcgtcgttacagactttatcaagattggacgcaagaagaaattcaacatataaaggaaaatatggcacaatctccatggcatactcattaccatgttgagccaaaaacaggacttctcaacgacccaaatggcttttcttacttcgatggcaagtggatcctcttttaccagaattttccttttggtgcagcccacggtttaaaatcttgggcacagctagaaagtgatgatttggttcactttagagaaactggagtcaaagttttgccagatactccattagatagtcacggtgcctactctggttctgccatgcaatttggcgataacttattcctattttatacaggaaatgttcgcgatgaaaactggatccgtcacccataccaaatcggtgctttgatggacaaggagggtaagattacaaagattgacaagatcttgattgaccagccagcagactctactgaccacttccgcgatccacaaatttttaactttcagggtcaatattatgccattgtcggcggacaagacttggagaaaaaaggtttcgttcgtctctacaaggctgtcaataacgactacacaaactggcaagcagttggcgaccttgactttgctaacgaccgtactgcctacatgatggaatgtcctaatctggtctttgtagaggaacagcctgtccttctctactgtccacaaggattggataagaaagttctagactacgataatatctttccaaatatgtataagattggggcttcctttgaccctaaaaatgccaaaatggtagatgtgtctcaacttcaaaacatggattacggtttcgaagcctatgcaactcaagccttcaacgctcctgatgggcgtgctctagcagttagctggcttggtttgccagatgtttcttacccatctgaccgttttgaccaccaaggaaccttctctttggtcaaggaactcactatcaaagacgacaagctctaccagtatccagtcgctgctattaaggaccttcgtgcttctgaagaagccttctcaaaccgtttccaaaccaagaacacttacgaacttgaactcaacttggaagctaatagccagagcgagattgtcttacttgctgataaagaaggtaagggactttcaatcaactttgaccttgtaaacggtcaagtgacagtggatcgtagccaggctggagaacagtatgcccaagaatttgggacaactcgttcttgccctatcgagaatcaggctactactgctacaatcttcatcgataactctgtctttgaaattttcatcaataaaggagaaaaagtattttctggtcgtgtcttcccacatgcggaccaaaatggtatcctgatcaaatctggaaacccaactggaacttactatgaattagattatggtcgcaaaactaactga

SEQ ID NO: 461 - DNA, 231 bp, Streptococcus pneumoniae
ttggctcaacatggtaatgagtatgccatggagattgtgccatattttcctttatatgttgaatttcttcttgcgtccaatcttgataaagtctgtaacgacgctcagttgtccattccattcattcctccaaaaatcttatcacttttaatagtaactgttttcgataaaaaatgcaagccttttatattaaaaaagagaaaaaactgtcaaacgattatcatgaaataa

SEQ ID NO: 462 - DNA, 198 bp, Streptococcus pneumoniae
atgcaagccttttatattaaaaaagagaaaaaactgtcaaacgattatcatgaaataaatacaggaaatcaatcaaatttttacgaaaatgtgaaagataatgaaataaaatactttttaaccaaggtttcaaacttatttttcaaggaattcctgatgaaacagtcaaaaacaatcaatctaaaacttgcccactaa

SEQ ID NO: 463 - DNA, 1884 bp, Streptococcus pneumoniae
atgaacaatcaggaaattgcaaaaaaagtcatcgatgccttgggcggacgtgaaaatgtcaatagtgttgcccactgtgcgactcgtctacgtgtcatggtcaaagatgaagagaaaatcaataaagaagtgattgagaacttggaaaaagttcaaggtgctttctttaactcagggcaataccaaattatctttggtacaggtacagttaacaaaatgtacgatgaagttgttgtacttggcttaccaacatcatctaaggatgacatgaaagcagaagttgctaaacaagggaactggttccaacgtgctatccgtactttcggtgatgttttcgttccaatcatcccagttatcgtagcgacaggtctcttcatgggtgtgcgtggtcttttcaacgctcttgaaatgccacttccaggtgactttgcaacttacacacaaatcttgacagatacagccttcatcatcttgccaggtttggttgtgtggtcaaccttccgtgtatttggtggaaatcctgccgttggtatcgttcttggtatgatgcttgtctctggctcacttccaaacgcttgggcagttgctcaaggtggtgaagtaacagcgatgaacttctttggtttcatccctgttgttggtttgcaaggttccgttcttccagccttcatcatcggggttgtcggagctaaatttgaaaaagctgtccgcaaggttgttccagatgtcattgacctcttggtaacaccattcgtgacacttttggtcatgtctatccttggactctttgtcattggaccagttttccacgttgttgaaaactacatccttattgctacaaaagcgattcttagcattccatttggtcttggtggtttcttgattggtggggttcaccaattgatcgtcgtgtcaggtgtgcaccacatcttcaacttgcttgaagtgcaattacttgctgctgaccatgctaacccattcaacgctatcatcacagctgctatgacagctcaaggtgctgctactgttgcggttggtgttaaaacaaaaaatccaaaactgaaaacacttgctttcccggctgctctttctgccttcctaggtattacagagcctgctatcttcggggtgaacttgcgcttccgtaaaccattcttcctttcattgattgctggtgcaatcggtggtggattggcttctatccttggacttgctggtactggtaatggtatcaccatcatccctggtacaatgctttatgttggtaacggacaacttccacaataccttcttatggtagctgtatcatttgcccttggttttgctcttacttacatgtttggttacgaagatgaagtagacgcaactgcagctgcaaaacaagctgaagtggctgaagaaaaagaagaagttgcgccagcagctcttcaaaatgaaacacttgtaactcctatcgtcggtgatgttgtcgctcttgctgatgtcaatgacccagtcttctcaagtggagctatgggacaaggtatcgctgtgaaaccaagccaaggcgtggtctatgcaccagctgatgctgaagtttcaattgcctttccaacagggcacgcttttggtttgaaaacaagaaatggtgctgaagttttgattcacgttggtattgacactgtatctatgaacggtgacggttttgaagcaaaagttgctcaaggtaataaggtgaaagctggcgatgttcttggaacatttgactcaaacaaaatcgctgcagctggacttgatgatacaacaatggttatcgttacaaatacagctgactacgcttcagtagctccagtcgcaacaggttcagttgcgaagggggatgctgtgatcgaagtgaaaatctaa

SEQ ID NO: 464 - DNA, 888 bp, Streptococcus pneumoniae
atgacaaaattatatggaagcttggaagcgggcggtacaaagtttgtctgtgctgtcggtgatgaaaactttaacgttgtagaaaaaacacaatttccaacaacaactccaatcgaaacaatcgataaaaccattgagttcttctcaaaattcgataacctttctggtcttgcagttggttcatttgggccgattgatattgacaaaaactcaaaaacttatggctttatcacgacgactccaaaaccaaactgggcaaatgtggacttgcttggtgcctttcgtcgcgccctaaacgtgccaatgtacttcacaacagacgtaaacagctctgcttacggtgaaatggttgcccgtaacaatgctggtggtcgtatcgaaaacttggtttactacacaatcggtacaggtatcggtgcaggcgtcatccaacgtggtgagtttatcggtggtgtgggtcaccctgaaatgggtcattattatgttgctagacacccaatggatattgaaaaagagtttaagggtgtttgtcctttccataagggatgtctagaaggttatgcagctggtccaagtttggaagctcgtacaggtgtacgtggggaaaatattgaactcaacaaccctgtttgggatgttcaagcctactatatcgctcaagctgcggttaatgcgacagtgactttccgcccagacgtgattgtctttggtggaggggtcatggctcaacaacatatgctggaccgtgtccgtgagaaatttacatctcttcttaatggttacctaccagtaccagatgtgcgtgactatatcgtgacgccagcagtcgcaggaaatggttctgccacacttgggaactttgttcttgcaaaagaagtttcaaaataa

SEQ ID NO: 465 - DNA, 213 bp, Streptococcus pneumoniae
gtgtcaaagcatttgccagaaaaagtcaataatataggtcagaccgtaggtataaaccacgagggtaaagggtttggtcagaatgatgatggtcatgtagcgcttgaaactcatcttggtcagggcagccagcatacagagaaagtcagctgggctaatgggccaaatcatcataaaaataaagaagcggtcaaaacgattgcccttatctag

SEQ ID NO: 466 - DNA, 600 bp, Streptococcus pneumoniae
atgaaagctgtttctccccttctgcagcgagttatcaatatctcatcgattgtcggtggggttgggagtttgattttctgtatttgggcttatcaggctgggattttacaatccaaggaaaccctctctgcctttatccagcaggcaggcatctggggtccacctctctttatctttttacagattttacagactgtcgtccctatcattccaggggccttgacctcggtggctggggtctttatctacgggcacatcatcgggactatctacaactatatcggcatcgtgattggctgtgccattatcttttatctagtgcgcctatacggagctgcctttgtccagtctgtcgtcagcaagcgcacctacgacaagtacatcggctggctagataagggcaatcgttttgaccgcttctttatttttatgatgatttggcccattagcccagctgactttctctgtatgctggctgccctgaccaagatgagtttcaagcgctacatgaccatcatcattctgaccaaaccctttaccctcgtggtttatacctacggtctgacctatattattgactttttctggcaaatgctttga

SEQ ID NO: 467 - DNA, 225 bp, Streptococcus pneumoniae
tttcaatctattatatctattatgcacaccactataggatctaataaaaatcacaacaagttcattcatagatggttacctcagggaactaagaaaacgactacaaaggaagtcgcattcatcgaaaagtggattaacaactatcctaaaaaatgcttgaactacaagtcccccagagaagacttctggatgactaacttgaacttgaaatttagcaataattaa

SEQ ID NO: 468 - DNA, 252 bp, Streptococcus pneumoniae
ttgtccatttttagaagactattgctgtgtaaaatatggcctggagcacttttatactcaatgaaaatcaaagagcaaactaggaagctagccgtagactgctcaaagtacagctttgaggttgcagataaaactgacgaagtcagctcaaaacactgttttgaggttgtagatagaactgacgaagtcagtaactatatctacggcaaggcgaagctgacgtggtttgaagagattttcgaagagtattag

SEQ ID NO: 469 - DNA, 228 bp, Streptococcus pneumoniae
ttactgacttcgtcagttctatctacaacctcaaaacagtgttttgagctgacttcgtcagttttatctgcaacctcaaagctgtactttgagcagtctacggctagcttcctagtttgctctttgattttcattgagtataaaagtgctccaggccatattttacacagcaatagtcttctaaaaatggacaaaaaacattgtaaaggctatcaaaaaggagtataa

SEQ ID NO: 470 - DNA, 894 bp, Streptococcus pneumoniae
atgctagaagtaagaagtctagagaaaagttttggatccaagcaagttttgtttggtattgactttcaagcgcgaccaggtcgtattttgggactagtcggaaaaaatggtgctggaaaaacaacgattttccatagtattttaaaattcctagaatatcagggagaaatcggtctggatggtcaggatattcgtcaggagacctatgctcggattggttatctgcctgaagaacgcagtctcatgcctaaattgacagttcttgaacaagttcgctacttggcgactctaaaaggcatggatgccaaagaagtcaaagaaaaactccctcaatggatgaagaggttggaagtaaaaggaaagctgacagataaaatcaagagtctgtcaaaaggaaatcagcagaagattcagctcattattactctgattcatgaaccagacctgattatcttggatgagccttttagtggattggacccagttaatacagaattgctcaaacaagtcatttttcaggaaaaagagcgcggagcaaccattatcttttctgaccatgtcatgaccaatgttgaggaactttgtgacgatattctgatgatccgagatggccgtgtggtcttgcacggaccagttcaggatgtccgcaatcaatacgggaaaacgcgtctctttgtttcaagtgaacgaagcaaggaagaattggaaaatcttcctcatgtcaaacaggtgagcttgaccaaacaaggtagttggaaattgattttggaggatgagagcgctggaagggaactcttcccaatcttgactcaaggtcaatatatcgcaacatttgaccaacaagcgccaactatcgatgaaatctttaaactagaatcaggagtggaagtatga

SEQ ID NO: 471 - DNA, 1200 bp, Streptococcus pneumoniae
atgagaaatatgtgggttgtaatcaaggaaacctatcttcgacatgtcaagtcatggagtttcttctttatggtgatttcgccgttcctctttttaggaatctctgtaggaattgggcatatccaaggttcttctatggctaaaaataataaagtggcagtagtgacaacagtgccatctgtagcagaaggactgaagaatgtaaatggtgttaacttcgactataaagacgaagcaagtgccaaagaagcaattaaagaagaaaaattaaaaggttatttgaccattgatcaagaagatagtgttctaaaggcagtttatcatggcgaaacatcgcttgaaaatggaattaaatttgaggttacaggtacactcaatgaactgcaaaatcagcttaatcgttcaactgcttccttgtctcaagagcaggaaaaacgcttagcgcagacaattcaattcacagaaaagattgatgaagccaaggaaaataaaaagtttattcaaacaattgcagcaggtgccttaggattctttctttatatgattctgattacctatgcgggtgtaacagctcaggaagttgccagtgaaaaaggcaccaaaattatggaagtcgttttttctagcataagggcaagtcactatttctatgcgcggatgatggctctgtttctagtgattttaacgcatattgggatctatgttgtaggtggtctggctgccgttttgctctttaaagatttgccattcttggctcagtctggtattttggttcacttgggagatgctatctcactgaataccctgctctttattttgatcagtcttttcatgtacgtagtcttggcagccttcctaggatctatggcttctcgtcctgaggactcagggaaagcattgtcgcctttgatgattttgattatgggtggtttttttggagtgacagctctaggtgcagctggtgacaatctcctcttgaagattggttcttatattccctttatttcgaccttctttatgccgtttcgaacgattaatgactatgcggggggagcagaagcatggatttcacttgctattacagtgatttttgcggtggtagcaacaggatttatcggacgcatgtatgctagtctcgttcttcaaacggatgatttagggatttggaaaacctttaaacgtgccttatcttataaatag

SEQ ID NO: 472 - DNA, 168 bp, Streptococcus pneumoniae
ttgttctatgagtatgttacatatctaggtaaaaattatttaaagcaaattaaccttatttctcaagatgtagtaggttccgagataaaagatagctatgaatatgagttctttaacaatggctatacctgctcccatatagaaatggtcattgagtcctaccagtga

SEQ ID NO: 473 - DNA, 849 bp, Streptococcus pneumoniae
atgatattcgctacgagtcaggtgaatccattgaccaactcttccgtcaggaatttaaggcctaagcaaaggagattatttatgttttggaatttagttcactacgaatttaaaaatgttaacaagtggtatttagccctctacgcagccgtgctagtcctttctgccctcatcggaatacagacacaaggctttaaaaatctaccttaccaagaaagtcaggctactatgctactttttctagctacagtctttggtggcttgatgcttacacttgcgatttcaaccattttcttgattattaaacgcttcaaaggtagtgtctacgaccgacaaggctatctgactttgaccttgccagtttctgaacaccatatcatcacagccaaactaatcggtgcctttatctggtcattgattagcaccgctgtattggctctaagtgctgttattattctggctttaacagctccagaatggattcctctttcttatgtgattacatttgtagaaacacatctccctcagatctttcttacaggtatatccttcctactaaataccatttcaggaatcctctgcatctacctggctatttccattggacagcttttcaatgaataccgtacagcactcgctgttgcagcctacattggtatccaaatcgtcattggatttattgaacttttcttcaatcttagttctaatttctatgtcaattcactggtaggactcaatgaccatttctatatgggagcaggtatagccattgttaaagaactcatattcatagctatcttttatctcggaacctactacatcttgagaaataaggttaatttgctttaa

SEQ ID NO: 474 - DNA, 723 bp, Streptococcus pneumoniae
gtgattatattaaaggagtttaagcctatgtcattactagcatttgaaaatgtatccaaatcatatggagcaacaccagcccttgaaaatgtttctcttgacattccagctggaaaaattgtcggccttcttgggccaaacggctcaggaaaaacaaccctgattaaactaattaatggcctcttacaaccagatcaaggacgtgtcctcatcaacgacatggacccaagcccagcaaccaaggccgttgtagcttatttgcctgatacgacctatctcaatgagcaaatgaaggtcaaagaagccctaacctacttcaagaccttctataaagatttcaatcttgaacgcgcccatcatctacttgcagacctgggcattgatgaaaatagtcgtctcaagaaactatcaaaaggaaacaaagaaaaggttcaactgattttggttatgagccgtgatgctcgtctctatgttttggatgaacccattggtggggtggatccagcagcccgtgcttatatcctcaataccattatcaacaactactcaccaacttctaccgttttgatttctacccacttgatttctgatatcgagccaatcttggatgaaattgtcttcctaaaagacggaaaagtcgtccgtcaaggaaatgtagatgatattcgctacgagtcaggtgaatccattgaccaactcttccgtcaggaatttaaggcctaa

SEQ ID NO: 475 - DNA, 210 bp, Streptococcus pneumoniae
tctggttgtaagaggccattaattagtttaatcagggttgtttttcctgagccgtttggcccaagaaggccgacaatttttccagctggaatgtcaagagaaacattttcaagggctggtgttgctccatatgatttggatacattttcaaatgctagtaatgacataggcttaaactcctttaatataatcactgactacgcctggtag

SEQ ID NO: 476 - DNA, 366 bp, Streptococcus pneumoniae
atgtcctggacatttgacaacaaaaaacccatctatttacagattatggagaaaatcaagcttcagattgtttcccatacactggaacccaatcaacaacttccaaccgtgagggagctagctagcgaggctggtgtcaatcccaataccatccaaagagccttatcagaccttgaacgagaaggatttgtctacagcaagcgaacaactggacgatttgtgactaaggataaggagctaatcgctcagtcacgcaaacaattatcagaagaagaattggaacacttcgtttcctccatgacccattttggctatgaaaaagaagaactaccaggcgtagtcagtgattatattaaaggagtttaa

SEQ ID NO: 477 - DNA, 474 bp, Streptococcus pneumoniae
atgcgttgtccaaaatgtggggctaccaagtcaagtgttatcgatagtcgccaagcagaagaagggaacaccattcgtagaagacgagagtgcgacgagtgccaacaccgttttacaacctacgaacgagtagaagaaagaaccttagtggttgttaaaaaagatggcacacgggaacaattctccagagataaaatctttaatgggattatccgctcagcccagaaacgtcctgtgtcaagtgatgaaatcaacatggtagtcaatcgtatcgaacagaaactccgtggtcgaaatgaaaatgaaattcaaagtgaggacattggttcactcgtcatggaggagttggctgaattggacgagattacctatgtacgttttgctagtgtctatcgtagttttaaggatgtcagtgagttagagagcttgctccaacaaatcacccagtcctctaaaaagaaaaaggaaagataa

SEQ ID NO: 478 - DNA, 1170 bp, Streptococcus pneumoniae
atgaagccaattgaccgtttttcttatctaaagaataatcgggtgtcgcaagatacctcatctctggtacagtgctacctcccgattatcggtcaggaggcactgagcctttatctttatacgattagtttttgggataatggtagaaaggaatatcttttttcaagtatcctcaatcatctcaactttgggatggatagactgataaaatcattgaaaatcttatctgcttttaatctcttgactctctatcaaaagggggatgtttatcagctagccctccatgctcctctatctagtcaagacttcttggggcatcctgtttatcgcagactcttagagaaaaagattggcgatgtagctgtggaggatttgaaagttgaaagtgctgatggtgaagaaatacctgtctcactcaatcaagtctttccagaattggcagaactaggcagtcaagaataccttggtctcaagaagaaagtggccaacgattttgacttggaccattttcgtcagcttatggctcgagatggacttcgctttgcggatgagcagtccgatgtcttaaacctctttgccattgccgaggagaagaaatggacttggtttgaaacctatcaattggccaagtcaacagctgtttctcaggttatttcaaccaaacgcatgcgtgaaaaaattgctcaaaaaccagtttcctctgactttagtcttaaggaagcgatcattatcaaagaagccaaaagtaaaactgccctgcagttcttggcagaaatcaagcaaacacgcaagggaaccattacccaaacagaaagagaactcttgcaacagatggctggcttgggtttgctggacgaagtcatcaatatcattcttttattgacctttaataaggtcgattcggcaaatatcaatgagaaatatgccatgaaggtagccaatgactatgcctatcaaaagattcattcggcagaagaggcagtcttgcgcatccgtgagcgaggacagaaagcaaaaacacaaaaacagaatcagactgccccagcaaaaaccaatattcctaaatggagtaatcctgaatataaaaatacgtcatccgctgaggaattagaagagatggaacgccaaaccctagaattattagcaaaattagataacggaggtgattag

SEQ ID NO: 479 - DNA, 897 bp, Streptococcus pneumoniae
atggaaagtgtcggagatgtactcaaacgtcaaccaagtcgttttcactatcaagatttagttcagaaaatcatgaaggatcctgatgttgcggcctttgtccagcaagaatccctcaatcaggacgagttgaaccgtagtatttccaagtttaaccaatacatcactgagagagataaattcctccgaggagatacagattatattgccaaaggctacaagcctatattagtcatgaaccatggctatgcggatgtttcttatgaagaaactcctgaactaatcgcagctgaaaaagaagcggctatcaagaaacgtctcaacttaattaattttccatctagcctgaaaaatgtcagttttttagatgtttatcgtgatgatgttcagcgcttaactgttctaaaaagaatgatagaatttgttaacgattaccccaataatttgaaaggtctttacttgtatggagactttggtgtgggtaaaagtttcatggtggctgccctagctcatgatttatcagaaaaacgtggtgtatcatccactctcctccactatcctagctttgtcattgatgtcaaaaatgctatcagtgatggcaatgttaagaccttagtggatgagattaagctttctgaagtcctgattttagatgatattggtgccgagcaatccaccacttgggtgcgtgatgaaatcctgcaggtcattctccaatatcggatgcaggaaaatttaccgacctttttcacctctaacttcaactttgaagatttggagaagcatttcgctaaagggaaaaatggaaatgacgaaacctgggaagccagacgcgtcatggaacgcatccgttatttggctgaggagactcgtttagaaggagtaaaccgtcgatga

SEQ ID NO: 480 - DNA, 714 bp, Streptococcus pneumoniae
atgacagaaaccattaaattgatgaaggctcatacttcagtgcgcagatttaaggagcaagtccttcctcaggaagatttgactgaaatcctgacagcagcccagatggcatcatcttggaagaatttccaatcctactctgtgattgtggtacgaagccaagagaagaaagatgccttgtatgaattggtacctcaagaagccattcgccagtctgctgttttccttctctttgtcggagatttgaaccgagcagaaaagggagcccgacttcataccgacaccttccaaccccaaggtgtggaaggtctcttgattagttcggtcgatgcagctcttgctggacaaaatgccttgttggcagctgaaagcttgggctatggtggtgtgattatcggtttggttcgatacaagtctgaagaagtggcagagctctttaacctacctgactacacctattctgtctttgggatggcactgggtgtgccaaatcaaactcatgatgtgaaaccgagactgccactagataatgtagtctttgaggaagaataccaagaacagtcaactgaggcaatccaagcttatgaccgtgtgcaggctgactatgctggagcgcgtgcgaccacaagctggagtcagcgtctagcagaacagtttggccaagcagaaccaagctcaactagaaaaaatcttaaacagaagaagttattgtag

SEQ ID NO: 481 - DNA, 1311 bp, Streptococcus pneumoniae
atggccctaccaactattgccattgtaggacgtcccaatgttgggaaatcaaccctatttaatcggatcgctggtgagcgaatctccattgtagaagatgtcgaaggagtgacacgtgaccgtatctatgcaacgggtgagtggctcaatcgctcttttagtatgattgatacaggaggaatcgacgatgtagatgctcctttcatggaacaaatcaagcaccaggcagaaattgccatggaagaagcagatgttatcgtttttgtcgtgtctggtaaggaaggaattactgatgcagacgaatacgtagctcgtaagctttataagacccacaaaccagttatcctcgcagtcaacaaggtggacaaccctgagatgagaaatgatatctatgatttctatgctctcggtttgggtgaaccactgcctatctcatctgtccatggaatcggtacaggggatgtactagatgctatcgtagaaaatcttccaaatgaatatgaggaagaaaatccagatgtcattaagtttagcctgattggtcgtccaaacgttggaaaatcaagcttgatcaatgctatcttgggcgaagaccgtgttattgccagtcctgttgctggaacaactcgtgacgctattgatacccactttacagatacagatggtcaagagtttaccatgattgatacggctggtatgcgtaagtctggtaaggtttatgaaaatactgagaagtactctgtcatgcgtgccatgcgtgctattgaccgttcagatgtggtcttaatggtcatcaatgcggaagaggggattcgtgaatacgacaagcgtatcgctggatttgctcatgaagctggtaaagggatgattatcgtggtcaacaagtgggatacgcttgaaaaagataaccacactatgaaaaactgggaagaagatatccgtgagcagttccaatacctgccttacgcaccgattatctttgtatcagctttaaccaagcaacgtctccacaaacttcctgggatgattaagcaaatcagcgaaagtcaaaatacacgtattccatcagctgtcttgaacgatgtcatcatggatgccattgccatcaacccaacaccgacagacaaaggaaaacgtctcaagattttctatgcgacccaagtggcaaccaaaccaccaacctttgttatctttgtcaacgaagaagaactcatgcacttttcttacctacgtttcttggaaaatcaaatccgcaaggcctttgtctttgagggaacaccgattcatctcatcgcaagaaagcgtaaataa

SEQ ID NO: 482 - DNA, 345 bp, Streptococcus pneumoniae
atgtcggtgatggaacatttgtttaaattcttacttttagcaccgtacttttattttgataactggattgaaaaggccaacagaaatagtaagttttttccaattttttattatttttactggatttacatccccttctattctctttttagccttgcttggacagttgtttcagttctgtttttcaataccgtcttgagaaatgtgacagatatcaagttatggggcatttggtttctttttattctgctagctattggtatgaattggttaacttattcctgtttcaaagaaatgtttcgcttgagacaggaactagggaagtctaagggtggaaggcattga

SEQ ID NO: 483 - DNA, 354 bp, Streptococcus pneumoniae
gtgatggaacacttgtttaaaatgataatcttattaccctgtttttactttttcagctggattgacaaggataatagagaaagtaaatttttcccaattttttactatttttactggatttacatcaccctctatgctctttttagccttgcttggacagttttttcagttctgtttttcaatatcgtcttgagaaatttgacagatatcaagttatggggtatttggctattattactacttatcgcttttgctagtgactggttagactatatctgtttcaaaaaaatgcttgacttgagacgggaactagggaagtctaaaggtgtgcataaaggaaggtgtaggaactaa

SEQ ID NO: 484 - DNA, 192 bp, Streptococcus pneumoniae
ttgattcgttcacattctattacaatctactataataaaatgatgagagttattacaaattataggtttgaaaaatcattaatttctttttcgagtattttaactaatgcctcttctttggttagtcgtaataaagttattcctttatcaatcaaatcggagttatgttgtagtattcccaagcgtacttga

SEQ ID NO: 485 - DNA, 852 bp, Streptococcus pneumoniae
atgagatgggattatggacagatttttaaagaaattcgaaagtcaaaaggattgacccaacaagatgtatgtggacaagtcatacatcggacaactctaacaaatattgaacacggtaaagttattcccagttttgaaaacatggtatttcttcttgaacaaattgatatgagcttggcagaattcaagtatatatgcaacgaataccatcctagtaaaaggcgagatattattgtagagagccaaaatccgtctacttttcaagatactagaaaaatggttgaactcactgagaaatgtcaaaaatatcttaagacacatcacgatgttcctattcaaaatatctatcgtcatacaaaaattgtcacagagttacgaactaaaggattcaaaaacaaccacgtcttgaaagatttgtctgaagaaatttgggactatcttgaacctatggatacatggtacattagtgatttgaaattgcttggaaccattctctttttctttccttctgaaaatcttccccttcttattgatagaattatgaaaaccatcgagaaatataaatacttccgagaaacaaaagtatttttatcatcttttttagccaatctctccactgtatattttcaacatcatttattcaaagaatgtgaaacaatcaccctacaacttttggtattagcagaagaattaaaaatatacgatattcttggattctctcaagtacgcttgggaatactacaacataactccgatttgattgataaaggaataactttattacgactaaccaaagaagaggcattagttaaaatactcgaaaaagaaattaatgatttttcaaacctataa

SEQ ID NO: 486 - DNA, 393 bp, Streptococcus pneumoniae
atgaaaactaagaaattattgaaaatggttattcctgttttaatgataagtgctgttggaactactttcgtagaagcaaatcagataggtgcttttagtaattttgttattactaccagttataagagaacaggttatttgactaaagaaaatgaaggtgcggaatatatcatgaacttaaatccttgtagaaatttacatcccatgactgttaagcatcgtatagtaaattctaatggagaagctcgtagtggagaatcgttaacaacctgtggtactcgttcaactcatggtaattgggcaacggttggctatgtttatgcagcagatatggcaagacaaaattggtgggatttatcagctgccatttcaggtagttggtcaccaaattaa

SEQ ID NO: 487 - DNA, 792 bp, Streptococcus pneumoniae
atgaagattcctctcttaacttttgcaaggcataaatttgtttatgtcttgcttactttgctttttcttgctttggtttatcgtgatgttttgatgacttatttcttttttgatattcatgcgcccgatctagctaaattcgatggacaagcaattaaaaatgacttattaaaatcagcattagattttcgtattctccagttcaatctaggtttttatcaatcatttattattccaatcatcattgttttgctaggttttcaatatattgagctgaaaaataaagttttacgattgagtattggaagagaagtgagctatcaagggttaaaaagaaagttgactttgcaagttgcaagtatcccttgtttgatatatttagtgactgtgctgataattgcaattataacctatttccttgggactttttctcctcttggatggaattctctattttctgatggaagtggtttacaaagactcctagatggagagataaaaagctatttgttctttacttgtgtcctactaatcggtattttcatcaatgcaatctattttttacaaatagttgattatgtggggaatgtgactcgttcggcaatcacctatttgatgtttctttggcttggttctatgctgctctatagtgccttgccttactatatggttcctatgacgagtttgatgcaagctagctatggggatgtaagtttgatgaaactctttactccttatatcctttatattgtcccttatatggtgcttgaaaaatatgaagataatgtttaa

SEQ ID NO: 488 - DNA, 678 bp, Streptococcus pneumoniae
ttgtcccttatatggtgcttgaaaaatatgaagataatgtttaagaattttaacaatattttgctaaagagaaagattgttttactacttcgtatagttctgatgatgattttgataaactatctattgtcaacagcggttcaaaagcaggatgctgttatctttttcaagagagaattgatttcaattttttcctataatgactattctgaagcgaatttagaaatccccaaactcttgttaaacctttcgcttttcatggtaggatggctctctgtcattttacttgaaagtgatttggcagaccattaccatcacttgattcgctatcaatcaagctcctttttcgattatacaaggaaacgattggttgtcatttctaaattttttactcaagatttacttgtctggttccttggtttacttccgctaggaattcatttcaaaacagtcgcacttttctttttacttgctcagttaatgatgttgtacttactactgtcttatctgatagcactgattagtgcgggcgctggtttttccttttttctctattttttagcatttgtgggacaagaatggatgatggatcatattgtaacagtgtatttactactcttaagcttattagttatgttgattgttagtcgcttggaagagaaatttaagaaaggataa

SEQ ID NO: 489 - DNA, 633 bp, Streptococcus pneumoniae
atgaaacttgaaattataaatggacagaaaatttatgggaaaagacctattttaaatcagttgaatttggtgtttcaatcaggaaaaatttatggacttaaaggtgataatggatctggcaagacggttcttttaaaggtacttgctggttatattaagcttgacaaaggaaaagttcttcaagatggtaaagtttacgggataaaaaatcattatattcaggatgcaggaattttaattgaaaaagtcgagtttttatctcatttatccctgagagaaaatttggaactgttaaggtatttttcatctaaagttacggaaaaaagaattgcctattggattcaatactatgatttacaggaatttgaagacgttgaataccggcatttatccttgggaacaaagcaaaaaatggccttgattcaagcctttatttcctctccttctatactctttctcgatgaacctatgaatgctttggatgagaagagtgtgaggttaaccaaacaggtcattttatcttacctgaaaaaagaaaatggtctggttatcctgacgtcgcacatatcggaagatatttcagacctttgtacagatgtattagttgtcgaaaatggacatatacaaatgtaa

SEQ ID NO: 490 - DNA, 288 bp, Streptococcus pneumoniae
atggcacatctaaaatcatttattacacgctattccaaggtttatattggtttagttctgctgatctggctgtctttcttctttatcccttgggataaaccacttctggggataaggattgacatcttcatcatacagaaaatcttgctagcttttggaattctgtccattctcatggccttgctgtccaagaaagtcagtctctttgtttttgaactgatttgctgtctttctctttggattaacttatttatcacatttgccattttgccgatttttggcaattaa

SEQ ID NO: 491 - DNA, 2514 bp, Streptococcus pneumoniae
atggctaatattttaaaaacaattatcgaaaatgataaaggagaaatccgtcgtctggaaaagatggctgacaaggttttcaaatacgaagaccaaatggctgctttgactgacgaccaactaaaagcaaaaacagttgaatttaaggaacgttatcaaaatggagaatcactggattcattgctttacgaagcatttgcggttgtccgtgaaggtgccaaacgtgtcctaggtctcttcccttataaggttcaggtcatgggggggattgttcttcaccatggtgacgtgccagagatgcgtacaggggaagggaaaaccttgactgcgaccatgccggtatacctcaatgccctttcaggtaaaggggttcacgtagttacggttaatgaatacctgtcagaacgtgacgcgactgagatgggtgaattgtactcttggcttggtttgtcagtagggattaacttggctaccaaatctccaatggagaaaaaagaagcctatgagtgtgatattacttactcaactaactcagaaatcggatttgactaccttcgtgacaacatggtcgttcgcgctgaaaacatggtacaacgtccgcttaactatgccttggtcgatgaggttgactctatcttgattgacgaggctcgtacacctttgattgtatcaggtgccaatgcggttgaaaccagtcagttgtatcacatggcagaccactatgtaaaatctttgaacaaagatgactacatcatcgatgtgcagtctaagactattggtttgtctgattcagggattgacagggctgaaagctacttcaaacttgaaaacctctatgacatcgaaaacgtggctttgacccactttatcgataacgcccttcgtgccaactacatcatgcttctcgatattgactatgtggtgagcgaagagcaagaaatcttgattgtcgaccaatttacaggtcgtaccatggaaggtcgtcgttattctgatggattgcaccaagctattgaagccaaagaaggtgtgccaatccaggatgaaaccaagacatctgcctcaatcacgtaccaaaaccttttccgtatgtacaaaaaattgtctggtatgacgggtacaggtaagactgaggaagaagaatttcgtgaaatctacaacattcgtgttattccaatcccaacaaaccgtcctgttcaacgtattgaccactcagaccttctttatgcaagtatcgaatctaagtttaaagcggttgtcgaagacgttaaggctcgttaccaaaagggtcaacctgtcttggttggtacagtagcggttgaaactagtgactacatttctaagaaattggttgcagctggtgttcctcacgaagtcttgaatgccaaaaaccactatagagaagcccaaatcatcatgaatgctggtcaacgtggtgccgttaccatcgcaaccaacatggcgggtcgtggtaccgacatcaagcttggtgaaggtgttcgtgaacttggaggactttgtgttattggtacagaacgtcatgaaagtcgtcgtatcgataaccagcttcgtggacgttcaggtcgtcaaggagatccaggtgagtcacaattctacctatctcttgaagatgatttgatgaaacgttttggttctgaacgcttgaagggaatctttgaacgtctcaacatgtctgaagaggcgattgagtctcgcatgttgacgcgtcaggttgaagcagcgcaaaaacgtgtcgaaggaaataactacgatacccgtaaacaagtccttcaatacgacgatgtcatgcgtgaacaacgtgagattatctatactcaacgttatgatgtcattactgcagaccgtgacttggcacctgaaattcaggcaatgatcaaacgcacgattggtcgtgtcgttgacggtcatgcgcgtgctaaacaagatgagaaactagaggcaattttgaacttcgctaagtacaacttgcttcctgaagattctattacgatggaagacttgtcaggcttgtctgataaggccatcaaggaagagcttttccaacgtgccttgaaggtttacgatagtcaggtttcaaaactacgcgatgaagaagcagttaaagaattccaaaaagttttgattctacgagtggtggataacaagtggacagatcatatcgatgcccttgatcaattgcgtaacgcggttggacttcgtggctatgctcagaacaaccctgttgttgagtatcaggcagaaggtttccgtatgtttaatgatatgattggttcgattgagtttgatgtgacacgcttgatgatgaaagcacaaattcatgaacaagaaagaccacaggcagaacgtcatatcagtacaacagcgactcgcaatatcgctgctcaccaagcaagtatgccagaagatttggatttgagccagattggacgcaatgaactttgcccatgtggttctggtaagaaatttaaaaactgtcacggtaaaagacaataa

SEQ ID NO: 492 - DNA, 1032 bp, Streptococcus pneumoniae
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaatgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 493 - DNA, 645 bp, Streptococcus pneumoniae
atggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatccgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaacttcctttatcatgggcaggaagttggaacatcagtaa

SEQ ID NO: 494 - DNA, 333 bp, Streptococcus pneumoniae
  unsure (154): n at each above location is unknown.
gtgttatgtttaacgccatctatgctgctcaaaacaagcaaacttcctttatcatgggcaggaagttggaacatcagtaattctgtggcccatgttatcttccgtggagcattcaacgagtatgccaattatatcccgaattactactatgaanacttactccaagccattgaacgctatgaaaccatgggacttgaaatccttttatcctcattaacacgaaccatgatgactcaggcaagcaatatatggagcagattcgaattgttcgccagaccttgcagaatcgtgattggaatgagaaaattaaaaagacggttcgaggatttatga

SEQ ID NO: 495 - DNA, 267 bp, Streptococcus pneumoniae
aatccttttatcctcattaacacgaaccatgatgactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagaggtctttggttgctctattactgacccttgcctaggttgggaaaatacagaggccttggtagaagagatttatgttaccttgacaaaataa

SEQ ID NO: 496 - DNA, 363 bp, Streptococcus pneumoniae
atgatagttggacacggaattgacatcgaagaattggcttcgatagaaagcgcagttacacgacatgaaggatttgctaagcgtgtactgaccgctcaggaaatggagcgcttcaccagtctcaaaggacgcaggcaaatagaatatttagctggtcgctggtcggctaaggaggccttttccaaggctatgggaacgggcattagcaagctcggttttcaggatttggaagtcttgaacaatgaacgtggggcgccttattttagtcaggcaccattttcaggaaagatttggctgtctatcagccacaccgatcagtttgtgacagccagtgtcattttggaggaaaatcatgaaagctag

SEQ ID NO: 497 - DNA, 1104 bp, Streptococcus pneumoniae
atgaaagctagtccacatagaccaaccaaggttctgattcatctgggagctattcgacaaaatattcagcaaatgggggctcatatccctcaaggaacgctcaagtgggctgtggtcaaggccaatgcttatggccatggagctgttgccgttgccaaggcaattcaagatgatgttgatggcttttgcgtttccaatatcgatgaagccattgaactcagacaagctggactcagcaagccaatcctcattttaggagtttctgaaatcgaagctgttgctctagctaaagaatatgacttcaccttgacagtggctggactggagtggattcaagcactcttagataaggaagtggacctaactggattgacagtccacctcaagattgattcagggatgggacggattggttttagagaggccagtgaggttgagcaggctcaagatttgctacaacaacacggtgttcgtgttgaaggaatctttacccactttgctactgctgatgaggaatcagatgactattttaatgcccagttagaacggtttaaaactattttagctagtatgaaggaagttccagagctggttcatgctagcaattctgcaacgactctttggcatgtagagactattttcaatgcggttcgtatgggagatgccatgtatggcctcaatccaagtggagcggtcttggatttgccttatgatttgataccggccttgaccttggagtctgctctggttcatgtcaagacagttccagcaggagcttgcatgggctatggagcaacttatcaagcggatagcgagcaagtcatcgcgaccgtgccaatcgggtatgcagatggatggacaagagacatgcaaaatttctctgtcttggtagatggccaagcttgcccaattgtcggcagggtttcgatggaccaaatcactattcgattgcctaagctttatccgctaggaaccaaggtaaccttgattggctccaatggggataaggaaatcactgcaactcaggtagcgacctaccgcgtaaccattaactatgaggtggtttgcctcctcagcgaccgtattccgagagaatattattag

SEQ ID NO: 498 - DNA, 2016 bp, Streptococcus pneumoniae
atgaatctacatcaacccttgcatgtcttgcctggtgtgggaccaaagtcagcagaaaaatacgccaaactaggaattgaaaacttgcaagatctcttgctctactttcctttccgttatgaagacttcaaaaccaagcaggtgctggagctggaagacggtgagaaggcagttctttctggtcaggtagtgactcctgctagtgtccagtattatggtttcaagcgcaatcgcctgcgttttagtctcaagcagggagaggtcgtttttgcggtgaatttctttaaccagccctatctggctgataaaatagagttgggagcaacccttgctgtctttggaaaatgggaccgcgctaaggctagtctgaatgggatgaaggttctggctcaggtagaagatgacctccagcctgtttatcgtctggctcagggaatcagtcaggccagtctggttaaggtcatcaagacggcttttgatcagggactggacctcttgatagaagaaaatctgccccagtctttactagacaaatacaaactcatgtcccgttgtcaggcagtccgagctatgcattttccaaaggatttggcagaatacaagcaggctcttcgccgtataaagtttgaggaactcttttatttccaaatgcagctgcagatgctcaaatctgaaaatagagttcagggaagtggtctggttctgaattggtctcaggaaaaagtgacagcagttaaagtaagtcttccttttgccctgacccaagctcaggaaaagagtttgcaggaaattttaactgatatgaagtccgaccaccacatgaatcgtctcctacaaggggatgtggggagtggaaaaacggtagtcgctggcttggccatgtttgcggcagtgacagcaggttatcaggctgccctaatggtaccaacagaaatcctcgcagagcaacactttgagagtttacagaacctttttcccaatttgaaactggctctcttgacaggttccttgaaagctgcagaaaagagagaggtcttggagaccattgccaagggtgaggctgatttgattatcggaactcacgctctgatacaagatggggtggagtatgctcgtcttggtttgattattatcgatgagcagcaccgttttggtgtagggcaaaggcgtattttacgggaaaaaggtgacaatccagatgtcctcatgatgacggcgactcccattccacggacgcttgccatcacagcctttggagatatggatgtttccattatcgaccagatgccagcaggtcggaagcctattgtgacgcgctggatcaaacatgagcaactacctcaggtcttgacttggttagagggggaaattcaaaaaggttcccaagcctatgtcatctctcctttgattgaagaatcagaagctctagatttgaaaaatgccattgccttatcagaggagttgacgactcattttgcaggcaaggcagaggtggctcttctacatggtaggatgaagagtgacgaaaaagaccagatcatgcaggatttcaaggagagaaagacggatattctggtttcgacgacggttattgaggttggggtcaacgttcccaatgcgactgtcatgattatcatggatgccgatcgcttcgggctcagccagcttcaccagcttagaggtcgtgtcggtcggggggacaagcagtcctacgctgttctcgttgccaatcccaagacggattctgggaaagaccgcatgcgcatcatgacagaaacgaccaatggatttgtccttgcggaggaagatttgaaaatgcgtggttctggtgagatttttggaaccagacagtcaggacttccagagttccaagtggctgatattatcgaagattttccgattttagaagaagcaagaaaggttgctagctacattagttctatagaaacttggcaagaagatccagagtggcgcatgattgcccttcatctggaaaagaaagaacatctggattaa

SEQ ID NO: 499 - DNA, 267 bp, Streptococcus pneumoniae
ttaatactcttcgaaaatctcttcaaaccacgtcagcgtcgccttaccgtatatatgttactgacttcgtcagttctatctgccacctcaaaacggtgttttgagctgacttcgtcagtttcatctacaacctcaaaaccatgttttgagctgacttcgtcagtttcatccacaacctcaaaacagtgttttgagcaacctgcggttagcttcctagtttgctctttgattttcattgagtataagttttccttagagaaagcttaa

SEQ ID NO: 500 - DNA, 204 bp, Streptococcus pneumoniae
atgaaaatcaaagagcaaactaggaagctaaccgcaggttgctcaaaacactgttttgaggttgtggatgaaactgacgaagtcagctcaaaacatggttttgaggttgtagatgaaactgacgaagtcagctcaaaacaccgttttgaggtggcagatagaactgacgaagtcagtaacatatatacggtaaggcgacgctga

SEQ ID NO: 501 - DNA, 981 bp, Streptococcus pneumoniae
atgaaaaatccagctttgctagaagaaattaagacctatagaggaagggatgaggttccggaagactttgatgctttctgggatggggaagtgaaaaatgtttccacgcttccatcctaccacttggaggaaagagatttccacattcctcaagtcaagtgctatgagttaacatttgaaggaagcaaggaaggaaaggtctatgcacgcattgttcttccaaagagtgaggagaaggttccactaatattccattttcatggttatatgggacgtggctgggactgggccgacatgctgggcttcaccgtagctggttacggtgttgtttccatggatgtgcggggccagtcaggttactcacaagacggcttgcgttctcctttaggaaataccgtgaaggggcatattatccgtggtgctatggaaggtcgggaccacctcttttataaggatgtttatctggatatttaccagttggtcgaaattgttgctagtctgtctcaggttgatgagaagcgtctttctagctatggtgcctcacaaggaggggctctagctctagttgcagcagcgctcaatcctcgaattcagaaaacagttgccatttatcccttcttgtcagacttcagacgggtgattgagattggtaatactagcgaggcttacgacgaacttttccgttatttcaagtttcacgaccccttccatgaaacagaggaggaaatcatggcgacccttgcctatatcgatgtcaaaaatcttgcccatcgtatccaaggtgaggttaagatgattacgggcttggacgacgatgtttgctatcccattacccagtttgcgatttataatcgtctgacctgcgataaaacctatcgcatcatgcctgagtatgctcacgaagccatgaatgtatttgtcaatgaccaagtctacaactggctctgtggaagtgagattccttttaaatatctaaaataa

SEQ ID NO: 502 - DNA, 618 bp, Streptococcus pneumoniae
gtgttaatacttttcaaaaatctcttcaaaccacgtcagcttcgccttgccgtatatatgttactgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagctgacttcgtcagttctatctgccacctcaaaacggtgttttgagcatcatgcgactagcttcttagtttgctctttgattttcattgagtataaaaacagatga

SEQ ID NO: 503 - DNA, 504 bp, Streptococcus pneumoniae
gtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagctcaaaacaccgttttgaggtggcagatagaactgacgaagtcagtaacatatatacggcaaggcgaagctga

SEQ ID NO: 504 - DNA, 228 bp, Streptococcus pneumoniae
atgatatttaaggcattcaagacaaaaaagcagagaaaaagacaagttgaactacttttgacagtttttttcgacagttttctgattgatttatttcttcacttatttgggattgtcccctttaagctggataagattctgattgtgagcttgattatatttcccattatttctacaagtatttatgcttatgaaaagctatttgaaaaagtgttcgataaggattga

SEQ ID NO: 505 - DNA, 2814 bp, Streptococcus pneumoniae
atgattgtaggagcagtggtatttggaacgtctcctgttttagctcaagaaggggcaagtgagcaacctctggcaaatgaaactcaactttcgggggagagctcaaccctaactgatacagaaaagagccagccttcttcagagactgaactttctggcaataagcaagaacaagaaaggaaagataagcaagaagaaaaaattccaagagattactatgcacgagatttggaaaatgtcgaaacagtgatagaaaaagaagatgttgaaaccaatgcttcaaatggtcagagagttgatttatcaagtgaactagataaactaaagaaacttgaaaacgcaacagttcacatggagtttaagccagatgccaaggccccagcattctataatctcttttctgtgtcaagtgctactaaaaaagatgagtacttcactatggcagtttacaataatactgctactctagaggggcgtggttcggatgggaaacagttttacggtaattacaacgatgcacccttaaaagttaaaccaggtcagtggaattctgtgactttcacagttgaaaaaccgacaccagaactacctaaaggccgagtgcgcctctacgtaaacggggtattatctcgaacaagtctgaaatctggcaatttcattaaagatatgccagatgtaacgcatgtacaaatcggagcaaccaagcgtgccaacaatacggtttgggggtcaaatctacagattcggaatctcactgtgtataatcgtgctttaacaccagaagaggtacaaaaacgtagtcaactttttaaacgctcagatttagaaaaaaaactacctgaaggagcggttttaacagagaaaacggacatattcgaaagcgggcgtaacggtaaaccaaataaagatggaatcaagagttatcgtattccagcacttctcaagacagataaaggaactttgatcgcaggtgcagatgaacgccgtctccattcgagtgactggggtgatatcggtatggtcatcagacgtagtgaagataatggtaaaacttggggtgaccgagtaaccattaccaacttacgtgacaatccaaaagcttctgacccatcgatcggttcaccagtgaatatcgatatggtgttggttcaagatcctgaaaccaaacgaatcttttctatctatgacatgttcccagaagggaagggaatctttggaatgtcttcacaaaaagaagaagcctacaaaaaaatcgatggaaaaacctatcaaatcctctatcgtgaaggagaaaagggagcttataccattcgagaaaatggtactgtctatacaccagatggtaaggcgacagactatcgcgttgttgtagatcctgttaaaccagcctatagcgacaagggtgatctatacaagggtgaccaattactaggcaatatctacttcacaacaaacaaaacttctccatttagaattgccaaggatagctatctatggatgtcctacagtgatgacgacgggaagacatggtcagcgcctcaagatattactccgatggtcaaagccgattggatgaaattcttgggtgtaggtcctggaacaggaattgtacttcggaatgggcctcacaagggacggattttgataccggtttatacgactaataatgtatctcacttagatggctcgcaatcttctcgtgtcatctattcagatgatcatggaaaaacttggcatgctggagaagcggtcaacgataaccgtcaggtagacggtcaaaagatccactcttctacgatgaacaataaacgtgcgcaaaatacagaatcaacggtggtacaactaaacaatggagatgttaaactctttatgcgtggtttgactggagatcttcaggttgctacaagtaaagacggaggagtgacttgggagaaggatatcaaacgttatccacaggttaaagatgtctatgttcaaatgtctgctatccatacgatgcacgaaggaaaagaatacatcatcctcagtaatgcaggtggaccgaaacgtgaaaatgggatggtccacttggcacgtgtcgaagaaaatggtgagttgacttggctcaaacacaatccaattcaaaaaggagagtttgcctataattcgctccaagaattaggaaatggggagtatggcatcttgtatgaacatactgaaaaaggacaaaatgcctataccctatcatttagaaaatttaattgggaatttttgagcaaaaatctgatttctcctaccgaagcgaaagtgaagcgaactagagagatgggcaaaggagttattggcttggagttcgactcagaagtattggtcaacaaggctccaacccttcaattggcaaatggtaaaacagcgactttcctaacccagtatgatagcaagaccttgttgtttgcagtagataaggaagatatcggacaggaaattattggtatagctaaaggaagcatcgaaagtatgcataatcttcctgtaaatctagcaggtgccagagttcctggcggagtaaatggtagcaaagcagcggtgcatgaagttccagaatttacagggggagttaatggtacagagccagctgttcatgaaatcgcagagtataagggatctgattcgcttgtaactcttactacaaaagaagattatacttacaaagctcctcttgctcagcaggcacttcctgaaacaggaaacaaggagagtgacctcctagcttcactaggactaacagctttcttccttggtctgtttacgctagggaaaaagagagaacaataa

SEQ ID NO: 506 - DNA, 216 bp, Streptococcus pneumoniae
tttgactttcctgatagagttgttcacatcttatttcaatctactatattttatagaacagactactctgaaagtagtttcagacctcttatgatttcgtatcagcttgaatgtcatcaaaaaaagatagcaggcttgaaaacctgctatctccttctatttttacaaaatcaaatgtttagaattcttctcttattgttctctctttttccctag

SEQ ID NO: 507 - DNA, 453 bp, Streptococcus pneumoniae
atgattattacaaaaattagccgtttaggaacttatgtgggagtaaatccacattttgcaacattaatagattttctagaaaaaacaggactagaaaatttaacagaaggttcgattgctatcgatggtaatcgattgtttgggaattgctttacttatctagcagatggtcaagcaggggctttctttgaaacacaccaaaaatatttggatattcatttagttttggaaaacgaagaagccatggctgttacatcgccggaaaatgtaagcgttacccaagaatatgatgaagagaaagatattgaattatacacagggaaagtggaacagttggttcatttgagagctggcgaatgcctcatcacttttccagaagatttacatcaacccaaggttcgtataaatgatgaacctgtgaaaaaagttgtctttaaagttgcgatttcttaa

SEQ ID NO: 508 - DNA, 1338 bp, Streptococcus pneumoniae
atgaaaaaaatgagaaagtttttatgtctagctggaattgcgctagcggctgttgccttggtagcttgttcaggaaaaaaagaagctacaactagtactgaaccaccaacagaattatctggtgagattacaatgtggcactcctttactcaaggaccccgtttagaaagtattcaaaaatcagcagatgctttcatgcaaaagcatccaaaaacgaaaatcaagattgaaacattttcttggaatgacttctatactaaatggactacaggtttagcaaatggaaatgtgccagatatcagtacagctcttcctaaccaagtaatggaaatggtcaactcagatgctttggttccgctaaatgattctatcaagcgtattggacaagataaatttaacgaaactgccttaaatgaagcaaaaatcggagatgattactactctgttcctctttattcacatgcacaagtcatgtgggttagaacagatttgttaaaagaacataatattgaggttcctaaaacttgggatcaactctatgaagcttctaaaaaattgaaagaagctggagtttatggcttgtctgttccgtttggaacaaatgacttaatggcaacacgtttcttgaacttctacgtacgtagtggtggaggaagcctcttaacaaaagatcttaaagcagacttgacaagccaacttgctcaagatggtattaaatactgggttaaattgtataaagaaatctcacctcaagattctttgaactttaatgtccttcaacaagctaccttgttctatcaaggaaaaacagcatttgactttaactctggcttccatatcggaggaattaatgccaacagtcctcaattgattgattcgattgatgcttatcctattccaaaaatcaaagagtctgataaagaccaaggaattgaaacctcaaacattccaatggttgtttggaaaaattcaaaacatccagaagttgctaaagcattcttagaagcactttataatgaagaagactacgttaaattccttgattcaactccagtaggtatgttgccaactattaaggggattagcgattctgcagcctataaagaaaatgaaactcgtaagaagtttaaacatgctgaagaagtaattactgaagctgttaaaaaaggtactgctattggttatgaaaatggaccaagtgtacaagctggtatgttgactaaccaacacattattgaacaaatgttccaagatatcattacaaatggaacagatcctatgaaagcagcaaaagaagcagaaaaacaattaaacgatttatttgaggctgttcagtag

SEQ ID NO: 509 - DNA, 885 bp, Streptococcus pneumoniae
atggttaaagaacgtaatttaactcgctggatatttgttttgccagctatgattatcgtaggattactctttgtttatccgtttttctcgagtattttttatagctttaccaataagcatttgattatgcctaattataaatttgttggtttggctaactataaagctgtgctatcagatcccaacttctttaatgcgttctttaattcaattaagtggaccgttttctcattagttggtcaagttttagtagggtttgtattggctttagctcttcacagagtacgccacttcaagaaattatataggaccttattgattgttccttgggcatttcctaccatcgttattgccttttcttggcagtggattctaaacggggtttatggctacttacctaatctaatcgtaaaattaggtttaatggaacatacacctgcatttttgacagatagtacatgggcattcctatgtttggtgtttatcaacatttggtttggagcaccaatgattatggttaatgtgctttcagctttgcaaacagtaccagaagaacaatttgaggctgctaagatagatggtgcttcaagttggcaggtgttcaagtttatcgtctttccacatattaaagtggttgtaggacttctagttgttttgagaactgtatggatctttaataactttgacattatctacctcattactggtggtggaccagccaatgctacaacgacgcttccaatttttgcttacaacctgggctggggaactaaattgttgggtcgtgcttcagcagttacagtattgctctttatcttcttggtggcgatttgctttatctactttgctatcatcagtaagtgggaaaaggagggtagaaaataa

SEQ ID NO: 510 - DNA, 834 bp, Streptococcus pneumoniae
atgaagaagaaatccagtatttatttagatattctctcacatgtactcttagttggtgcgaccattgttgcaattttcccattggtatggattatcatatcttctgtcaaagggaagggggaattaactcagtatccaacacgattttggcctgaacaatttacattagattatttcactcatgttatcaacgatttgcacttcattgataacattcgaaacagtttaatcattgccttggctacaacccttattgcgattattatttctgctatggcagcctatggtattgttcgattctttcctaaattgggagcaatcatgtcgagactactcgtcattacctacattttcccaccaattttgttagcaattccctattcaattgccattgctaaagttgggttaacaaatagtttatttggcttgatgatggtttatctatcttttagtgttccatatgcagtttggctcttagttggatttttccaaacagttccaattggaattgaagaagcggctagaattgatggtgcaaataaatttgttacgttttataaagttgtgctaccgattgtagcaccaggtattgtagcaacagctatttatacatttatcaatgcttggaatgaattcctgtatgccttgattttgattaacaatacaggaaagatgacagtagcagtagcccttcgttcacttaatggttcagaaatactagactggggagatatgatggcagcgtctgttattgtagttcttccatcaattattttcttctctatcatccaaaataagattgcaagtggattatcagaaggatctgtgaagtag

SEQ ID NO: 511 - DNA, 762 bp, Streptococcus pneumoniae
atgaataaaagaggtctttattcaaaactaggaatttctgttgtaggcattagtcttttaatgggagtccccactttgattcatgcgaatgaattaaactatggtcaactgtccatatctcctatttttcaaggaggttcatatcaactgaacaataagagtatagatatcagccctttgttattagataaattgtctggagagagtcagacagtagtaatgaaatttaaagcagataaaccaaactctcttcaagctttgtttggcctatctaatagtaaagcaggctttaaaaataattacttttcaattttcatgagagattctggtgagataggtgtagaaataagagacgcccaaaagggaataaattatttattttctagaccagcttcattatggggaaagcataaaggacaggcagttgaaaatacactagtatttgtatctgattctaaagataaaacatacacaatgtatgttaatggaatagaagtgttctctgaaacagttgatacatttttgccaatttcaaatataaatggtatagataaggcaacactaggagctgttaatcgtgaaggtaaggaacattacctcgcaaaaggaagtattggtgaaatcagtctatttaacaaagcaattagtgatcaggaagtttcaaatattcccttgtcaaatccatttcagttaattttccaatcaggagattctactcaagctaactattttagaataccgacactattgaaagttctataa

SEQ ID NO: 512 - DNA, 378 bp, Streptococcus pneumoniae
gtgctatacttgttgttcaccacaaacacaaggaaaggcacagagatgcaagaacattataccccaaaagggaaacatttgacaatagataaccgtcgcttgattgagcggtggaagaatgaaaataagtccaatcgtgaaattgcaggcttgttaggaaaggcgcctcaaacgattcataatgaagtcaaaagaggtacaactttacaacaagtgagaaaagggctatacaaaaaggtctattctgccgattacgcacaaactgtttaccaattcaatcgaaaacggtcggtgaaaaagttaattttaacaaaggaaatcagagagaagatcttacactatcataagcacataagcaaaaattttcgcctgaaatga

SEQ ID NO: 513 - DNA, 633 bp, Streptococcus pneumoniae
atgatggttaacaagaagcaagtgaaagttggtatttcaaccatctactactggtttcataatggtcatttaggattgacgaaggccgacatgctttatcccagaaaaaggaaaggtgtcaagaagcaagctagtccgaactttaagccggcaggtaaatctatcgaagaacgtcctgacgttattaatcttcgcttggaaaatggtcattatgaaattgataccgtcctactgactaagataaaaaattattgcctgttagtcttaaccgaccggcggagcagacaccaaattataaggttaattccaaataaaactgctgaatctgtcaatcaggcgcttacgttactattaggggagcatcgtattctgtccattactgcagataatggttcggagttcaaacgattgtctgaggtatttcctgaggaacatatctactacgcacatgcttactcttcatgggagagaggttcaaatgaaaatcataatcgattaattcggagatggttacctaaaggaaccaagaaaacgactccgaaagaagtagcttttatcgaaaattggattaacaactaccctaaaaaatgcttggactacaagtcgccaagtgaatttcttttgggtggctaa

SEQ ID NO: 514 - DNA, 1401 bp, Streptococcus pneumoniae
gtgaatttcttttgggtggctaacttcaacttgaaatttgggataccgacactatatacattaagtagtggaagagttctatcaagtattgatgcacgttatggtgggactcatgattctaaaagtaagattaatattgccacttcttatagtgatgataatgggaaaacgtggagtgagccaatttttgctatgaagtttaatgactatgaggagcagttagtttactggccacgagataataaattaaagaatagtcaaattagtggaagtgcttcattcatagattcatccattgttgaagataaaaaatctgggaaaacgatattactagctgatgttatgcctgcgggtattggaaataataatgcaaataaagccgactcaggttttaaagaaataaatggtcattattatttaaaactaaagaagaatggagataacgatttccgttatacagttagagaaaagggtgtcgtttatgatgaaacaactaataaacctacaaattatactataaatgataagtatgaagttttggagggaggaaagtctttaacagtcgaacaatattcggttgattttgatagtggctctttaagagaaaggcataatggaaaacaggttcctatgaatgttttctacaaagattcgttatttaaagtgactcctactaattatatagcaatgacaactagtcagaatagaggagagagttgggaacaatttaagttgttgcctccgttcttaggagaaaaacataatggaacttacttatgtcccggacaaggtttagcattaaaatcaagtaacagattgatttttgcaacatatactagtggagaactaacctatctcatttctgatgatagtggtcaaacatggaagaaatcctcagcttcaattccgtttgaaaatgcaacagcagaagcacaaatggttgaactgagagatggtgtgattagaacattctttagaaccactacaggtaagatagcttatatgactagtagagattctggagaaacatggtcgaaagtttcgtatattgatggaattcaacaaacttcatatggcacacaagtatctgcaattaaatactctcaattaattgatggaaaagaagcagtaattttgagtacaccaaattctagaagtggccgtaagggaggccaattagttgtcggtttggtcaataaagaagatgatagtattgattggagataccactatgatattgatttgccttcgtatggttatgcctattctgcgattacagaattgccaaatcatcacataggtgtactgtttgaaaaatatgattcgtggtcgagaaatgaattgcatttaagcaatgtagttcagtatatagatttggaaattaatgatttaacaaaataa

SEQ ID NO: 515 - DNA, 1104 bp, Streptococcus pneumoniae
atggttaaatacggtgttgttggagcagggtattttggagctgaattggctcgctatatgcaaaagaatgatggagcagagattactcttctctatgatccagataatgcagaggcgattgcagaagaattgggagcaaaagtagcaagttccttagatgagttggtttctagcgatgaagtagattgtgttatcgtcgcaactccaaataatcttcataaggaaccggttattaaggctgcacagcatggtaaaaatgttttctgtgaaaaaccaattgcgctttcttatcaagattgtcgcgagatggtagatgcgtgtaaagaaaacaatgtaacctttatggcaggacatattatgaatttctttaatggtgttcatcatgcaaaagaactcattaatcaaggagttatcggagacgttctatattgtcatacagctcgtaatggttgggaagaacaacaaccgtcagtatcatggaaaaaaattcgtgaaaaatcaggtggtcacttgtatcaccacatccatgaattggattgcgttcaattccttatggggggcatgcctgaaactgtaaccatgacaggtggaaatgtggcccatgaaggtgaacatttcggtgatgaagatgatatgatttttgtcaatatggaattttctaataagcgttttgccttgttagaatggggttcagcttatcgttggggtgaacattatgtcttaatccaaggaagcaaaggtgccatccgcttagacttattcaactgtaaaggaactcttaagctagatgggcaagaaagctatttcttgattcacgaatcgcaagaagaagatgatgatcggactcgtatctatcatagtacagagatggatggagcaattgcttatggtaaaccaggtaaacgtactccattatggctatcatctgtcattgataaagaaatgcgctatctgcatgagattatggaaggagctccagtatcagaagaatttgcaaaacttttgacaggtgaagctgccctagaagcaattgctactgcagatgcttgtacccagtctatgtttgaagatcgcaaagtaaaattgtcagaaattgtaaaataa

SEQ ID NO: 516 - DNA, 390 bp, Streptococcus pneumoniae
ttgaatttccaaaccatcgtagcgttcacgcttggtacaatccagagcaatcacctcgatgtccagttctgccaattcatcaacttctttcatagtagccgtgatgaagggttcctgaggtggataatcacgtttgataatcccaatgattggaagtttagtgacttccttaatttccttgatatcgcgaacactgtttgctcggataccgactgctccaccttgctcagccgctttgaccagcaagggaatcacccctcccgcttctgtataaagcggttcatgaggaagagcctgacaagaaacgatgattccatctttgatttgctcaatcaaggcttctttgctaatctgtggcatcctctttcctccttttctttatttctatga

SEQ ID NO: 517 - DNA, 699 bp, Streptococcus pneumoniae
atgccacagattagcaaagaagccttgattgagcaaatcaaagatggaatcatcgtttcttgtcaggctcttcctcatgaaccgctttatacagaagcgggaggggtgattcccttgctggtcaaagcggctgagcaaggtggagcagtcggtatccgagcaaacagtgttcgcgatatcaaggaaattaaggaagtcactaaacttccaatcattgggattatcaaacgtgattatccacctcaggaacccttcatcacggctactatgaaagaagttgatgaattggcagaactggacatcgaggtgattgctctggattgtaccaagcgtgaacgctacgatggtttggaaattcaagagttcattcgtcaggttaaggagaaatatcctaatcagcttttgatggctgatactagtatcttcgaagaagggctagcagctgtagaagcaggaattgactttgtcggaacaaccttatcaggctacacatcctacagtccaaaagtagacggtccagattttgaattgattaagaaactctgtgatgccggtgtagatgtcattgcagaaggaaaaattcatacaccagaacaagccaaacaaatccttgaatatggagtgcgaggcatcgttgttggtggcgccattactagaccaaaagagattacagaacgcttcgttgctagtcttaaataa

SEQ ID NO: 518 - DNA, 1518 bp, Streptococcus pneumoniae
atgtttaaagttttacaaaaagttggaaaagcttttatgttacctatagctatacttcctgcagcaggtctacttttggggattggtggtgcactttcaaacccaaccacgatagcaacttatccaatactagacaatagtatttttcaatcaatattccaagtaatgagctctgcaggagaggttgtattcagtaatttgtcactacttctctgtgtgggattatgtattggcttagcgaaacgagataaaggaaccgctgcgttagcaggagtaactggttacttagttatgactgcaacgatcaaagctttagtaaaactttttatggcagaaggatctgcaattgatactggagttattggagcattagttgtcggaatagttgccgtatatttgcacaaccgatataacaatattcaattaccttccgctttaggattctttggaggttcacgcttcgttcctattgttacatcgttctcttctatcttgattggctttgtcttctttgttatttggccacctttccaacaacttcttgtttctacaggtggatatatttctcaggcgggtccaattggaacttttctatatggatttttaatgagactttctggagcagtaggcttacatcatataatttaccctatgttttggtatactgaacttggtggtgttgaaactattgcaggacaaacagtggttggagctcaaaaaatattttttgctcaattagccgatccggcccattctggattatttacagaaggaacaaggttttttgcaggtcgtttctcaacaatgatgttcggtttaccggctgcctgtttagcgatgtaccatagtgttcctaaaaatcgtcgtaaaaaatacgcgggtttgttttttggagttgctttaacatcttttattaccggtattacagaaccaattgaatttatgtttctattcgtcagtccggttctatatgttgttcacgcattccttgatggtgttagcttctttattgcagacgtcttaaatatttcaataggaaacacattttcaggaggtgtaatcgatttcactttatttggaattttgcaggggaacgctaagacgaattgggttcttcagattccaattggacttatttggagtgttttgtattatattatttttagatggttcattactcaattcaacgttctaacgccaggacgaggagaagaagtagattctaaagaaatttctgaatccgcagattcaacttcaaatactgcagattatttaaaacaggatagcctacaaattatcagagcgttgggtggatcaaataatatagaagatgtagatgcttgtgtgacacgtttacgtgtagctgtaaaagaagttaatcaagttgataaagcacttttaaaacaaattggtgcagttgatgtcttagaagtgaagggtggcattcaagcaatctatggagcaaaagcaatcttatataaaaatagtattaatgaaattttaggtgtagatgattaa

SEQ ID NO: 519 - DNA, 1329 bp, Streptococcus pneumoniae
atgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaacgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgaatatcttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagtggctggactcaatactactcaccatactacaacactattgatggatttgctgaaatgagaacactttggttcccaatgttgcaatctgtatcaaatggtgacgaaaaaccagcggatgctttgaaagccttcactgaaaaagcaaacgaaacaatcaaaaaagctatgaaacaatag

SEQ ID NO: 520 - DNA, 888 bp, Streptococcus pneumoniae
gtgaaagtcaataaaatccgtatgcgggaaacagtgatttcctacgctttcctagcaccagtattattcttctttgtcatctttgtgttggctccgatggtgatgggcttcattacaagtttctttaactactcaatgactagatttgagtttgtaggcttggataactatatccgtatgtttaaagatcctgtctttacaaaatctctgattaacacagttattttggttattggatctgtaccagttgttgttctattctcactctttgtagcatctcagacctatcatcaaaatgtcattgccagatccttctaccgtttcgtcttcttccttcctgttgtaacgggtagtgttgccgtgacagttgtttggaaatggatttatgacccgctatcagggattctaaactttgtccttaagtcaagccacatcatcagccaaaacatttcttggttgggagataaaaactgggcattgatggcgattatgattattctcttgaccacttcagttggtcagcccatcatcctttatatcgctgccatggggaatattgacaattcactggttgaagcggcgcgtgttgatggtgcaactgagtttcaagttttttggaagattaaatggccaagccttcttccaacaactctttatattgcaatcatcacaacaattaactcattccagtgtttcgccttgattcagcttttgacatctggtggtccaaactactcaacaagtaccttgatgtactacctttacgaaaaagccttccaattgacagaatacggctatgccaacacaattggtgtcttcttggcagtcatgattgctatcgtaagctttgttcaatttaaagtacttggaaacgacgtagaatactaa

SEQ ID NO: 521 - DNA, 840 bp, Streptococcus pneumoniae
atgcaatctacagaaaaaaaaccattaacagcctttactgttatttcaacaatcattttgctcttgttgactgtgctgttcatctttccattctactggattttgacaggggcattcaaatcacaacctgatacaattgttattcctcctcagtggttccctaaaatgccaaccatggaaaacttccaacaactcatggtgcagaaccctgccttgcaatggatgtggaactcagtatttatctcattggtaaccatgttcttagtttgtgcaacctcatctctagcaggttatgtattggctaaaaaacgtttctatggtcaacgcattctatttgctatctttatcgctgctatggcgcttccaaaacaagttgtccttgtaccattggtacgtatcgtcaacttcatgggaatccacgatactctctgggcagttatcttgcctttgattggatggccattcggtgtcttcctcatgaaacaatttagtgaaaatattcctacagagttgcttgaatcagctaaaatcgacggttgtggtgagattcgtaccttctggagtgtagccttcccgattgtgaaaccagggtttgcagcccttgcaatctttaccttcatcaatacttggaatgactacttcatgcaattggtaatgttgacttcacgtaacaatttgaccatctcacttggggttgcgaccatgcaggctgaaatggcaaccaactatggtttgattatggcaggagctgcccttgctgctgttccaatcgtcacagtcttccttgtcttccaaaaatccttcacacagggtattactatgggagcggtcaaaggataa

SEQ ID NO: 522 - DNA, 453 bp, Streptococcus pneumoniae
atgatttttgacgatttgaaaaacatcaccttttacaaagggattcatcctaatttagacaaggctatcgactatctctaccaacatcgtaaggattctttcgaattaggaaagtatgatattgatggagataaagtctttctagttgttcaggaaaatgtcctcaatcaagctgaaaatgatcaatttgagtatcataagaactatgcagatttgcatttgctggtagaaggacatgaatattcgagctacggttcacgtatcaaagacgaggcagtagcattcgacgaagcgagtgacattggctttgttcattgtcatgaacactacccactcttgttgggttatcacaattttgcgattttcttcccaggtgagccacatcagccaaatggttatgcaggcatggaagaaaaggttcgaaaatatctctttaaaattttgattgattaa

SEQ ID NO: 523 - DNA, 354 bp, Streptococcus pneumoniae
ttggtatcttcttgtcagtctgtgtatgctacaagagctagtttcttggatggacagggaattacagttgatgagatggcttggataattaggggcattgtgaatgcattgattggtagatacataaaattaggtacttatgcggctaagtatggtattagtatggcgcgttctatcttaaatagggcagctgcaactgcggcagcaagagtaggattattgactaagatttttggatggattttacgaatagctgtgctcgcagctgatgtatatggtaattttgccaacaatattgctgtagcttgggatgcacatgataaaatccctaacaatggtcgtataaacttttaa

SEQ ID NO: 524 - DNA, 198 bp, Streptococcus pneumoniae
ttgttagggattttatcatgtgcatcccaagctacagcaatattgttggcaaaattaccatatacatcagctgcgagcacagctattcgtaaaatccatccaaaaatcttagtcaataatcctactcttgctgccgcagttgcagctgccctatttaagatagaacgcgccatactaataccatacttagccgcataa

SEQ ID NO: 525 - DNA, 645 bp, Streptococcus pneumoniae
atggcacaaaaaggagtaagccttatcaaggcagcatttgatacagataactttctcatgcgttttagtgagaaagtcttggacatcgtgacagccaatcttctttttgtcgtctcttgtttgcccatcgtgacgattggagtggctaaaatcagcctctacgagaccatgttcgaagttaagaagagcagacgggtgcctgtttttaaaatctatctaagatctttcaagcaaaatctgaaactaggtcttcagctgggtttaatggagttaggaattgtgtttcttaccctttcagatctctatcttttctggggtcaaacagctctgcccttccaattgctgaaagccatttgtttaggtattctgatttttcttactatcgtgatgctggctagttaccctatcgcggcacgttatgacctatcttggaaagaaattcttcaaaaaggattgatgttggctagttttaactttccttggttcttcctcatgttagccattcttgtcctcattgtgatggttctttatctgtccgccttcagtctactcttaggtggctcagtcttcttactttttgggtttggactattggtctttatccagactggattgatggagaaaattttcgcaaaataccaatag

SEQ ID NO: 526 - DNA, 660 bp, Streptococcus pneumoniae
atgtcagatttgaaaaaatacgaaggtgtcattccagccttctacgcatgttatgatgatcaaggagaagtaagcccagaacgtacgcgtgccttggttcaatacttcattgataaaggtgttcaaggtctttatgtcaatggttcttctggtgaatgtatctaccaaagcgttgaagatcgcaagttgattttggaagaagtcatggcggtagccaaaggtaaattgaccattattgctcatgttgcctgcaacaatactaaagacagtatggaacttgctcgccatgctgaaagcttgggagtagatgctattgcaacgattccaccaatttatttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgttaagaactcttctatgccagttcaagatatccaaacctttgtcagccttggtggggaagaccatatcgtctttaatggtcctgatgagcagttcctaggaagacgcctcatgggtgctagggtggtatcggtggtacttatggtgctatgccagaactcttct

SEQ ID NO: 527 - DNA, 300 bp, Streptococcus pneumoniae
ggtggtatcggtggtacttatggtgctatgccagaactcttcttgaaactcaatcagttgattgcggataaggacctaaaaacagcgcgtgaattgcagtatgctatcaacgcaatcattggtaaactcacttctgctcatggaaatatgtacggtgtcattaaagaagtcttgaaaatcaatgaagtcttgaatattggatctgttcgttcaccattgacaccagtgactgaagaagatcgtccagttgtagaagcggctgctgccttgattcgtgaaaccaaggagcgcttcctctaa

SEQ ID NO: 528 - DNA, 885 bp, Streptococcus pneumoniae
atgacatactacgttgcaattgatatcggtggaaccaacatcaagtatggtttggttgatcaagaggggcaacttcttgaatcgcatgaaatgccaactgaggcgcataagggtggacctcatatcttacaaaagaccaaagatatcgtagctagttatttagaaaaaggcccagtagcaggtgttgccatatcttctgctgggatggtggatccggataagggtgagattttctatgctgggcctcaaatccctaactacgcaggcacccagttcaaaaaggaaatcgaagaaagctttactattccttgtgagattgaaaatgatgtcaactgtgcaggtcttgctgaggcagtatctggttcaggcaagggagcaagtgtgacactttgcttgaccattggaaccggtatcggtggttgcttgattatggataggaaagtcttccatggttttagtaattcagcctgtgaagtcgggtatatgcatatgcaggatggagcttttcaggatctcgcttctacaacagctttagtgaaatatgtagctgaagcccatggagaagatgttgatcagtggaatggccgacgtatctttaaggaagctactgaaggaaacaaaatctgcatggaaggtattgaccgtatggttgactatctaggaaaaggtctggcaaatatttgttatgtggccaatccagaagtggttattcttggtggtggtatcatggggcaagaggctatcctcaaacctaagatccgcacagccttgaaagaggcattggtaccaagtttagcagaaaaaacacgattagaatttgcccatcaccaaaatacagcagggatgttgggtgcatattatcattttaagacaaaacaatcctag

SEQ ID NO: 529 - DNA, 849 bp, Streptococcus pneumoniae
atggacaaaccagatatcgcaactatcattgattcacattttgaagaaatgacagacctagagcaagaaatcgctcgctattttttgcaagctgaaacgattacagatgatttatcttctcaacaagtcacccaaaaattacatatttctcaagctgctttgacccgctttgctaaaaagtgtggctttactggctaccgagaatttattttccaataccaacatcaggcagaaaatcaagccaaccaagtctccaagcatagtccactgaccaaacgagtcctcagaagttatagcaatatgagggaacaaacacaagacttgattgacgaaatccaactagagcgaattgcccagctaatcgaagatgctgagcgtatctacttctttggaacagggagttctggcctcgtcgcccgtgaaatgaaattacgttttatgcgactaggtgtggtctgcgaagctttgacagaccaagacggctttgcctggacaaccagcatcatggatgaaaattgtctagtactgggtttctcactttcaggctcaactccttctattttagatagtctattagatgccaaggagatgggggcaaagactgtactctttacaagtgttcccaataaagatagccagacctatacagagactgttcttgtagccacccacagccaaccctcctacatccaacgaatatccgctcaacttcctatgctcttctttatcgatttgatttatgcctactttttggaaatcaatcgcgaaagcaaggaaaaaatctttaatagctactgggaaaataaaaaactcaacggctatcgtagacaaaaacgtgtaagaaaatcc

SEQ ID NO: 530 - DNA, 2043 bp, Streptococcus pneumoniae
atgagaaaatttaacagccattcgattccgattcggcttaatttattgttttcaatcgtcattttactctttatgaccattattggtcgtttgttgtatatgcaggttttgaacaaggatttttacgaaaaaaagctagcctcagctagtcagaccaagattacaagcagttcagcccgtggggaaatttatgatgctagtggaaaacctttggtagaaaatacgttaaagcaggttgtttcctttacgcgtagcaataaaatgacggctacagacttaaaagaaacagctaaaaagttactgacttatgtgagcatcagttctccaaatttgacagaacgccagctggcggattactatttggctgatcctgaaatctataaaaaaacagtggaagctctcccaagtgagaaacgcttggattcagatggcaatcgtctatccgaatcagaactgtataacaatgcggtcgatagtgtccaaacaagtcaactaaactatacagaggatgaaaagaaagaaatctatctttttagtcagttaaatgctgttggaaactttgcgacaggaaccattgctacagatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgatcgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggctttccaagatagcgtggatgctttactgaaaagttatttcaattccgagctagaaaatggtggagccaagtattctgaaggtgtctatgcagtcgcccttaacccaaaaacaggtgcggttttgtctatgtcagggattaaacatgacttgaaaacgggagagttgacgcctgattccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaattgacctaccagatgaatctactggatttgttcccaaagagtatagctttgctaattacattactaatgcctttgggcagtttgataactatacgccgatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggcgccttggtatccattagcggaaaaacaggtacagccgaaagctatgtggcagatggtcagcaagcaaccaataccaatgcggtggcctatgccccatctgataatccccaaatcgctgttgcagtggtctttcctcataataccaatctaacaaatggtgtaggaccttccattgcgcgtgacattatcaatctgtatcaaaaataccatccaatgaactag

SEQ ID NO: 531 - DNA, 357 bp, Streptococcus pneumoniae
cttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaat

SEQ ID NO: 532 - DNA, 513 bp, Streptococcus pneumoniae
ttgacagttattctaagttaccaggtatcgggattaagacggctacgcgtctggccttttatacgattgggatgtctgctgatgatgtcaatgaatttgcaaaaaatctccttttctgctaagagagaattgacatattgttctatttgtggacgtttgacagacgacgatccttgttctatctgtactgatccgactcgtgaccagacaacaattttagttcttgaggatagtagagatgtggcagccatggaaaatatccaagaataccatggactctatcatgtccttcatggcctcatttctcctatgaatggtatcagtccggacgatatcaatctcaagagccttatgactcgtcttatggatagtgaagtttcagaagtgattgtggcgactaatgctacagcggatggtgaagcgacttccatgtatctttcacgtttgctcaagccggctggtatcaaggttacgcgtctagacacgaggtctcgctgtgggagcggacattga

SEQ ID NO: 533 - DNA, 1044 bp, Streptococcus pneumoniae
atgaaacaaacgattattcttttatatggtggacggagtgcggaacgcgaagtctctgtcctttcagctgagagtgtcatgcgtgcggtcaattacgaccgtttcacagtcaagactttctttatcagtcagtcaggtgactttatcaaaacacaggaatttagtcatgctccggggcaagaagaccgtctcatgaccaatgaaaccattgattgggataagaaagttgcaccaagtgctatctacgaagaaggtgcagtggtctttccagtccttcacgggccaatgggagaagatggctctgttcaaggattcttggaagttttgaaaatgccttacgttggttgcaacattttgtcatcaagtcttgccatggataaaatcacgactaagcgtgttctggaatctgctggtattgcccaagttccttatgtggctatcgttgaaggcgatgatgtgactgctaaaatcgctgaagtggaagaaaaattggcttatccagtcttcactaagccgtcaaacatggggtctagtgtcggtatttctaagtctgaaaaccaagaagaactccgtcaagccttaaaacttgccttccgatatgacagccgtgtcttggttgagcaaggagtgaatgcccgtgaaattgaggttggcctcttgggtaactacgatgtcaagagcacgctacctggagaagttgtcaaggacgttgccttttatgactacgatgccaagtatattgataacaagattactatggatattcctgccaaaatcagtgatgatgtggtggctgtcatgcgtcaaaatgcagaaacagccttccgtgccattggtggccttggtctatctcgttgcgatttcttctatacagataagggagagatttttctcaacgagctcaataccatgccaggttttacccagtggtctatgtacccactactttgggacaatatggggatcagctacccagaactaatcgagcgtttggttgaccttgccaaggaaagttttgacaagcgcgaagcgcatttgatataa

SEQ ID NO: 534 - DNA, 1374 bp, Streptococcus pneumoniae
atgaaattaacaatccatgaaattgcccaagttgttggagccaaaaatgatatcagtatctttgaggacacccagttagaaaaagctgagtttgatagtcgtttgattggaactggagatttatttgtgccacttaaaggtgcgcgtgatggccatgactttattaaaacagcctttgaaaatggtgcagcagtaaccttgtctgagaaagaggtctcaaatcatccttacattctagtagatgatgttttgacagcctttcaatccctagcatcctactatcttgaaaaaacgactgttgatgtctttgctgttacaggttcaaatggcaagacaacgactaaggatatgttggcgcatttactgtcaacaagatacaagacctacaaaacacaaggcaattacaataatgagattggccttccttacacagttctccacatgcctgaaggaacagaaaagttggtcttggagatggggcaggaccacttgggagatattcatctcttgtctgaattggctcgtccaaaaacagccatcgtgaccttggttggagaagctcatttggcctttttcaaagatcgttctgagattgctaaaggaaaaatgcaaattgcagacggaatggcttcaggttccttgcttttagcgccggctgaccctatcgtagaggactatttgccaactgataaaaaggtggtccgttttgggcaaggggcagagttggaaatcacagacttggttgagcgcaaagatagtctaaccttcaaggccaatttcttagagcaagcccttgatttgccagtaactggtaagtacaatgctaccaatgctatgattgcatcctatgttgccctacaagaaggagtttcagaggagcaaattcatcaggccttccaaggtcttgaattgacgcgtaatcgtactgagtggaagaaagcagccaatggagcagatatcctgtcagacgtatataatgccaatccaactgctatgaagctgattttagagactttctctgccattccagccaatgaaggtggcaagaaaattgcagtgttggcggatatgaaggagcttggtgaccagtctattcaactccataaccagatgattttgagcctttctccagatgtgcttgataccgttattttctatggagaagacattgctgaattagcccaattggccagtcaaatgttcccaataggccacgtttactacttcaagaaaacagaagaccaagaccaatttgaagacctagtcaagcaggtcaaggaaagcctcagtgccaatgatcaaatcttgctcaagggctctaactctatgaacctagccatgttggtagaaagtttagaaaatgaaaccaagtga

SEQ ID NO: 535 - DNA, 1347 bp, Streptococcus pneumoniae
atgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggctatggaacggactatgcttgtaaagaattgtcagctgatgcctactttccaaaattgttggaaggagggcagcttgcttcacagccaaccttatcccgttttctttccagaactgacgaggaaacagtccatagtttgcgatgcctcaaccttgaattggtcgaattctttttacagtttcaccagctaaaccaactcattgtagatatcgattctacccatttcacaacttatggcaagcaagaaggtgttgcttataacgctcactatcgtgctcatggctatcatcctctttatgctttcgaggggaagacaggttattgtttcaatgcccagcttcgtcctggtaatcgttattgttctgaagaggcagacagctttatcacacctgttttagaacggtttaatcaacttctctttcgaatggatagtggctttgcgaccccaaaattatacgatttaattgaaaaaacagggcaatactacctcataaaactcaagaaaaatactgttctgagccgtcttggagacctttccctcccttgcccacaggatgaggacttaaccatcttgccccactccgcctactcagaaactctctatcaagcaggatcttggtcgcacaagcgtcgtgtctgccagttctctgaacgaaaagaaggaaacttgttctacgatgttatttctctcgttacaaatatgacgagtggaacaagccaagaccagtttcagctttatcgtggacgtggtcaagccgagaatttcatcaaggagatgaaggagggattttttggcgataaaacggatagttcaaccttaatcaaaaacgaagttcgtatgatgatgagctgtatcgcctacaatctctatctttttttcaaacatctagctggaggtgacttccaaactttaacaatcaaacgcttccgccatctttttcttcacgtggtaggaaaatgtgttcgaacaggacgcaagcagctcctcaaattgtctagtctctatgcctattccgaattgttttcagcactttattctaggattagaaaagtcaacctgaatcttcctgttccttatgaaccacctagaagaaaagcgtcgttaatgatgcattaa

SEQ ID NO: 536 - DNA, 576 bp, Streptococcus pneumoniae
atgattgcccttacagatactggcttaacctttacaaaagatccttttgactgtgagcgctacgaggacttgcgaagtctgttatctgaaatgttgaatcagggatcagacctggatgcagaagaagtagcagaagtcttgaaaccaacttcagcttatgcgactcccttaatggacgtccgtgcttggattgttgaggatgagaagatttgtctggttaggggacaaggagaggatagttgggctttgccaggtggctttggtgaagtcggctattctccaactgaaaatattctcaaggaaattgaagaagaaaccggttttaaagccaaagttgaaagactgctagctgtttttgataccaatcgtttccaactacagagcaaacaatatgcaaagtttgtttttgaatgtaagcttctcgatggacaattccaagaaaatcaagaaatcgctgaccttcaattttttgcaattgaccaactgccgaatttatctgaaaaacgcattaccaaggagcaaatcgagattctttggcaggtttatcaaggtcagagggagcaatatcttgactaa

SEQ ID NO: 537 - DNA, 597 bp, Streptococcus pneumoniae
atgaatttatgggatattttctttacgactcaggcaaccgagccgcccaaatttgaccttttttggtatgttagcctatttacgctcttagccttaaccttttatacagcccatcgctatcgtgaaaagaaggtttaccaacgatttttccaaatcttgcagactgttcagttaatccttctttatggttggtactgggtcaatcatatgccactgtcagaaagcctacccttttaccattgccgtatggctatgtttgtggtactcttgcttcctggtcagtccaaatataaacaatactttgcattattgggaacatttgggacattagcagcctttgtttatccagtgccagatgcttacccttttccacatatcaccattctatcctttatctttggtcatttagcactcttggggaactctctagtttatctattgagacagtataatgcgcgattgctggatgtgaagggaatttttctcatgacctttgccctaaatgccttgatttttgtggtcaatttggtgacaggtggcgattacggatttttgacaacccgcccattggttgggggaacacgttctagtagctaa

SEQ ID NO: 538 - DNA, 261 bp, Streptococcus pneumoniae
atgcctgccttttcttccgcttgggaaatggctgacttgatagcagttgctgctgtatcaatatcaacaataattccatcctttacacctttacttttggcattactcacgccaattacatttaattcaccatttctctgctcggccacaagcaccttgacagagcttgttccaatatctagacctgtaaaaaagccttctctagccattacatcgcttcctctctatcttccaagtttcgcacttcgtattattccataa

SEQ ID NO: 539 - DNA, 1374 bp, Streptococcus pneumoniae
atggctagagaaggcttttttacaggtctagatattggaacaagctctgtcaaggtgcttgtggccgagcagagaaatggtgaattaaatgtaattggcgtgagtaatgccaaaagtaaaggtgtaaaggatggaattattgttgatattgatacagcagcaactgctatcaagtcagccatttcccaagcggaagaaaaggcaggcatttcgattaaatcagtgaatgtcggcttgcctggtaatcttttgcaggtagaaccaactcaggggatgattccagtaacatctgatactaaggaaattacggatcaagatgttgaaaatgttgtcaaatcagctttgacaaagagtatgacacctgaccgtgaagtcattacctttattcctgaagaatttattgtggatggtttccaagggattcgtgacccacgtggtatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaatgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtagaggttattggagaagtggaagcagtcgaagtgacggaagcctacttgtcagaaattatttctgcacgaatcaagcacatccttgaacaaatcaagcaagaattagatagaaggcgtctattggacctccctggtggtattgtcttaatcggtgggaatgccattttaccaggtatggttgagcttgctcaggaagtctttggcgtccgtgtcaagctttatgttccaaatcaagttggtatccgtaatccagcctttgcgcatgtgattagtttatcagaatttgcgggtcaattaacagaagttaatcttttggctcagggagcgataaaaggtgagaatgacttaagtcatcagccaattagttttggtgggatgctgcaaaaaacagctcagtttgtacaatcaacgcctgttcaaccagctcctgctccagaagtagagccggtggcgcctacagaaccaatggcggatttccaacaagcttcacaaaataaaccgaaattagcagatcgtttccgtggcttgatcggaagcatgtttgacgaataa

SEQ ID NO: 540 - DNA, 1257 bp, Streptococcus pneumoniae
atgacattttcatttgatacagctgctgctcaaggggcagtgattaaagtaattggtgtcggtggaggtggtggcaatgccatcaaccgtatggtcgacgaaggtgttacaggcgtagaatttatcgcagcaaacacagatgtacaagcattgagtagtacaaaagctgagactgttattcagttgggacctaaattgactcgtggtttgggtgcaggaggtcaacctgaggttggtcgtaaagccgctgaagaaagcgaagaaacactgacggaagctattagtggtgccgatatggtcttcatcactgctggtatgggaggaggctctggaactggagctgctcctgttattgctcgtatcgccaaagatttaggtgcgcttacagttggtgttgtaacacgtccctttggttttgaaggaagtaagcgtggacaatttgctgtagaaggaatcaatcaacttcgtgagcatgtagacactctattgattatctcaaacaacaatttgcttgaaattgttgataagaaaacaccgcttttggaggctcttagcgaagcggataacgttcttcgtcaaggtgttcaagggattaccgatttgattaccaatccaggattgattaaccttgactttgccgatgtgaaaacggtaatggcaaacaaagggaatgctcttatgggtattggtatcggtagtggagaagaacgtgtggtagaagcggcacgtaaggcaatctattcaccacttcttgaaacaactattgacggtgctgaggatgttatcgtcaacgttactggtggtcttgacttaaccttgattgaggcagaagaggcttcacaaattgtgaaccaggcagcaggtcaaggagtgaacatctggctcggtacttcaattgatgaaagtatgcgtgatgaaattcgtgtaacagttgtcgcaacgggtgttcgtcaagaccgcgtagaaaaggttgtggctccacaagctagatctgctactaactaccgtgagacagtgaaaccagctcattcacatggctttgatcgtcattttgatatggcagaaacagctgaattgccaaaacaaaatccacgtcgtttggaaccaactcaggcatctgcttttggtgattgggatcttcgccgtgaatcgattgttcgtacaacagattcagtcgtttctccagtcgagcgctttgaagccccaatttcacaagatgaagatgaattggatacacctccatttttcaaaaatcgt

SEQ ID NO: 541 - DNA, 237 bp, Streptococcus pneumoniae
ttgattccttctacagcaaattgtccacgcttacttccttcaaaaccaaagggacgtgttacaacaccaactgtaagcgcacctaaatctttggcgatacgagcaataacaggagcagctccagttccagagcctcctcccataccagcagtgatgaagaccatatcggcaccactaatagcttccgtcagtgtttcttcgctttcttcagcggctttacgaccaacctcaggttga

SEQ ID NO: 542 - DNA, 672 bp, Streptococcus pneumoniae
atgaatgtaaaagaaaatacagaacttgtttttcgagaagttgcagaggctagtctgagtgctaatcgagagagtggttcggtctctgtcattgcagttaccaagtatgtagatgtaccgacagcggaagccttgcttccgctaggtgttcatcatatcggtgaaaatcgtgtagataagtttctggaaaaatatgaagctttaaaagatcgagatgtgacttggcatttgattggtaccttgcaaagacgtaaggtgaaagatgtcattcaatacgttgattatttccatgcattggactcagtaaagctagcaggggaaattcaaaaaagaagtgaccgagtcatcaagtgtttccttcaagtaaatatttctaaagaagaaagcaaacacggtttttcgagagaggaactgctggaaatcttgccagagttagccggactagataagattgaatatgttggtttaatgacgatggcaccttttgaggctagcagtgagcagttgaaagagattttcaaggcggcccaagatttacaaagagaaattcaagagaaacaaattccaaatatacctatgaccgagttaagtatgggaatgagtcgtgattataaagaagcgattcaattcggttccacttttgttcgtataggtacatcattttttaagtag

SEQ ID NO: 543 - DNA, 540 bp, Streptococcus pneumoniae
atgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggtacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgattttcagtatatgacagaggtgcaggctcgtcgttgtttggactatttggatggagcttgtcatgttttagctggaaatttgaaaaaggtagcttctaccatgtatttgttaacaccagtgaacgttattgtaaatgttgaagatatccgtttaccagatgaagatcaacagggtgagttcggttttgatatgaagcgaaatagagtacgataa

SEQ ID NO: 544 - DNA, 264 bp, Streptococcus pneumoniae
atgatttttttaattcgtatgatttataatgcagtggatatttactccctgattttgatagccttcgctgtcatgtcttggtttccaggtgcctacgaatccagtttaggtcgttggattgtagcgttggtgaaaccagtgcttgctcccttgcaacgcctgcctttacagatagcgggtcttgatttatctgtttgggttgcgattgttttggttcgatttttaggagaaaacttagtgcgttttctggcgatgataggatga

SEQ ID NO: 545 - DNA, 786 bp, Streptococcus pneumoniae
atgaataaagggatttatcagcatttctccatagaagatcgtccatttcttgacaagggaatggaatggataaagaaggtagaagatagctatgctccttttttaactccttttatcaatcctcatcaggagaagctattaaagattttggcaaaaacctatggtcttgcttgtagcagtagtggggaattcgtctcgagtgagtatgttcgagttttattatacccagattatttccaaccagagttttcagattttgaaatatctcttcaggaaattgtgtattccaataaatttgaacatttaacgcatgctaagattttagggacagtcatcaatcaattagggattgaacggaaactttttggagatatcctagtagatgaagaacgggcgcagattatgattaatcagcagtttcttcttctctttcaagatggactaaagaaaattggtcgtatacctgtttcgctggaggaacgtcctttcaccgagaaaatagataagctagaacagtatcgagaactggatttatctgtgtctagttttcgattagatgttcttttatcaaatgttttgaaactatctaggaatcaagcaaaccagttgattgaaaagaaacttgtccaagtaaattatcatgtggtagacaaatcagattacactgttcaagttggagacttgattagtgtgagaaaatttggtcgcttgagattacttcaagataagggacaaacgaaaaaagagaagaaaaaaataaccgtccagttattattaagtaagtga

SEQ ID NO: 546 - DNA, 789 bp, Streptococcus pneumoniae
atgccaattacatcattagaaataaaggacaagacttttggaactcgattcagaggttttgatccagaagaagtcgatgaatttttagatattgtggttcgtgattacgaagatcttgtgcgtgcgaatcatgataaaaatttgcgtattaagagtttagaagagcgtttgtcttactttgatgaaataaaagattcattgagccagtctgtattgattgctcaggatacagctgagagagtgaaacaggcggcgcatgaacgttcaaacaatatcattcatcaagcagagcaagatgcgcaacgcttgttggaagaagctaaatataaggcaaacgagattcttcgtcaagcaactgataatgctaagaaagtcgctgttgaaacagaagaattgaagaacaagagccgtgtcttccaccaacgtctcaaatctacaattgagagtcagttggctattgttgaatcttcagattgggaagatattctccgtccaacagctacttatcttcaaaccagtgatgaagcctttaaagaagtggttagcgaagtacttggagaaccgattccagctccaattgaagaagaaccaattgatatgacacgtcagttctctcaagcagaaatggcagaattacaagctcgtattgaggtagccgataaagaattgtctgaatttgaagctcagattaaacaggaagtggaagctccaactcctgtagtgagtcctcaagttgaagaagagcctctgctcatccagttggcccaatgtatgaagaaccagaagtag

SEQ ID NO: 547 - DNA, 2793 bp, Streptococcus pneumoniae
atgaaactcaaagacacccttaatcttgggaaaactgaattcccaatgcgtgcaggccttcctaccaaagagccagtttggcaaaaggaatgggaagatgcaaaactttatcaacgtcgtcaagaattgaaccaaggaaaacctcatttcaccttgcatgatggccctccatacgctaacggaaatatccacgttggacatgctatgaacaagatttcaaaagatatcattgttcgttctaagtctatgtcaggattttacgcaccatttattcctggttgggatactcatggtctgccaatcgagcaagtattgtcaaaacaaggtgtcaaacgtaaagaaatggacttggttgagtacttgaaactttgccgtgagtacgctctttctcaagtagataaacaacgtgaagattttaaacgtttgggtgtttctggtgactgggaaaatccatatgtgaccttgactcctgactatgaagcagctcaaattcgtgtatttggtgagatggctaataagggttatatctaccgtggtgccaagccagtttactggtcatggtcatctgagtcagcccttgctgaagcagagattgaataccatgacttggtttcaacttccctttactatgccaacaaggtaaaagatggcaaaggagttctagatacagatacttatatcgttgtctggacaacgactccatttaccatcacagcttctcgtggtttgacggttggtgcagatattgattacgttttggttcaacctgctggtgaagctcgtaagtttgtcgttgctgctgaattattgactagcttgtctgagaaatttggctgggctgatgttcaagttttggaaacttaccgtggccaagaactcaaccacatcgtaacagaacacccatgggatacagctgtagaagagttggtaattcttggtgaccacgttacgactgactctggtacaggtattgtccatacagcccctggttttggtgaggacgattacaatgttggtattgctaataatcttgaagtcgcagtgactgttgatgaacgtggtatcatgatgaagaatgctggtcctgaatttgaaggtcaattctatgaaaaggtagttccaactgttattgaaaaacttggtaacctccttcttgcccaagaagaaatctctcactcatatccatttgactggcgtactaagaaaccaatcatctggcgtgcagttccacaatggtttgcctcagtttctaaattccgtcaagaaatcttggacgaaattgaaaaagtgaaattccactcagaatggggtaaagtccgtctttacaatatgatccgtgaccgtggtgactgggttatctctcgtcaacgtgcttggggtgttccacttcctatcttctacgctgaagatggtacagctatcatggtagctgaaactattgaacacgtagctcaactttttgaagaacatggttcaagcatttggtgggaacgtgatgccaaagacctcttgccagaaggatttactcatccaggttcaccaaacggcgagttcaaaaaagaaactgatatcatggacgtttggtttgactcaggttcatcatggaatggagtggtggtaaaccgtcctgaattgacttacccagccgacctttacctagaaggttctgaccaataccgtggttggtttaactcatcacttatcacatctgttgccaaccatggcgtagcaccttacaaacaaatcttgtcacaaggttttgcccttgatggtaaaggtgagaagatgtctaaatctcttggaaataccattgctccaagcgatgttgaaaaacaattcggtgctgaaatcttgcgtctctgggtaacaagtgttgactcaagcaatgacgtgcgtatctctatggatattttgagccaagtttctgaaacttaccgtaagattcgtaacactcttcgtttcttgattgccaatacatctgactttaacccagctcaagatacagtcgcttacgatgagcttcgttcagttgataagtacatgacgattcgctttaaccagcttgtcaagaccattcgtgatgcctatgcagactttgaattcttgacgatctacaaggccttggtgaactttatcaacgttgacttgtcagccttctaccttgattttgccaaagatgttgtttacattgaaggtgccaaatcactggaacgccgtcaaatgcagactgtcttctatgacattcttgtcaaaatcaccaaactcttgacaccaatccttcctcacactgcggaagaaatttggtcatatcttgagtttgaaacagaagacttcgtccaattgtcagaattaccagaggctcaaacttttgctaaccaagaagaaatcttggatacatgggcagccttcatggacttccgtggacaagcacaaaaagccttggaagaagctcgtaatgcaaaagttatcggtaaatcacttgaagcacacttgacagtttatccaaatgaagtggtgaaaactctactcgaagcagtaaacagcaatgtagctcaacttttgatcgtgtcagacttgaccatcgcagaaggaccagctccggaagctgcccttagcttcgaagatgtagccttcacagttgaacgtgctgctggtgaagtatgtgaccgttgccgtcgtatcgacccaacaacagcagaacgcagctaccaggcagtcatctgtgatcattgtgcaagcatcgtagaagaaaactttgcggacgctgtcgcagaaggatttgaagagaaataa

SEQ ID NO: 548 - DNA, 186 bp, Streptococcus pneumoniae
atgaaattaaaaacacttgctttaattagtggtatcgtcggtcttgtgggaggaattttacttcttattggtccttttgtcttgttgggaacaacggtaaacacagctgctacaactcttaatggaggagctactgcaggggctttttcaggtgttgcctgtactcttgaatgccttgaagattga

SEQ ID NO: 549 - DNA, 261 bp, Streptococcus pneumoniae
atggaggagctactgcaggggctttttcaggtgttgcctgtactcttgaatgccttgaagattgaaaatcttgttcttggtatcattgctattgtttactataaaggagataagcgtgtaggtgcagctccgtctgtactaatgattgtttctggtggagttagtctcattccattcttaggatgggttggggggattcttgctattatcggaggatctctattccttgcaacattgaagaaattcaaatcagaagaataa

SEQ ID NO: 550 - DNA, 189 bp, Streptococcus pneumoniae
atggaaaataatgactcgtttactaaactaaaagagtcaactcaaaaattattcgatgcgcagaaaaaaaggttaaataatgaagatagaatagaaacaaccaaaaacaatgtgattgccaaacattgtcaaacagtcctttcctttttggttttgactagcttttttgtgaaaaattgtgtaaaatag

SEQ ID NO: 551 - DNA, 216 bp, Streptococcus pneumoniae
ctttgttccattcagactcaccgtggcgagcaaaaaccaattttaccattagatggattctcctttaaattttccgaggtttcccctcgtttatctattctattttacacaatttttcacaaaaaagctagtcaaaaccaaaaaggaaaggactgtttgacaatgtttggcaatcacattgtttttggttgtttctattctatcttcattatttaa

SEQ ID NO: 552 - DNA, 693 bp, Streptococcus pneumoniae
atggtaaaattggtttttgctcgccacggtgagtctgaatggaacaaagctaaccttttcactggttgggctgatgttgatttgtctgaaaaaggtacacaacaagcgattgacgctggtaaattgatcaaagaagctggtatcgaatttgaccaagcttacacttcagtattgaaacgtgctatcaaaacaactaacttggctcttgaagcttctgaccaattatgggttccagttgaaaaatcatggcgcttgaacgaacgtcactacggtggtttgactggtaaaaacaaagctgaagctgctgaacaatttggtgatgagcaagttcacatctggcgtcgttcatacgatgtattgcctccaaatatggaccgtgatgatgagcactcagctcacacagaccgtcgttatgcttcacttgacgactcagtaatcccagatgctgaaaacttgaaagtgactttggaacgtgctcttccattctgggaagataaaatcgctccagcttttaaagatggtaaaaacgtattcgtaggagctcacggtaactcaatccgtgcccttgtaaaacacatcaaaggtttgtcagatgatgagatcatggacgtggaaatccctaacttcccaccattggtattcgaattcgatgaaaaattgaacgttgtttctgaatactaccttggaaaataa

SEQ ID NO: 553 - DNA, 2412 bp, Streptococcus pneumoniae
atgataaggaataaaaaacaagattatgtactggcctacaagcaaccagcttcaaccacttacatgggttgggaagaagaagctttaccgataggtaatggttctttaggagcaaaagtatttggccttatagggtctgaacggattcaatttaatgaaaaaagtctctggtctggaggtccacttcctgatagttcagattatcagggtggaaatcttcaggatcagtatgtttttttagctgagattcggcaggctttggagaagagagattacaatctggctaaggaactggctgagcagcacctaattgggccaaaaacgagtcaatatgggacctatctgtcttttggggatattcacattgagttcagccagcaaggtacgactttgtctcaggtgacggactatcagagacagttgaatattagtaaggcacttgcgacgacttcttatgtctataagggaacgcgatttgaacgtgaagcttttgcgagttttccagatgatctcttggttcaatgttttactaaggaagggttggaaactctagattttactatagaactatccttgacctgtgatttggcttctgatggaaagtatgagcaggaaaaatctgattacaaggagtgtaagttggatattactgattctcatatcttgatgaagggaagagttaaggataatgatctgcggtttgctagttatctagcttgggaaacggatggagatattagagtttggtcagatagggttcagatatcaggagccagttatgccaatctcttcttggccgctaagacggattttgcccaaaatcctgctagcaattatcgcaagaaactagatttagagcaacaggtgatagacttggtggacacagctaaagaaaagggctatacccaattgaaatcaaggcatatcgaggactaccaagccttattccagcgtgttcaattggatttggaagctgatgttgacgcatccactacagatgatttgttaaaaaattataagccacaagaagggcaggctttggaggagctgttcttccagtatggacggtatttattgattagttcgtccagagactgcccagatgctctaccagctaacctacagggagtctggaatgcggtcgacaatcctccttggaattcggactatcacttaaatgtcaatctgcagatgaattattggccagcctatgttaccaatctcctagagacggtctttccagtcatcaactatgtagatgatttgcgtgtctatggtcgtctagcggctgtaaagtatgcaggaatcgtctctcagaaaggtgaggaaaatggttggttggttcatactcaagcgactccctttggttggacggcacctggttgggattactattggggttggtcaccagctgccaatgcgtggatgatgcaaaccgtttatgaagcctattcattttatagggaccaagactatcttagggagaaaatttatcccatgttgagggaaacggttcgtttttggaatgcctttttacataaggatcagcaggcgcagcgttgggtgtcttctccgtcttattccccagaacatgggccgatttcgattggcaatacctatgaccaatctctgatttggcagttatttcatgattttattcaggctgctcaggaattgggactggatgaggacttgttgactgaggttaaggagaagtctgatttactaaatcctttgcaaatcactcaatctggtcgaatcagggagtggtatgaggaggaagagcagtattttcaaaatgagaaagtggaggcccagcatcggcacgcttcccatctagtgggactctatcctggcaatctctttagctacaagggacaagagtatattgaagcggcgcgtgctagcctcaatgatcgtggagatggcggcacaggctggtccaaggctaataagatcaatctctgggcgcgtttgggagatggcaatcgagcccataaattattggcagagcagttaaagacatccaccttgcaaaatctttggtgtagccatcctccttttcagatagatggtaattttggtgctactagtggcatggcagaaatgttactccagtctcatgcagcttatctggtacctctagctgccctacctgatgcttggtcaacaggttctgtttcaggcttaatggcacgtggacattttgaagtgagcatgagctgggaagataaaaaactcttacagttgaccattttatcaaggagtggaggagatttgcgagtttcttatccagatattgagaagagtgtgattaaaatgaatcaagaaaaaataaaagcgaaatgcatggggaaagattgtatttcggtggcaacagcagaaggtgatcttgttcaattttatttttaa

SEQ ID NO: 554 - DNA, 711 bp, Streptococcus pneumoniae
gtggatctgatggcttatattgagatgaaacactgttacaagcgttatcaggttggggacacggagattgtggctaatcgtgatgtgaattttgagattgaaaagggggagctggttattatccttggtgcttcaggtgcaggcaagtcaacagttctcaaccttcttgggggaatggataccaatgatgaaggggaaatctggattgatggtgttaatattgcggattatagttcccaccagcgcaccaattaccgtagaaatgatgtggggtttgtttttcagttttataatctagtttctaatctgacagctaaggaaaatgtggaactggcttctgaaattgtgacagatgccttgaatcctgatcaggtcttgacagatgtaggtctggctcatcgtctaaataactttccagcccagctttctggaggggagcaacagcgagtctccattgcacgcgcggtagccaaaaatcctaaaattcttctttgtgatgaacctactggagccttggattatcagacgggcaagcaggttttgaaaattctccaagatatgtctcgtcaaaagggagcgacggtgatcatcgtgactcataatggagctttggcgcccattgctgatcgcgtgattcatatgcacgatgccagtgtcaaggatgtggtgctcaaccagcatcctcaggatattgacagtttggagtactag

SEQ ID NO: 555 - DNA, 2775 bp, Streptococcus pneumoniae
atgccagtgtcaaggatgtggtgctcaaccagcatcctcaggatattgacagtttggagtactagcatgatcaagcgaaaaacttattggaaggacttaattcagtccttcacaggctccaaggggcgttttttatccatcttgatcctgatgatgttgggatctctagccttagtaggcctcaaagtaaccagtcccaacatggaggcgacagctaatgcttatttaacaactgctcaaaccttggatttggcagtcatgtctaactatggcttggatcaagcagaccaagaagaactaaaacagacggagggcgcagaggtcgagtttggctatttgacagatgtgactatggataatgggcaggatgccattcggctgtactccaaaccagagcgaatttcaacctttcagctaagaaagggacgacttcctcagtcagacaaggaaatcgctttggccactcatttgcaagaccaatacagcgtgggacaggagattagttttaaagaaaaagaagagggtcattcctctttaaaagaccatacttataccattactggttttgtggattcggctgaaatcctctcccagcgagatatgggctacgcaggaagtggaagtgggactctggcagcctatggggtgattttacctagtcaatttgatcagaaagtctacaatatagctcgtttgaaatatcaagatttagcaggtttaaatgccttttcatcagcttatgaagaaaaatccaagcaacatcaggaagagcttgaacaaattttatcagataatggcaaggtacgtctgcaacttttgaaaaaagaaggacaagagtctctagacaaggggcaagagacccttgacaaggctcagactaatttgcaggaaggcaagcgtcgtttagcagctgctcaagctcgtatacaggctcaagaaagtcaactagccttgtttcctcaagttcagagagagcaggctagtgctcaacttacccaagccaagcaggaattgggcaaggaagaggccaaactaaagcaagctgaacaaaatctagcccaagaaaaggaaaaattagaaaaacatcagcaagtcttggacgatttggcggagccaaggtatcaggtctataatcgtcagaccatgccaggtggtcagggctatcttatgtatagcaatgcttcatccagtattcgagcagtgggcaatatctttcctgtggtactttatgccgtagcagccatggtgacatttacgaccatgactcgctttgtagacgaagagcgaactcatgcagggatttttaaggccttgggttatcgtagtaaggatattatcgccaagtttctcctttatggactagtagctgggactgtcggaacggctctaggtagtatacttggtcattatttgctagccagtgtaatttcaagtgtcattacaaaaggcatggtggtgggagaaactcagattcagttctattggacctatagcttactagcttttgtcttgagcttgttggcgagtgtgttatcagcctatctggtggcttggagggaacttcatgacgaagcagcccagcttctacttcctaaacctcctgtcaaaggagctaaaatcttattggagcgtatcggttttatctggcgtcgtctcagttttactcataaggtaacagcccgcaacatctttcgttataagcagagaatgttgatgacaatctttggtgtggcaggttctgtagctctgctctttgcaggtttgggaatccaatcttctgtagcaggagttccgtctaaacagtttcaacaaatccaacagtatcagatgcttgtctctgaaaatcctagtgcgaccaatcaggacaaggtagagctagcagaagtgttgaaagggcaggagatactagcctaccagaaaatctattctaaaacgctagacaaggatttcaaaggcaaggctggtcttcaaaacattactcttatgatgatagagaaggaagatttgactccctttatccatcttcaacatcatcagcaggagctgacattaaaagatggcatcgttattacagctaaactcgcccagctggcaggtgtcaaggttgggcagactttagaaattgaaggtaaggaactaaaggtcgctgctattactgagaactacgttggtcactttatttatatgagtcaggctagctatgagcaactttacggacagctaccccaagccaacacttatctggtctcattaagggataccagtgcaactagtatcgaaagtcaggcgggcttgcttatgaatcaatctgcggtgtccagcgttgtccaaaatgcttcagccattcgactcttcgactctatcgctagctcactcaatcagaccatgaccatcttggtcatcgtatcggttctattagctattgtcatcctttacaatctgaccaatatcaacgtagctgagagaatccgtgaactctccactatcaaggttcttggttttcataataatgaagtcaccctctacatttaccgtgagacgattgtgctgtcccttgtgggaatcgtacttggtctgatagctggtttctatttacaccaatttttgattcaaatgatttcgcctgcgactattctcttttatccgcaggtaggctgggaagtctatgtaatcccagtggcagcagtaagcttcattttgaccttgcttggtttcttcgtcaattattatctgagaaaggttgatatgttagaagccctgaaatctgtagagtaa

SEQ ID NO: 556 - DNA, 519 bp, Streptococcus pneumoniae
atggaagaaaaaagattggagtatcctatggtaacttttctcggaaatcctgtgagctttacaggtaaacaactacaagtcggcgacaaggcgcttgatttttctcttactacaacagatctttctaaaaaatctctggctgattttgatggcaagaaaaaagtcttgagtgtcgttccttctatcgatacaggcatctgctcaactcaaacacgtcgttttaatgaagaattggctggactggacaacacggtcgtattgactgtttcaatggacctaccttttgctcaaaaacgttggtgcggtgctgaaggccttgacaatgccattatgctttcagactactttgaccattctttcgggcgcgattatgccctcttgatcaacgaatggcacctattagcacgcgcagtctttgtcctcgatactgacaatacgattcactacgttgaatacgtggataatatcaattctgagccaaacttcgaagccgcaattgcagctgctaaagccctatag

SEQ ID NO: 557 - DNA, 930 bp, Streptococcus pneumoniae
atgaaaaaattaggtacattactcgttctctttctttctgcaatcattcttgtagcatgtgctagcggaaaaaaagcaacaacttctggtcaaaaactaaaagttgttgctacaaactcaatcatcgctgatattactaaaaatattgctggtgacaaaattgaccttcatagtatcgttccgattgggcaagacccacacgaatacgaaccacttcctgaagacgttaagaaaacttctgaggctgatttgattttctataacggtatcaaccttgaaacaggtggcaatgcttggtttacaaaattggtagaaaatgccaagaaaactgaaaacaaagactacttcgcagtcagcgacggcgttgatgttatctaccttgaaggtcaaaatgaaaaaggaaaagaagacccacacgcttggcttaaccttgaaaacggtattatttttgctaaaaatatcgccaaacaattgagcgccaaagaccctaacaataaagaattctatgaaaaaaatctcaaagaatatactgataagttagacaaacttgataaagaaagtaaggataaatttaataagatccctgctgaaaagaaactcattgtaaccagcgaaggagcattcaaatacttctctaaagcctatggtgttccaagtgcctacatctgggaaatcaatactgaagaagaaggaactcctgaacaaatcaagaccttggttgaaaaacttcgccaaacaaaagttccatcactctttgtagaatcaagtgtggatgaccgtccaatgaaaactgtttctcaagacacaaacatcccaatctacgcacaaatctttactgactctatcgcagaacaaggtaaagaaggcgacagctactacagcatgatgaaatacaaccttgacaagattgctgaaggattggcaaaataa

SEQ ID NO: 558 - DNA, 849 bp, Streptococcus pneumoniae
atgattgcagaatttatcgatggattgcaaaaattccatttcctacaaaatgccttgataacagctattgtcgtcgggattgtagctggagccgtgggatgtttcattattctacgcgggatgtcactcatgggagatgccatttcacatgctgtcttaccaggtgtagccctctccttcatcttgggccttgacttctttatcggagccattgtctttggattgctagctgccatcatcattacctacatcaaaggaaactcgattatcaaaagcgataccgccatcggcattaccttttcttctttcttagccctcggtatcatcttgattggtgtcgctaaaagttcaactgaccttttccatatcctttttggtaatatcctggccgtccaagatacggatatgtttattactatgggtgtgggggcagccatcctcttgttaatctggattttcttcaagcaactcttgataacttcctttgatgaactcttggctaaagccatgggaatgcctgtcaatttctatcactaccttctcatggtactcctgactctcgtgtctgtgacagccatgcaaagtgtcggaactatcctgattgtagccatgctgattaccccagctgcaactgcttatctgtatgctaatagtctgaaaagcatgattttcctttcctcaaccttcggagctactgcttcagttttgggactctttattggctatagttttaatgttgcggcaggttctagtatcgtgcttacagctgctagtttctttctcattagcttctttatcgctcccaaacaacgatatttgaaactgaaaaataaacatttgttaaaataa

SEQ ID NO: 559 - DNA, 756 bp, Streptococcus pneumoniae
atgtatattaagagacaggaggaatacaagtttatgatacgtatcgaaaatctcagtgtctcctacaaagaaacgttggcacttaaggatatttcactagtgctccatggaccaacaattaccggcatcattggtccaaacggcgctgggaaatcaacactattaaaaggtatgctgggaattatcccacatcaaggtcaggcatttctcgatgacaaggaagttaaaaaatccttacaccgaattgcctatgtcgaacaaaaaatcaatatcgactacaactttcccatcaaggtcaaggaatgcgtctcgttaggactatttccctctattcctctctttcgaagtttaaaggctaaacattggaagaaagtgcaagaggcccttgaaatcgtcggcctagctgactacgctgaacgtcaaattagtcaactgtctggaggtcaattccagcgggtcttgattgccagatgtttggtgcaggaagccgactatatcctcttggatgaaccctttgctgggattgactctgtcagtgaggaaatcatcatgaatacgctgagagatttgaaaaaagctgggaagacggttctcatcgttcaccacgacctcagcaagattccccactacttcgatcaagtcttacttgtcaatcgagaagtgattgcctttggtccaacaaaagaaacttttaccgaaaccaatctaaaagaagcttacggtaatcaactctttttcaatggaggtgacctatga

SEQ ID NO: 560 - DNA, 1953 bp, Streptococcus pneumoniae
ttgcattccctagtgatttttgttaagataaatgcaaatacaaatgaaagcgagaacaagatgacacgttatcaagatgatttttatgatgctatcaatggagaatggcaacagacagctgaaatcccagcagataagtctcaaacaggaggttttgttgatttagaccaggaaattgaagacctgatgttggcgacaacagacaagtggttagcaggtgaagaagtgcctgaggatgctatcttggaaaactttgtcaaataccaccgcctagttcgtgattttgacaagagagaagctgacggtatcacacctgtcttaccactccttaaagaattccaagaattggaaacttttgcggattttacagctaaactagcagagtttgagcttgcaggaaaaccaaacttccttccttttggtgtatcgccagactttatggatgctagaatcaatgttctatgggctagcgctccaagcacaatcttgccagatacgacctactatgcagaagaacatcctcagcgcgaagagctcttgactctttggaaagaaagcagcgcaaatctcctcaaggcttatgatttctctgatgaagaaattgaagacttgctagaaaaaagacttgaattggaccgccgagttgcggcagtggtgctctctaatgaagaaagttcagaatatgctaaactctatcatccatattcttacgaagatttcaagaaattcgcgcctgccctacctttggatgacttcttcaaagcagttattgggcaattaccagacaaggttattgtagacgaggaacgtttctggcaagcagcagagcaattctacagtgaggaagcctggtctctccttaaagcaaccttgattttgagtgttgtcaatctttcaaccagctatttaacagaggatatccgtgttttgtctggtgcctacagccgtaccctttctggagttccagaggcaaaagataaggtcaaagcagcttatcatctagcacaggaacctttcaagcaagccctgggtctttggtacgcccgtgagaagttctctccagaagccaaggcggatgtggagaaaaaagtggcaaccatgattgatgtctataaggagcgtctgcttaagaatgactggctcactccagaaacctgtaaacaggctatcgtgaagctcaatgtgatcaaaccttatattggctatccagaagaattgcctgcacgttacaaggataaggtagtgaatgaaactgccagtctttttgagaatgctctagcctttgcgcgtgtggaaatcaagcacagttggagtaagtggaaccagcctgtaaactataaggaatggggcatgcctgctcatatggtcaatgcctactacaatcctcagaagaacctgattgtctttccagcggccattttacaggcgcctttctatgacttgcatcagtcatcttctgctaactacggtggtattggggcagtgattgcccatgaaatttcccacgcctttgatactaacggagcttcctttgacgaaaatggtagcctcaaggattggtggacagagagcgactatgctgccttcaaggagaaaacacaaaaagtcattgaccaatttgatggacaggattcttatggagcaaccattaacggtaaattgactgtatcagaaaacgtggctgacttgggaggaatcgcagcagcgcttgaagcagctaagagagaagcagacttctcagcagaagagttcttctacaacttcggtcgcatctggcgcatgaaaggtcgtccagaatttatgaaacttttggctagcgtcgatgtgcacgcaccagccaaactccgtgtcaatgtgcaagtaccaaacttcgacgatttctttacaacctatgatgtcaaagaaggagacggaatgtggcgttcaccagaggagcgcgtgattatttggtaa

SEQ ID NO: 561 - DNA, 630 bp, Streptococcus pneumoniae
atgaaaatccataaaaccgtgaatcctgttgcctatgaaaatacctattatctagaaggcgaaaagcacctcatcgtcgtcgatcctggtagtcattgggaagccattcgtcagacaatcgagaagatcaacaaaccgatctgtgctattctcttgacccacgcccattatgaccatatcatgagtctggacttggttcgcgagacgtttggcaatcctcctgtctatatcgcagagagcgaagccagctggctctacactcctgtcgataatctctccggtctccctcgccacgatgatatggcagatgtggtcacaaaacctgcagaacacacctttgtctttcacgaagaataccaactagaggaatttcgttttaaggttctaccgaccccagggcactctatcggtggtgtttccctagtctttcctgatgctcacctagtcttgacgggagatgctctattccgcgaaactatcggacggaccgaccttccgactggtagcatggagcaactccttcatagtatccagacccaactcttcaccctaccaaactacgatgtctatccaggacatggtccagctactactatcgctcacgaaaaggccttcaatccctttttttag

SEQ ID NO: 562 - DNA, 201 bp, Streptococcus pneumoniae
atggattttcatactagctccaatctcaaagaatgtactaatactcttcgaaaatctcttcaaaccgcgtcaactttatctgcaacttcaaagcagtgctttgaacagcctgcggctagctttctagtttgctctttgattttcattgagtataaattaagtatagcacagttagggagaataggtaaggatttaaaatga

SEQ ID NO: 563 - DNA, 243 bp, Streptococcus pneumoniae
ttggcgcggtttgaagagatttttgaagagtataaaaatcctcaagatactttcttctatcctttagtttataaggagaatacctatgaaaaaactgctatttctatctttgctctcctaatgttaggagtttgctgcctgttcctattcagccagcaaagctataaaaaactcgttcaatactatgctaacgaccagaacctgcccagtaggataacttatagtgaatatagcgacaaatga

SEQ ID NO: 564 - DNA, 2223 bp, Streptococcus pneumoniae
atgccgaaagaagtgaatttaacaggcgaagaagttgtcgctttaaccaaagaatatttaacggaagaggatgttcattttgtccataaggccttggtctatgctgttgaatgccacagtggtcaatatcgcaaatcaggcgagccttatatcattcaccctatccaagtggcaggtattttagctaagctaaagctggatgctgtaacagtagcttgtggattcttgcatgatgtggtggaagatacagatgcgaccttggacgatttggaaagagagtttggtcctgatgtgcgggtgattgttgacggagttaccaagcttggcaaggtcgagtacaaatcgatcgaggagcaattagcggaaaatcatcgcaagatgctcatggccatgtctgaggacatccgcgttattttggtcaaactgtctgaccgcttgcacaatatgcggaccctgaaacatcttcgaaaagacaagcaggagcgtatttccaaagaaaccatggaaatctatgccccacttgcccatcgtttggggatttccagtgtcaaatgggaattagaagacttgtctttccgttatctcaatccaacggagttttacaagattacccatatgatgaaggaaaagcgcagggagcgtgaggccttggtggatgaggtagtcacaaaattagaggagtatacgacagaacgtcacttgaaagggaagatttatggtcgtcccaagcatatttactcaattttccgcaaaatgcaggacaagagaaaacggtttgaggaaatctatgatctgattgctattcgttgtattttagatacccaaagtgatgtttatgccatgcttggttacgtgcatgaattttggaaaccgatgccaggtcgcttcaaagactatattgccaaccgcaaggccaatggttatcagtctatccatacgactgtttatggaccaaaagggccgattgaattccagattcgaaccaaggaaatgcacgaggtggctgagtacggggttgcggctcactgggcttataagaaaggtataaaggggcaagttaacagcaaggaatcagctattggaatgaactggatcaaggagatgatggagctccaagaccaggctgatgatgctaaggaatttgtggactctgttaaggaaaactatctggctgaggagatttacgtttttaccccagatggagctgtccgttcccttcccaaagattcaggaccgattgattttgcctacgaaatccataccaaggtcggtgaaaaagcaactggtgccaaggtcaatggccgcatggttccactgacaaccaagttaaagacaggggatcaggttgaaattatcgccaacccgaactcctttggacctagccgtgactggctcaatatggtcaagactagcaaggcgcgcaataagattcgccagttctttaaaaaccaagataaggaattgtctgtcaacaagggtcgtgagatgctgatggctcagttccaagaaaatggctatgtggcaaataaatttatggacaagcgccacatggatcaagttctgcaaaagaccagttacaagacagaagactccctctttgcggccattggttttggggaaatcggtgcgattaccgtctttaaccgtctgactgaaaaggaacgccgtgaggaagagcgtgccaaggccaaggctgaggcagaggagcttgtcaaaggtggcgaggtcaaggttgaaaataaagaaactctcaaggtcaagcatgaggggggagtggttattgaaggtgcttctggtctcctagtgcggattgctaagtgttgtaaccccgtgcctggtgacgatattgttggctacattaccaagggtcgtggtgtggctattcaccgtgtggactgtatgaacctgcgtgcccaagaaaactacgagcaacgtctccttgatgtggaatgggaagaccagtactctagctcaaataaggagtatctggcccatatcgatatctacggtctcaaccgtacaggactgttgaacgatgtactgcaagttctttcaaatacaaccaagaatatttcaacggtcaatgcccaaccaaccaaggatatgaagtttgctaatatccatgtgtccttcggtattgccaacctctctacactgaccacggttgtcgataaaattaagagtgtgccagaagtttactctgtcaaacggaccaacggctag

SEQ ID NO: 565 - DNA, 243 bp, Streptococcus pneumoniae
ttgcccctttatacctttcttataagcccagtgagccgcaaccccgtactcagccacctcgtgcatttccttggttcgaatctggaattcaatcggcccttttggtccataaacagtcgtatggatagactgataaccattggccttgcggttggcaatatagtctttgaagcgacctggcatcggtttccaaaattcatgcacgtaaccaagcatggcataaacatcactttgggtatctaa

SEQ ID NO: 566 - DNA, 444 bp, Streptococcus pneumoniae
atgaaaatcattatccaacgggttaaaaaagcccaagtgagtatagaaggccagattcagggaaaaatcaatcagggacttttattgctggttggtgttggaccagaggaccaagaggaagatttggactatgctgtgagaaaactggtcaatatgcggattttttcagacgcagaaggcaagatgaacctgtctgtcaaagatattgaaggagaaatcctctctatttctcagtttaccctctttgcggatactaagaaaggcaatcgtccagcctttacaggggcagctaaacctgatatggcatcagacttctatgatgctttcaatcaaaaattagcgcaagaagtgcccgttcagacaggcatctttggagcagatatgcaggttgagctggttaataacggacctgttaccattatcctagatactaaaaagagataa

SEQ ID NO: 567 - DNA, 228 bp, Streptococcus pneumoniae
ctctattcccagattagaccgagattctggcgttttgctttacaaattctcctatgggatagcctgatgattctctccttggtgtctttaagtgatattccacttttccttcagggaactctcctcatcctaggacatctcatcccttcctatcgcatctgccaaagcctgaaaagagacttcccccaagcatatcaagaaccgatttctttttggagtattttatga

SEQ ID NO: 568 - DNA, 423 bp, Streptococcus pneumoniae
gtgcttgtcatgaaaaaactctatagaatccattttatagcaattgcagttattgatttgctactatttgcattttttatcattagactcgagacatcttttgagtggctcttgctctctgatttaattttcttccttactcaaggactcctgctatttctcttgatcgtccgactcaaacatcaattcgctgagatttatcctcaaatcaataaaaagattcgcttctactatttaggggttctcaccattgattttctattttttgttctcttagccttcattagttctcagcgtttttcatctcttatgccaatcatcactgcttgccattctactttttattatatgacagctgactacctaagagaaaactatccagacttttacgacaaacacatctctttatgggagtgtctctaa

SEQ ID NO: 569 - DNA, 708 bp, Streptococcus pneumoniae
atgaaaaaatcactaaaaatttttgctacatctaaatggtttgacctcttcggggttgctttggtcgttgggattgcgattgcatctggttacctcaactcacgcctcgataaatttgtagactggggaccatggacagctcttgtaccctttggattgatttccgtaaccaacgttgggatttccatgttgtccactcgtttcacggggaaattaagcaaatggggaaattactttagtattgttaataccattttgtccggtgctattgattatatccttggaaataaggcggccatcattacctatcccgtcaccttcctcatttatacctttgctataaagaaatggaaagcttcgcaagaaggcagacccaaccaaatgagccaaaaacaggtaaaattggcggtcatcatcatttccatcatcgccttcctctttgcctttgtgaccaactatatcggatatgagggcaagatgaatctccttgcctacgtaacaactattgcctttgcactatccctcattgccaatgctttgaatgcattaaaactaacaactcagtggggcttttggttgatttacaatttcgttcagctgacaaaagctggtattcaaggaaacttcgccaatatcggtaaatacatcttttatatcctcaatgcaatcggagctttatttgtctggaatgatgaagaagttagataa

SEQ ID NO: 570 - DNA, 420 bp, Streptococcus pneumoniae
ttgattgaagtatttctaattcatcatttagactatacaagtgaccagattcacgaggaagctgacgtcttggaacacactgtctctgacctgttcgtggaaagactagataaactgctaggtttccctaaaacctgcccccacggaggaactattcctgccaagggagaactactcgttgaaatcaataacctcccactagctgatatcaaggaagctggcgcctaccgcctgactcgggtgcacgatagttttgacattctccattatctggacaagcactcacttcacatcggtgaccagctccaagtcaagcagtttgatggcttcagcaataccttcactatcctcagtaacgacgaggatttacaagtgaatatggacattgcaaaacaactctatgtcgagaaaatcaactaa

SEQ ID NO: 571 - DNA, 240 bp, Streptococcus pneumoniae
atgaccccaaacaaagaagactatctaaaatgtatttatgaaattggcatagacctgcataagattaccaacaaggaaattgcggctcgcatgcaagtctctccccctgccgtaactgaaatgatcaaacgaatgaaaagtgaaaatctcatcctaaaggacaaggaatgtggctatctactgactgacctcggtctcaaactggtctctgagctctatcgtaagcacacgcttgattga

SEQ ID NO: 572 - DNA, 843 bp, Streptococcus pneumoniae
atgacgaaaatagctcttctttcagatattcatggaaataccaccgccttggaggctgttttggcagatgctcagcagctaggagtggatgaatactggcttttgggagatattctcatgccagggacaggacgtagaaggattttggacttgttggatcaactaccgattacggctagagttttgggaaactgggaagacagtctttggcatggtgtccgtaaggaattggacagtactcgccccagtcaacgctatctcttgcgccagtgccagtatgttttagaggaaatttccctagaagaaattgaagtgctccacaatcaacctcttcaaattcatcgtcagtttggggatttgacggtgggaattagccatcatctgcctgataagaactgggggcgagagttgattcatactggcaaacaagaggagtttgaccgcttggtgactcatcctccctgtgatattgctgtttatggacatattcaccagcagttgcttcgttacgggactggtgggcaattgattgtcaatccgggttcgattggccaacctttctttttggacgctcagctacggaaggacttgcgggcccagtatatgattttggagtttgatgacaaaggcctggtagatatggacttccgacgggtagactacgatgtggcagcggaattgcagctggctaaagacctgagacttccctattttgaggtttactatgaaagtctggtcaatgggatccaccatactcatcatcaggaatttttgagagaattggctcagaaagagggctgcgaccgggagttagacgactggttgaaaagtggtaacgattga

SEQ ID NO: 573 - DNA, 195 bp, Streptococcus pneumoniae
ttggaatttgcatcctcttctcctttttacgaggctaccctgcctctactcttctttttctattattataccctttttagttgtaatgtcaatcgttaccacttttcaaccagtcgtctaactcccggtcgcagccctctttctgagccaattctctcaaaaattcctgatgatgagtatggtggatcccattga

SEQ ID NO: 574 - DNA, 315 bp, Streptococcus pneumoniae
atgcaaattccaagtagatttaccattgcgactcatatgctgataatcattgccctcgaggggaaggaaagcaaggtgaccagtgattttctggctgctagtgtcggggtcaatcctgtcattatcagaaagatcttgtcccagttgaagaaggcagagctgatttcagtagcgcgtggaacgggcggaacagagattgtcaaggaccttaaggatattagtcttttagatgtttatcaaggcgggtcgaatgtcttggtaagacaggtcaactcttcagtttccatgacaatccgaatccaaattgccctgtag

SEQ ID NO: 575 - DNA, 219 bp, Streptococcus pneumoniae
tcttttagatgtttatcaaggcgggtcgaatgtcttggtaagacaggtcaactcttcagtttccatgacaatccgaatccaaattgccctgtaggagctcatattcatgatgttttggatcaaaaattggagagaattcagttgactatggaggcagaacttggtcaaaccagtctagaaaaagtcgtggccgatgcagagagtcagatgaaggattaa

SEQ ID NO: 576 - DNA, 303 bp, Streptococcus pneumoniae
atgtatctcgttataggaattgtattagcctttatagtgtcattttggaaggataatagaagtttgtggaatccagtattatttttattatccctcatttcaagttatttttatctatcctaccttttttataaaaatggatacgagaatgttcagttagctttttatgtatttgcctttgtcttacttccttttttgctttttctaagtggcatctttttaatctataatggggtcattttgttgaagcgagagggacgttccaagccccattatctctcaatgctatttgatttttattga

SEQ ID NO: 577 - DNA, 1074 bp, Streptococcus pneumoniae
atggccaatatttttgactatctgaaagatgtcgcatatgattcttattacgaccttcccttgaatgagttagacattctaaccttaatagaaatcacctacctctcctttgataatctggtctccacacttcctcaacgtcttttagatctagcacctcaggttccaagagatcccaccatgcttactagcaaaaatcgccttcaattattagatgaattggctcaacacaagcgcttcaaaaattgcaaactctcccattttatcaacgacatcgaccctgaactgcaaaagcaatttgcggctatgacttatcgtgtcagcctcgatacctatctgattgtctttcgtgggacagatgacagtatcattggctggaaggaagatttccacctgacctatatgaaggaaattcctgctcaaaagcacgcccttcgctatttaaagaacttttttgcccatcatcctaagcaaaaggttattctagctgggcattccaagggaggaaatctcgctatctatgctgctagccaaattgagcaaagtttgcaaaatcagatcacagcagtttatacatttgatgcacctggtctccatcaagaattgacacagactgcgggttatcaaaggataatggatagaagcaagatattcattccacaaggttccattatcggtatgatgctggaaattcctgctcaccaaatcatcgttcagagtactgccctgggtggcatcgcccagcacgatacctttagttggcagattgaggataagcacttcgtccaactggataagaccaacagtgatagccagcaagtagacacaacctttaaagaatgggtggccacagtccctgacgaagaacttcagctctacttcgacctcttctttggcactattcttgaggctggtattagctctatcaatgacttggcttccttaaaggcgcttgaatacattcatcatctctttgtccaagctcaatccctcactccagaagaaagagaaaccttgggtcgccttacccagttattgattgatactcgttaccaggcatggaaaaatagataa

SEQ ID NO: 578 - DNA, 678 bp, Streptococcus pneumoniae
atgcacaagattttattaatagaagatgatcaggtcattcgtcaacaggtcgggaaaatgctctctgaatggggatttgaagtggtcctggtagaagactttatgaaagttttgagtctatttgttcagtcggaacctcatctggtcctcatggatattggtttgcccttgtttaatggttatcactggtgtcaggaaatccgcaagatttccaaggtacctatcatgtttctttcttcgagagaccaggctatggatattgtcatggcaatcaatatgggggcggatgactttgtgaccaagccttttgaccagcaggttcttttagctaaggttcagggcttgttgcgtcgttcctatgagtttgggcgtgatgagagtttgctggaatatgctggtgttatcctcaataccaaatccatggatttacattatcaagggcaagtcttgaatttgaccaagaatgaattccagattttacgcgtgttatttgagcatgcaggcaacatcgtagcacgtgacgacctgatgcgggaactttggaacagtgactttttcattgatgataataccctctctgtcaatgtggctcgtttgcgtaaaaagttggaggagcagggattggtaggatttatcgagaccaagaaaggaatagggtacggattgaagcatgcttga

SEQ ID NO: 579 - DNA, 975 bp, Streptococcus pneumoniae
atgcttgattggaaacaattttttctagcctatctgcgctcccgtagtcgtctttttatctatctgctttctttggcatttcttgtcttactctttcagtttttatttgccagtctaggaatttacttcctctactttttcttcttgtgttgctttgtaaccatattatttttcacttgggacatattggtggaaacgcaggtctatcgccaggaacttctctatggagagagggaagccaagtctcctttggaaatagctttagcagaaaaattagaagcgcgtgagatggaactctatcagcagaggtcaaaagcagaaagaaaactgacggatttgctggattactataccttgtgggtccatcagataaagacccccattgcagccagtcaactcttagttgcagaagtggtcgaccgccaactgaagcagcagctagaacaggaaattttcaaaatcgactcctataccaacctagttttacagtacctgcgtttagaaagtttccatgatgatttgctcttaaagcaggttcaaattgaggacttggtcaaggaaataattcgtaaatatgctcttttctttattcaaaaaggcttaaatgtcaatctacatgaccttgataaagaaatcgtgacggataaaaagtggctgctagtggttattgagcaaatcatctcaaacagtctcaagtacaccaaggaaggtggtctggagatttatatggatgaccaagagctttgtatcaaagatacgggaatcgggataaaaaacagtgatgtcctccgagtatttgaacgtggcttttcaggatacaatggccgtttgacccagcagtcctctggacttggcctttatctatctaagaaaatttctgaagaactggggcaccagattcgtatcgagtctgaggtcggaaaaggaacgacagtgcggattcagtttgctcaagtgaacttagtccttgagtaa

SEQ ID NO: 580 - DNA, 1983 bp, Streptococcus pneumoniae
atgcttagaaactatgaaataataaaaaaggagaacatcatgattaacattactttcccagatggcgctgttcgtgaattcgaatctggcgtaacaacttttgaaattgcccaatctatcagcaattccctagctaaaaaagccttggctggtaaattcaacggcaaactcatcgacactactcgcgctatcactgaagatggaagcatcgaaattgtgacacctgatcacgaagatgcccttccaatcttgcgtcactcagcagctcacttgttcgcccaagcagctcgtcgtcttttcccagacattcacttgggagttggtccagccatcgaagatggtttctactacgatactgacaacacagctggtcaaatctctaacgaagaccttcctcgtatcgaagaagaaatgcaaaaaatcgtcaaagaaaacttcccatctattcgtgaagaagtgactaaagacgaggcacgtgaaatcttcaaaaatgacccttacaagttggaattgattgaagaacactcagaagacgaaggcggtttgactatctatcgtcagggtgaatatgtagacctctgccgtggacctcacgttccatcaacaggtcgtatccaaatcttccaccttctccatgtagctggtgcgtactggcgtggaaacagcgacaacgctatgatgcaacgtatctacggtacagcttggtttgacaagaaagacttgaaaaactaccttcaaatgcgtgaagaagctaaggaacgtgaccaccgtaaacttggtaaagagcttgacctctttatgatttcacaagaagtgggacaaggtttgccattctggttgccaaatggtgcgactatccgtcgtgaattggaacgctacatcgtaaacaaagagttggcttctggctaccaacacgtctacactccaccacttgcttctgttgagctttacaagacttctggtcactgggatcattaccaagaagacatgttcccaaccatggacatgggtgacggggaagaatttgtccttcgtccaatgaactgtccgcaccacatccaagtttttaaacaccatgttcactcttaccgtgaattgccaatccgtatcgctgaaatcggtatgatgcaccgttacgaaaaatctggtgccctcactggccttcaacgtgtacgtgaaatgtcactcaacgacggtcacctattcgttactccagaacaaatccaagaagaattccaacgtgcccttcagttgattatcgatgtttatgaagacttcaacttgactgactaccgcttccgcctctctcttcgtgaccctcaagatactcataagtactttgataacgatgagatgtgggaaaatgcccaaaccatgcttcgtgcagctcttgatgaaatgggcgtggactactttgaagccgaaggtgaagcagccttctacggaccaaaattggatatccagattaaaactgcccttggaaaagaagaaaccctttctactatccaacttgattttttgttaccagaacgcttcgacctcaaatacatcggagctgatggcgaagatcaccgtccagtcatgatccaccgtggagttatctcaactatggaacgcttcacagctatcttgattgagaactacaagggggccttcccaacatggctggcaccacaccaagtaaccctcatcccagtatctaacgaaaaacacgtggactacgcttgggaagtggccaagaaactccgtgaccgcggtgtccgtgcagacgtagatgagcgcaatgaaaaaatgcagttcaagatccgtgcttcacaaaccagcaagattccttaccaattaattgttggagacaaagaaatggaagacgaaacagtcaacgttcgtcgctacggccaaaaagaaacacaaactgtctcagttgataattttgttcaagctatcctagctgatatcgccaacaaatcacgcgttgagaaataa

SEQ ID NO: 581 - DNA, 390 bp, Streptococcus pneumoniae
atgaaggtggaaccacgttgcgacgtcctttcgaggatgtcgcatttttttattaggatactaattatggagttgcaagaattagtggagcgcagttgggcaatccgacaagcttatcacgaactggaagttaagcatcatgattccaagtggacggtagaagaagacctcttggctttatctaatgatattggaaatttccaacgactggtgatgacaaagcaaggacgctactatgatgaaacaccctacacactggaacaaaaactttcagaaaatatctggtggctattagaactttctcaacgtttggatatagacattctgacggaaatggaaaacttcctctctgataaagaaaagcaattgaacgttaggacttggaagtag

SEQ ID NO: 582 - DNA, 291 bp, Streptococcus pneumoniae
gcttgtcggattgcccaactgcgctccactaattcttgcaactccataattagtatcctaataaaaaaatgcgacatcctcgaaaggacgtcgcaacgtggttccaccttcatttatgtacctcaaaagagagggacacctctgatcggctctaacgtggccaccgttttatgttttcataaaaaactcaagagtagtatcagtttagacttcctatgcgtttccagcaaccacgcactctctagtagaaagggactaagtgacttgtctctatggattattatagcatga

SEQ ID NO: 583 - DNA, 210 bp, Streptococcus pneumoniae
gtgattatcatgcgtagattctattcccatctcccctactatctggtcatattattcttttattggccactttatgagttgttcttactagttgtttctgacccccttacactcaaggaactctatataaacaatcttctcttctttacacctctggtaatcttgattatatcgttactctatagctaccgtttccgtttctcactttga

SEQ ID NO: 584 - DNA, 630 bp, Streptococcus pneumoniae
atgaaactagcagttattgcagcaaatggacaagcggggaaagcaattgttgaagaagcagtcaaacgaggacatgaagtaacggctattgttcgttctgaaaacaaaagtcaagctgagtctattattaaaaaagatttatttgagttgacaaaagatgatcttactggatttgatgctgttatttcagcgtttggtgcttatacaccagatacgctaccgctccacagcaaatcaatcgaactatttaatcagcttcttgctggaacacagacacgttttctagttgtagggggagcaggaagtctttatatagatgaaacaaaaacgacacgacttttagatacgtctgattttcctgaagaatttaagtcactagcaaaagatcaagcggatgaattggatcttcttcgtacaaaaaataatctcaactggacttttgtcagtcctgctgtagattttattcccgatggtgaaaaaacaggaaactacattctagcaggagaaatttttactactaatgaaaaaggaataagccagattagttatgcagattatgctattggattggtagatgaacttgaaaaaggtcatcatataaaagaacgtatctctttacttgaaaaataa

SEQ ID NO: 585 - DNA, 270 bp, Streptococcus pneumoniae
atggcaatctcaaaagagaaaaaaaatgaaatcattgcacaatatgcacgtcacgaaggtgatacaggttcagtagaggttcaagttgctgtccttacttgggaaatcaaccaccttaacgaacacatcaaacaacacaaaaaagaccacgctacttaccgtggattgatgaaaaaaatcggtcgccgtcgtaacttgcttgcatacttgcgtaaaaacgacgttaaccgttaccgtgagttgatcaactctctaggacttcgtcgctaa

SEQ ID NO: 586 - DNA, 225 bp, Streptococcus pneumoniae
tctataaacgatttatctagcaagaatcatgatgctaagggcgtcaaaaatccgtatgaaaatagggaaatgacacagtgttcgatgagcacaaggagtttcatctttttcactaggattttagcccgggctcaaatcagctctctgacttcagagggcttttttattgaggttttatcggtaacaattttggagactacaaaaacctcaaacggtatcagctaa

SEQ ID NO: 587 - DNA, 477 bp, Streptococcus pneumoniae
atgggacagacaatcatatctgctattggtgtttatatttccaccagtatcgattatttaattattttaattattttatttgcacagctatcacagaataaacagaaatggcatatttatgcggggcaatatctaggcacaggcttacttgtaggggcgagtttagttgctgcttatgtcgttaatttcgtgcctgaagaatggatggttggattgcttggtttaatccctatctatttagggattcgctttgcaattgttggagaagatgcggaagaagaagaggaagaaattattgaaagattagaacaaagcaaggcaaatcaactgttttggacagttacattgctgacaattgcgtctggcggagataatttaggtatctatataccttattttgcttcgttagattggtcacagaccctcgtggccttgcttgtgtttgtaatcggcataattatcttttgcgagaattag

SEQ ID NO: 588 - DNA, 750 bp, Streptococcus pneumoniae
atgttttatacttatttgcgtggattagttgtattgctcttatggtccatcaatggcaatgctcactatcataatactgataaaattcctaatcaagatgaaaattatattttagttgcgcctcaccgtacctggtgggatcctgtttatatggcctttgcgaccaagccaaaacagttcatctttatggcaaaaaaagaactctttaccaaccgtatctttggttggtggattcgtatgtgtggcgcctttcccatcgaccgtgaaaatcccagcgcctcagccatcaaatatcctatcaacgttctcaaaaaaagtgaccgctctctcatcatgtttccaagtggtagccgccactcaaacgatgtcaaggggggcgcagcactgattgccaaaatggccaaggtccgtatcatgccggttacctacaccggtcccatgactttgaagggcttgattagccgtgaacgtgtcgatatgaactttggaaatccaatcgatatctcagatatcaagaaaatgaatgatgaaggcattgaaacagtcgccaatcgtattcaaacagaattccaacgtctggacgaagaaacgaaacaatggcacaatgataaaaaaccaaatccactctggtggtttatccgcatccctgccctcatccttgctattatcctcgctatcctaaccatcatctttagctttatcgcaagcttcatctggaacccagataagaaaagagaagaacttgcatag

SEQ ID NO: 589 - DNA, 2337 bp, Streptococcus pneumoniae
atggataaaaataagattatgggattaacccaaagagaagtcaaggaaagacaggctgagggtttggtcaatgactttaccgcatcagccagtaccagcacttggcaaatcgttaaacgaaatgtctttaccctttttaacgctttgaacttagccattgctttggctcttgcctttgtgcaggcttggagcaatctggtcttctttgctgttatctgctttaacgctttttctgggattgtgaccgagctacgagccaaacacatggtggacaagctcaatctcatgaccaaggaaaaggtcaaaaccatccgtgatggtcaggaagttgctcttaatcctgaagaattagtgctaggagatgtcattcgtttgtctgcaggagagcagattcctagtgatgccttggttttggaaggctttgcggaagtcaatgaagccatgttaacgggagaaagtgatttggtgcaaaaggaagttgacggcttacttttgtcaggaagtttcctagccagtgggtcagttttatctcaagttcaccatgtcggtgcagacaactatgctgccaaactcatgcttgaggctaagaccgttaaacccatcaactcccgtatcatgaaatcgctggacaagttggctggttttactgggaagattatcattccctttggtctggctctcttgctggaagccttgcttttaaaaggcctgcctctcaagtcatctgttgtaaactcgtcgacagctcttttgggaatgttgcctaagggaattgcccttttgaccattacttcgctcttgactgcagttatcaagctaggtttgaaaaaggtcttggtgcaggagatgtactctgttgagaccttggcgcgcgtggatatgctctgtctggacaagacgggtaccatcacccaaggaaagatgcaggtggaggctgttcttccgttgacggaaacgtatggtgaagaggctattgccagcatcttgactagctacatggcccatagtgaggataagaatccaactgcccaagccattcgccagcgttttgtgggagatgttgcttatcctatgatttccaatcttcccttctccagcgaccgcaagtggggggctatggagttagaaggcttggggacagttttcttaggggcacctgagatgttgctggattctgaagtcccagaagccagggaggccttggagagaggatcacgtgtcttggtcttagctctcagtcaggagaaattagaccatcacaaaccacagaaaccatctgatattcaggctctagccttgctggaaatcttggaccccattcgagagggagcagcagagacgctggactatctccgttctcaggaggtaggactcaagattatctctggtgacaatccagttacggtgtctagcattgcccagaaggctggttttgcggactatcacagctatgtagattgctcaaaaatcaccgatgaggaattgatggccatggcggaggagacagctattttcggacgtgtttcccctcatcaaaagaaactcatcatccaaacgttgaaaaaagcgggtcatacaacggctatgacaggggacggggttaatgatatcttggcccttcgtgaggcggattgttctatcgtgatggcggagggggatccagcaacccgtcagattgccaatctggttctcttgaactcagactttaatgatgttcctgagattctcttcgagggtcgtcgcgtggtcaataacattgcccacatcgccccgattttcttgataaagaccatctattccttcctgttagcagtcatctgtattgccagtgctttactaggtcggtcagagtggattttgattttccccttcattccgatccagattaccatgattgaccagtttgtggaaggtttcccaccattcgttctgacttttgagcgaaatatcaaacctgttgagcagaatttcctcagaaaatccatgcttcgtgccctaccaagcgctctcatggtcgtcttcagcgtcctgtttgtgaaaatgtttggcgcgagtcaaggttggtctgagttagaaatctcaactctactctattatctcttggggtcaattggtttcttatccgtatttagagcctgcatgccatttaccctatggcgtgtcctcttgattgtttggtcagtaggaggtttcctagccacagctctcttcccaagaattcaaaaactgcttgaaatttcaaccttaacagaacaaacgttgcctgtttatggtgtcatgatgttggtctttaccgtgattttcatcctgaccagtcgttaccaagcgaaaaaataa

SEQ ID NO: 590 - DNA, 231 bp, Streptococcus pneumoniae
tccttactatctcgcaaaaggagcaacaacgtttccatttgttcttgttttctagacacgatacacctcctttatgaatccattatatcgctttcaaaaaataatatacttcgcattttgtcctttgcaatggacatttttgtttttatcaaaaatatgatatcaaatagaacagaacctcactatgccaaaatcattttaccttttcttcataacatctattttagttga

SEQ ID NO: 591 - DNA, 1464 bp, Streptococcus pneumoniae
gtgtctagaaaacaagaacaaatggaaacgttgttgctccttttgcgagatagtaaggattatatatctgctaaagtattgggagaaaaattaaattgctctgataaaacggtttatcgccttgtcaagggaatcaacaaagattgtccggtagaagcattcattttatctgaaaaaggcagaggtttcaaattaaatccaagaagttccctcgtggacgttgatgggaattttacagaggcttttgatcctgaagtaaggcgtgaaaaattactagaacgtctcttgttgactgctcctaagccacattctatttatgatttaggagaggaattctacgtaagcgagtcagtagtactaaaagatcgtcagatattacaagagagtctagcaatttatgggttagatttaaaaatgagacaacgaaagctttttattgatggggatgaggctcaaattcgttcagccattctaaatctactgccaatgtttaatcagttggatttagagcaaattacacagaataaggttcagcctcttgacggagaacttgctcacttttgtttgggattactgattacacttgagagagaattgggggtaaacattccctatccatataatataaatattttctctcacctgtatatttttatcagtaggaatcgtcgtagtactagtattcatgttgtagcaccttcaaaacctactattgttgatgagaaaatttacagtgtctgtcaaaaaattattcaagaaattgaacaatattttaggatgaaggttgatgcagttgagattgactatctttatcaatacgttgtatcttcgagattgcaaaaaccattttcttccgggaagcttcctttttctcagcgagttttagatgtcactcattactattttagccgtatgtgtatggacaatagagagattgaaacgacagatcctgactttgttgacttggcgagtcatatcagtcccttactgaggagattagataatagagtacagattaagaatagtcttttatcacaaattcttttaacctatcctaatctggttaaagagttaacaactatttctaaagaagtgagtctagtatttggttttgcttccttgagtctggacgagattggttttctagtcttatattttgcacggtttcaagaaaagcgagcacgtcctctaaaaacagtagtgatgtgtacatcaggtgtcggaacttcagagcttttacgagcacgattagaaaagcaattttctgaattggatattattgatgtagttgcttatcatcaattagatgagctgataaatctatatccagatttagatttcattgtgacgacggtagctttgcaggaaccagcaagtgtcccgtttgtcctagttagtgtttttctaaccgagggtgataaacaacgtcttcaagcaaaaattcaggagataaactatgaataa

SEQ ID NO: 592 - DNA, 429 bp, Streptococcus pneumoniae
atgaataatctttcgcttgtccttatggatatatctgttcaaaatcgtcaagaagcctacaaagaattagcaaatcaaatcagccttcttgtttctgaagatacagaaaaaatagaagagcttctatattaccgtgagagacagggaagtatagaggttgctaaaggtgttcttctaccacattgtgaaggaaactttcaacatcatgtcttagtgattactagattaaaatcacctatcagagaatggtcgaaggatatccagtgtgttgaccttattatcggtttggccattgcagtatcacaggacaagtcatgtattaaaacattgatgagaagactagcagatgaatcattcataaatcaattaaaacagttaacaaaagaagaattacgggagataatatatggaaatcaaagatattcttaa

SEQ ID NO: 593 - DNA, 453 bp, Streptococcus pneumoniae
tatatggaaatcaaagatattcttaatgtgagtctgatccagacggatttacagatgcagagcaaagaagaggtttttgaggcattagctcaactattggttgagacgggttatgtgtctgatagagaccaatttatcgaaggtctttatcagagagaggcagaaggacagaccggtattgggaattatattgctattccccatagcaagagttctgctgtggagaaggcgggggtagtcatagctataaatcacaatgagattccttgggagaccattgatgggaaaggggtcaaagtaattgtactctttgcagttggtgatgatacagaagctgctagggagcatttgaagaccttatcactctttgctcgaaaacttggtaatgacgaagttgttgccaaattagttcgggctcagacatctgatgatgtgattgcagctttttgttaa

SEQ ID NO: 594 - DNA, 312 bp, Streptococcus pneumoniae
atgaaaattgttggtgttgcagcttgtactgtgggaattgcccacacttatattgcacaggaaaaattagagaatgccgcaaaggtagctggacatgtgattcatgttgagactcaggggacaataggggtagaaaatgaattgagtcaagagcagattgatgcagcggatgtagttattttagcagttgatgttaagatttctggtatggaacgctttgagggtaaaaagattatcaaggttccaacagaagtggcagtcaaatctcccaataaactgattgctaaagctgttgagattgttacgaaataa

SEQ ID NO: 595 - DNA, 1107 bp, Streptococcus pneumoniae
aaatatttaaggagaaaatatatgttgaaacacttaaacttaaaaggtcacttattgacagccatttcctatatgattccaattgtttgtggtgcaggattcttagttgccattggtttagcaatggggggtggtgttcctgacgctcttgtagcaggaaaattcactatctgggatgctttagcaactatgggtggtaaagcccttggtctcttgccagttgttattgctacaggtttgtcttactcgattgctggtaagccagggattgcaccaggttttgttgttggtctaattgccaattctgttggttcagggtttatcggtggtatcttgggaggttatatagctggtttcttggttcaagcgattattaaaaaggtcaaagtaccaaactggattaaaggtttaatgccaaccttgattattccttttgtagcctctttggtaagtagtttgattatgatttatattattggagcgcctatcgcagcctttaccaactggttgacgagcttattacaaagcttgggaagtgcttcaaatggtttgatgggggcagttattggagttctcagtgctgttgactttggtggcccacttaataaaacagtctatgcctttgtgttgactttacaggctgaaggtgtgaaagaaccattgactgctttgcaattggtgaatactgctacaccagttggatttggattggcctattttatcgcgaaattactcaaaaaaaatatctatactcaagaggaaatcgaaacattgaaatcggctgttcctatggggattgtcaatattgttgaaggtgtaattccgattgttatgaataacttggttccaggtctcattgcaacaggtatcggtggtgctgttggtggtgctgtttctttgacaatgggtgctgattctgccgtgccatttggtggagtgcttatgttaccaaccatgactcgtccagtagctggtatttgtgctttgttagccaacattgtagtcacaggacttgtctacgcgattttgagaaaaccaataaaacatacagaaccagttatgactgttgaagaagagattgatttgtcagatattgaaattttgtaa

SEQ ID NO: 596 - DNA, 696 bp, Streptococcus pneumoniae
atgtcaagaattgaattttcaccatctttgatgaccatggatttggacaaattcaaagagcagattacttttttgaatgataaagtagcatcttatcatatcgatattatggatggccattttgttcccaatattaccttgtctccttggttcattcaagaagttcaaaaaattagtgacacacctttatcagttcatctgatggtcacagacccaaccttttgggtagatcaagttctcgatttacaatgtgagtatatttgtattcatgctgaagttctgaatggtcttgcttttcgtttgattgataaaattcatgatgcaggtctaaaggctggtgttgtccttaatcctgaaacacctgtttctacaatctttccctacattgatttacttgacaaagtaactattatgactgtagatccaggttttgcaggacaacgctttttggagtctaccttgtataaaatccaagaactccgtcagcttagagttcagaatggttatcactacatcattgagatggatggttcttcgagtcgtaagactttcaaacaaattgatgtggcaggaccagatatttatgttataggtcgcagtggattatttggtttggatgacgatattgccaaagcctgggatatctgttctagagattacgaagaaatgaccggaaaaacaatgccaatcaaataa

SEQ ID NO: 597 - DNA, 1971 bp, Streptococcus pneumoniae
atgtcactacaatcagttaacgccattcgttttcttggcgtagatgctattaacaaatctaattctggtcacccgggaatcgtcatgggtgctgcgccaatggcttatagcctatttacaaagcaccttagaattacacctgagcagccaaactggattaaccgagatcgctttatcttgtctgcgggtcatggatcaatgctactgtatgctctcttgcatttaacagggtataaggatgtatccatggacgagattaaaaatttccggcaatggggatctaagacacctggtcatcctgaagtgacgcatacgtctggtgtggatgcgacatctggtccgcttggtcaggggatttctactgccgttggtttcgcccaagcagagcgttttttagctgctaagtacaacaaagatggttttcctatttttgaccattatacttatgttatcgctggagacggtgacttcatggaaggagtgtctgcggaggcggcttcttatgcaggtcatcaagctttagataagcttatcgtcctctacgactccaacgatatctgcttggatggtgagaccaaagatactttctctgaaaatgttcgcgcccgttacgatgcttatggttggcatacagttctggtagaagatggaacagatttagcagcaatttctacagcaattgagacggccaagttttctggtaagccgagtttgattgaagtgaaaacggtaattggttacggctcacccaataaaagtggtacaaatgctgttcatggtgcaccactaggagcagaagaaacaggagcaactcgtaagtttttgggatgggattacgatccatttgaagtaccagaggaagtatattctgatttcaagacaaatgtagcggatcgtggtcaggaggcatacgatgcttgggctagtttggtgtctgattacaaggttgcttatcccgaagttgctagtgagattgacgctattgtagctggaaaatcccctgtaaccattactgaaaaagacttccctgtctatgagaatggcttctctcaagcaactcgtaattcgtcccaagatgctattaatacagcagcagcagttttaccaaccttcttaggtggatcggcagacttagctcactccaacatgacctacatcaaggcagatggcttacaagataaatataatccattaaaccgcaatattcagtttggggtacgtgaatttgccatgggaacaatcctcaatggaatggctcttcatggtggtttacgagtttatggcggaaccttctttgttttctctgactacgtcaaagctgctattcggctatcagccattcaggagttgcctgtaacttatgtctttacccatgattcaattgccgttggtgaagatggtccaactcatgaaccagttgaacatttggcaggtttacgctcaatgccaaacttgactgttatccgtccagcggatgcccgtgaaactcaagcggcttggcatcatgccttgaccagtaccaccactccaactgtcattgtcttaacccgtcaaaacttggtagttgaagaagggacagactttggtaaggtcgctaaaggagcctacgtcgtgtatgataccccgggatttgatactattatcattgctacaggatctgaggtcaatctagctatcaaagctgctaaggaattggttttacaaggtggtaaagtacgtgtggtatctatgccctcaaccgaactatttgatgctcaagatgctacctacaaggaagacattttaccatctaagactcgtcgtcgtgtggccattgaaatggcagcgacccaaagttggtacaagtatgttggtttggatggcgcggtcatcggtattgacatcttcggtgcgtctgccccagctcagactgtgattgataattatggatttacggtagagaatatcgttgctcaagttaagtccctatag

SEQ ID NO: 598 - DNA, 573 bp, Streptococcus pneumoniae; identical to SEQ ID NO: 19

SEQ ID NO: 599 - DNA, 573 bp, Streptococcus pneumoniae; identical to SEQ ID NO: 19

SEQ ID NO: 600 - DNA, 834 bp, Streptococcus pneumoniae
atgactgagttttcgttagatcttcttctaaaagccattaaactagctcgttcgacctactactatcacttgaaacagctagataaaacagataaggaccaagagcttaaagctgaaattcaatccatttttatcgaacacaagggaaattatgcttatcatcggatttatttagaactaagaaatcgtggttatctggtaaatcataaaagagttcaaggcttgataaaagtactcaatttacaagctaaaatgcgacaaaaacgaaaatattcttctcataaaggagacgttggtaagaaagcagagaatctcattcaaggccaatttgaaggctctaaaacaatggaaaagtgctacacagatgtgacagaatttgccattccagcaagtactcaaaagctttacttattaccagttttagatggctttaatagcgaaattatcgcctataatctttcaacttcacccaacttagaacaagtacaaacaatgttggaacaggcattcacagagaagcactacgagaatacgattctccatagtgaccaaggctggcaatatcaacacgattcttatcatcggttcctagagagtaagggaattcaagcatctatgtcacgcaagggaaacagcccagacaacggcatgatggaatctttctttggcattttgaaatcggagatgttttatggttatgagaagaactttagatctttagaaaaccttgaacaagctattgtggactacattgattactacaacaacaaacgaattaaggtaaaactaaaaggacttagccttgtgcagtacagaactaaatccttcggataa

SEQ ID NO: 601 - DNA, 531 bp, Streptococcus pneumoniae
ttgctagatgaaaaaaggaagaactatgtagaagataagagacaaaatttccctagtctccctaactggaaaatggatttattttcagaagaagaaaaaaggaattattttcaaaccacatgtgaaatttcaagtaaagactctgcaataaataaatacaaaatggaaaaaattattaagagatcaaataaaggaaatgtttatcgggcaattagaaaatcggacgggcaaaaagtaatcatcaagcagtcaagaccttttgtgaattatgatgctgaaggagaatggacagctcttgatgatataaaaaatgaagctcacatgctaaaaaaattagccgataaaagttatactactaatttaactgatgaattttatatcgtggatgattattttcttgttcaggaacaagttgacgggttaaactttgaagaatttattcgagaaacagaacactccttaaatattagagaaaaaacactgtataacattgtgaatatagtaagtgacatccataaactgggaatataa

SEQ ID NO: 602 - DNA, 417 bp, Streptococcus pneumoniae
atggatttattagagaaagaatgtttaaaatgtgataaaaatttccaacagggtgatatttggaattactattatttatcagataaggtgcctgcacaagggtggaaaatacacataagctcccaaataaaagacgctgtaaatatttttaagattgtgtataaactatcccaactaaataattgtagctttaaagtcgttaaaaatttagaggaattaaaaaaaattaattcccctagggaaatgagccctactgctaacaaatttataactctatatcctaagtcagaatctgaagctaagagtatgatttgtaatcttacgaatagactgtcagaatttaaggctccaaaaatactatctgactatcaatgtggaatgcattctctagttcattatagatatggggctttttaa

SEQ ID NO: 603 - DNA, 678 bp, Streptococcus pneumoniae
atgatttcaaagagattagaattggtagcttcctttgtgtcacagggggctattttactagatgtgggaagtgaccatgcttatctgcctatcgagttggttgagagaggccaaatcaaaagcgctattgcaggtgaggtggtggaaggtccctatcagtctgcggttaaaaatgttgaggctcacggcctaaaggagaaaatccaagtccgtttagccaatggcttggcagcttttgaagagactgaccaagtgtctgtcattaccattgctggcatgggtggtcgtttgattgctaggattttagaagaaggtttggggaagttagctaatgtagagcgtttgatcctccagcccaataatcgtgaagacgacttgcgtatctggctacaggatcatggattccagattgtagcagaaagcatcttagaagaagctggaaagttttatgagattttggtggtggaagcaggacaaatgaagctatcagccagtgatgttcgctttggtcccttcttgtccaaagaagtcagtccagtatttgtccaaaaatggcaaaaagaagctgagaagctagagttcgccctcggacaaatcccagaaaaaaatctggaagaacgtcaagttctagtagataagattcaagctatcaaggaggtgctccatgttagcaagtga

SEQ ID NO: 604 - DNA, 798 bp, Streptococcus pneumoniae
atgttagcaagtgaagtgatccaagcttatgaagccttttgccctcaggaattttctatggagggagacagccgtggtctgcaaattggcactttagacaagggtatccaaagggtcatggttgccctcgatattcgtgaagagacggtggcagaggccattgaaaagggtgtggacttgattatcgtcaagcacgcgcctatctttcgtcctatcaaggacttgcttgccagccgtccgcaaaatcagatttacatcgacctgattaagcatgatatcgcagtttatgtcagccataccaatattgatatcgttgaaaatgggctcaatgactggttttgtcagatgctaggaatcgaggagacgacttatctgcaggaaacaggtccagaacgtggaattggacgtattgggaatattcagcctcagacattttgggaattggcccaacaggtcaagcaagtctttgacctagatagccttcgaatggtgcattatcaagagaatgatttgcagaagcctatttcaagagtagcaatttgtggtggaagcgggcagtctttctataaggatgctttggcaaagggggcagatgtctatatcactggcgacatctactaccatactgctcaggatatgctgtctgatggcttgttagcattggatccaggtcactatatcgaagtgctttttgtggaaaaaatcgcagcactccttactcaatggaaagagaaaaaaggctgggaactagagattttacctagtcaagcatcgaccaatcctttccgtcatatctag

SEQ ID NO: 605 - DNA, 1104 bp, Streptococcus pneumoniae
atgaaaaaagttgccattattggagcaggaattgtgggagcaacagctgcctactacctctcgagagaaagtgacctagaggtgaccgtttttgaccatgagcaaggtcaagccaccaaggccgcagcaggaattatcagtccttggttttccaaacgccgtaataaagcctggtacaagatggcgcgcttgggggctgatttttatgtggatttattagctgatttagagaaatcaggacaaaaaatcgacttttaccagcgttcgggagtctttctcttgaaaaaggatgaatccaagttggaagaactttatcaactggccctccagcgcagagaagaatctcccttgatagggcaattagccattctggaccaagcttcagctaatgaattattccctggtttgcagggatttgaccgcctgctctatgcttctggtggagcgagagtagatggccaactcttggtaactcgtctgctagaagccagtcatgtcaagctggtcaaagaaaaagtgactctgacactcttatcatcaggctaccagattggcgaagaggtgtttgatcaggttattttggcaacgggagcttggttgggggacatgttagagcctttaggttatgaagtggatgtccgtcctcaaaaaggacaactacgagattatcagcttgcccaagacatggaagcttaccctgttgtcatgccagaaggggagtgggatttgattccctttgcaggtgggaaattatccttgggcgctacccatgaaaatgacatgggatttgatttgacggtagatgaacccttgctccaacaaatggaggaggcggccttgcctcattacccagttttagctagagcgacttcaagggctgagcgtgtgggaatccgtgcctataccagtgatttctctcccttctttgggcaggtgccagaattggcaggtgtctatgcaggcagtggactaggttcatcaggcctcacaactggtcctatcattggttaccatctagcccaactgatccaagacaaggagttgaccttggaccctctaaattacccaattgaaaactatgtcaaacgagtaaaaagcgaataa

SEQ ID NO: 606 - DNA, 192 bp, Streptococcus pneumoniae
atgaaaatcaaagaacaaactaggaaactagccgcgggttactcaaagcactgctttgaggttgtggatagaactgacgaagtcagctcaaaacactgttttgaggttgtagatagaactgacgaagtcagtaaccatacccatggcaaggcgacgttgacgtggtttgaattggattttcgaagagtataa

SEQ ID NO: 607 - DNA, 1020 bp, Streptococcus pneumoniae
atgcaagaaaagattttggtaactggtggtgccggttttattggaacccacactgttattgaattgatccaagcaggccatcaagttgttgtggtggataatcttgtcaatagcaatcgtaagagtttagaagttgttgaaagaatcacaggagttgagattcctttctatgaggcagatattcgtgacacagataccctcagagatattttcaagcaggaagaaccgactggtgtcattcactttgctggtttgaaggctgttggcgaatcaacacgtatccctcttgcctactatgacaacaatatcgctggaactgtcagccttttgaaagccatggaagaaaacaactgtaaaaacatcatcttcagttcttctgcgacagtttacggggatccgcacacagtgcccatcttggaagatttcccactttcagtgaccaacccatacggtcgtactaagctcatgctagaggaaattttgactgatatttacaaagcagactcagaatggaatgttgtcttgcttcgttactttaacccaatcggagcccatgagagtggtgatttgggagaaaatccaaacggtattccaaacaatctcttgccatatgtgactcaagtagccgttggaaaattagagcaagtgcaagtgtttggagacgattacgatacggaagatggaacaggtgttcgtgactatatccacgttgtcgatttggctaagggtcacgttgcagctttgaaaaaaatccaaaaaggttcaggactaaacgtttataaccttggaactggtaaaggttactcagttcttgaaattatccaaaacatggaaaaagcggtgggacgtcctattccttaccgcatcgtagaacgtcgcccaggtgatatcgctgcctgctactcagacccagcaaaagctaaagcagaactcggttgggaagcagaactcgacatcacccaaatgtgtgaagacgcatggcgttggcaaagcaagcatccaaatggatttgaagactaa

SEQ ID NO: 608 - DNA, 954 bp, Streptococcus pneumoniae
atgatgatttcaatcatcgtcccttgtttaaacgaagaggaagtacttcctcttttttatcaggctctggaagctttacttccagatttggaaacagaaatcgagtatgtctttgtcgatgatggatcaagtgatgggaccttggaactcttaaaggcctatcgggagcaaaatccggcagtccattatatttctttctctcgaaattttggcaaagaagcagccctttatgcaggcttgcaatatgcgacaggagatttggtggtggtgatggatgcagacctccaagatcctcctagtatgttgtttgagatgaaaaatgtactagacaaaaatgtagacttggactgcgttgggacacggagaactagtcgggagggagaacccttctttcgcagtttctgtgctgttctcttttatcgcctcatgcaaaaaatcagcccagtagctctgccgtcgggtgtccgtgactttcgtatgatgagaaggtctgtggtcgatgccattttaagcttgactgagtccaatcgtttttctaagggactctttgcctgggtcggctttaaaacccactatctggactatccaaatgtcgaaaggcaggctggcaagaccagttggagttttaggcaactctttttttactccattgaagggattgttaatttttcagatttccctttgactatagcctttgtagctggtctcctatcttgttttctttctctgctgatgaccttttttgttgtggttcggaccctcattttgggcaatccgacatctggttggacctctctgatggctgttattctctttcttggaggcattcaactcttgaccattgggattctcggtaagtatatcagtaagatttatttagagactaaaaaaagaccactttatcttatcaaagaaaaaagtgatgataggctaaaaaagatagaatttatctga

SEQ ID NO: 609 - DNA, 666 bp, Streptococcus pneumoniae
atgctaagtaaagaggattatactgaagaaatcgggctaataaagaaacaaaattatgtagaggctgaattgtatcctatagttgctgatataattaagccaactttaaaagatagtttatcaaaaagatatgtcttcggaagacaaagaaggggtttgggacaaatttattatggtctaagtaattttcctgatatagttattttagataagacttatgaaaacaaatctaggaaaagtataaaaattgaagaatggaagaaacttcgaggatgcgtggaagttaagaatttaaattatagtttaattacagaggaaaaaatcaaatcaaccatatcgaacagttttgaacatataactggagagatggaacaactaactggagagatgggacaacttattggagaccttttatggtataaaaaagtaatttatacaaatggaattgaatggagatttctaagtttagatgacaaggaagagatagataatacaattgttgaagtagttaacaaaagaatagaaacagaagaagcgggaaattcttttgattggtggaagaatattaaagatttatcgttcaattatacggatatatgcctatctaaagattgtagacaagagtggaatgaatttgtaaaaagggtaaaggaaatagaatggtag

SEQ ID NO: 610 - DNA, 207 bp, Streptococcus pneumoniae
atgaaaatcacacttatacctgaacgatgtatcgcctgtggactttgccaaacttattctgatttatttgattaccacgataatggaatcgtgcgtttttacgatgaccctgaccaactggaaaaagaaatttctcctagtcaggatgtcttagaggctgttaaaaattgcccaactcgcgccctgattggaaaccaggaagcctaa

SEQ ID NO: 611 - DNA, 477 bp, Streptococcus pneumoniae
atggcaaaagaaccgtggcaagaagatatttatgatcaagaagaatcaagagcagggcgtcggcatcgaaaccacggaggggctgataggatggctaatcgtattttgacgatcctagctagtattttctttgtaattgtggtggtgatggtcatcgttctcatctatctatcatcgggggggagtaatcgcacagcagccttaaaagactttcatgattctgatgcaagtgtagtacaaatctcatcttcaagcagttctcagcctgagcagagttcagagccagaatctacttctagtagttcagaagaagctgctaatcctgaaggaacgattaaagttctcgcaggagaaggggaagcagctattgccgctcgtgcaggaatctccattgctcagttagaggccttgaatcctgggcacatggctacaggatcttggtttgctaatccaggtgatgttataaaaataaaatag

SEQ ID NO: 612 - DNA, 672 bp, Streptococcus pneumoniae
atgaaaacaattcaaattgctattgatggtcctgcttccagcggtaagagtacggtcgcaaagattattgctaaggattttggattcacctaccttgatacaggagctatgtatcgtgcagcgacctatatggctcttaagaaccaattaggagttgaagaagtcgaagcccttctagccttgttggaccagcatccaatcagctttggacgttcagaaactggagaccagcttgtttttgtaggagatgtggatattacccatcctatccgtgaaaatgaagtgaccaatcatgtttctgctattgcagcaattcctcaagtgcgtgagaaactggtttctctccaacaagaaattgcccagcaaggcgggattgtcatggatggtcgcgatattggaactgttgtattgccacaagcagaattgaaaattttcctagtagcttctgttgatgagagagcagagcgtcgttacaaggaaaatattgccaagggaattgaaacagaccttgaaaccctaaaaaaggaaattgctgcgcgtgactacaaggatagtcatcgtgagacttctcctctcaaacaagcagaggatgctgtctaccttgatacaactggtttgaacattcaagaagtagttgaaaaaatcaaagcagaagctgaaaaaagaatgtaa

SEQ ID NO: 613 - DNA, 339 bp, Streptococcus pneumoniae
atgaacaatttaccaaattgtccaaaatgtaactcagaatatgtctacgaagacggtgccctactggtttgcccagagtgtgctcatgagtggaatcctgctgaagttgcagaagtagaagaaggtcttgtcgctatcgatgccaacggaaataaattggctgatggtgatatagtaactctcatcaaggacttgaaagtaaaaggtgcgccaaaagatttgaaacaagggacgcgcgtgaaaaatatccgcatcgtagaaggcgaccacaatatcgactgtaagattgatggttttggtgccatgaaacttaaatcagagtttgtgaggaagatttaa

SEQ ID NO: 614 - DNA, 630 bp, Streptococcus pneumoniae
atgtcaaaacactataaacttgtattttatagccgtatcttcttgtttctagcggcttttacgggagtttatcttgaaattactaggcatggtggttttgggatgcttctctattacacggttctgtccaacctcttggtaactatttttaccctttatcttctaaaggttatgagccgtgtaggtgaaaattggcaaaggccaagtctcttgcgcttaaaaggtggggtcaccatgagtatcatgattacctgtgtgatttaccatttcctcttggcgcccattgcgactaatttctataccctagaaaatttcctttgccactatatcgttcccatctggtttttagcggataccctcttttttgacaaacagggtcaatacaagatttgggatccagcagtgtggaccattttaccctttctgtatatgatgtttgctctttttaatggcttggttctaaaactcaatattccaaatgccaaggataatcctttcccttacttctttttgaatgtgaacaagggttggaatgttgtgtttaagtggtgtctgattatctttgttgcctatatggtagcaggatttattttctactttatcaagcaaatcaagagaaagtcatcctaa

SEQ ID NO: 615 - DNA, 228 bp, Streptococcus pneumoniae
gtggtgtctgattatctttgttgcctatatggtagcaggatttattttctactttatcaagcaaatcaagagaaagtcatcctaatactcttcgaaaatctcttcaaaccacgtcagtttccatctgcaacctcaaaacactgttttgaacaacctgcggctagcttcctagtttgctctttgattttcattgagtataagatacaagggattcattttcgaatttaa

SEQ ID NO: 616 - DNA, 1152 bp, Streptococcus pneumoniae
atgaaacaatttttagaacgggccagcattttggctctctccctcgttttgattacctccttttccatttcgagtgccctaccagccatgtttgactattatcagggttattctaaggaacaaattgagctcttggtgagcttgccttcctttggaatcatgatgatgttactgctaaatggtttcttagaaaaaatatttcctgagcgcttacagattagtttgggcttgctgattttatcattgagcggtacagctcccttctggtaccaagcctatccctttgtctttggaacacggcttctctttggtttgggtcttgggatgatcaatgccaaggccatttctattatcagtgaacgctaccaaggaaaaaggcgaattcagatgttagggctacgcgcttctgcagaggtcgttggagcttctatcattaccttggccgtcggtcagttgttggcttttggttggacagctatctttctagcctatagtgctggatttttggtgctgcccctttatctgctctttgtcccttatggaaaatcaaagaaagaagtcaagaaaagagcgaaggaagcaagtcgtttaactcgagaaatgaaaggcttgatttttaccttagctatcgaagcggcagttgtagtttgtaccaatacagctattaccatccgtattccaagtttgatggtggaaagaggattgggggatgcccagttatctagttttgttcttagtatcatgcagttgatcgggattgtggctggggtgagtttttctttcttgatttctatctttaaagagaaactgctcctctggtctggtattacctttggcttggggcaaatcgtgattgccttgtcttcatccttgtgggtggtagtagcaggaagtgttctggctggatttgcctatagtgtagtcttgacgacggtctttcaacttgtctctgaacgaattccagctaaactcctcaatcaagcaacttcatttgctgtattaggctgtagtttcggagcctttacgaccccattcgttctaggtgcaattggcttactaactcacaatgggatgttggtctttagtatcttaggaggttggttgattgtaatctctatctttgtcatgtacttacttcagaagagagcttag

SEQ ID NO: 617 - DNA, 750 bp, Streptococcus pneumoniae
atgacgagatataaagcaactatttcctatgatggttatgcctttgatggctttcagcgccagcctcatgcgcgtagcgttcaggaagaaattgaaaaaaccttgaccagattaaataaagggcaaaccattactgttcacggtgctggtaggacagatagtggggttcatgccctgggacaggtcattcattttgacctgccttatcagatggatgaggagaaactccgttttgccttggatacccagtctcctgaagatattgatgtgatttcgattgagcttgtggcagatgattttcattgccgttatgccaaacatagcaagacctatgagtttattgtggatagaggacgtcccaaaaatcctatgcgccgtcactatgccacccactttccctacccactcgatgtggaacgaatgcagattgcaatcaaaaagctagagggaacccatgattttaccggttttacagcctctgggactagtgtagaggataaggttcgcaccatcacagaagctagtttaatagtcgatgagacaggacaatttttgacctttaccttttcaggaaatggtttcttgtataaacagattcgcaatatggtggggactcttctcaaaatcggtaacaaccgcatgccagtagagcagattgctctcatcttggagaagaaggacaggcaacttgcaggtcccactgcagcaccaaatggtttgtatttaaaggagattcgttatgaagaataa

SEQ ID NO: 618 - DNA, 774 bp, Streptococcus pneumoniae
atgaagaataatcgtattttagcactttctggaaatgatatttttagtggtggtggactgtcagctgatttggctacctataccttgaacggcttgcatgggtttgtagcagtgacttgtttgacagccttgacagaaaaaggatttgaagtctttccaactgatgataccatttttcaacatgaattagatagcttgcgtgatgtggaatttgggggaattaagattggtcttctccctactgtcagtgtggctgagaaggccttggactttatcaaacaacgcccaggagtacctgtggtgttggatcctgtcttggtctgcaaggaaacgcatgatgtagctgtcagtgagctctgccaagagttgattcgcttcttcccttatgtcagtgtgattacgcctaatctcccagaagcagaattattatccggtcaggaaattaaaaccttggaagacatgaaaactgcagcgcagaaattgcatgatttaggagcgccagcagtcattatcaagggaggcaatcgtcttagtcaggacaaggctgtggatgtcttttatgatggacagacctttactatcctagaaaatccagttatccaaggccaaaatgctggtgcaggttgtacctttgcctctagcattgccagtcacctggttaaaggtgataaatttttgccagcagtagaaagctctaaggctttcgtttatcgtgctattgcacaagcagatcagtatggagtaagacaatatgaagcaaacaaaaacaactaa

SEQ ID NO: 619 - DNA, 462 bp, Streptococcus pneumoniae
atgaagcaaacaaaaacaactaaaatcgcccttgtatccctattaaccgccctttctgtggttctaggttatttcttaaaattcccaacacctacaggaattctaactcttttagatgctggtgtcttctttgcggccttttactttggtagtcgtgaaggagcggtagtcggaggactagcaagtttcttgattgacctcttatcaggctaccctcagtggatgttctttagcttggtcaaccatggcttgcagggatttttcgcaggatttaaaggaaaaagtcagtggttaggccttattttagcaactattgccatggtaggaggctacgccttgggttctactttgatgaatggctgggcagcagccctcccagaaattctaccgaattttatgcaaaatatggtagggatgattgtaggatttattcttagtcaaagtatcaagaagattaagtaa

SEQ ID NO: 620 - DNA, 573 bp, Streptococcus pneumoniae; identical to SEQ ID NO: 19

SEQ ID NO: 621 - DNA, 273 bp, Streptococcus pneumoniae
atgactgagttttcgttagttcttcttctaaaagccattaaactagctcgttcgacctactactatcacttgaaacagctagacaaaacagataaggaccaagagcttaaagctgaaattcaatccatttttatcgaacacaagggaaattatgcttatcgctgtattcatttagaactaagaaatcgtgcttatctggtaaatcataaaagagttcaaggcttgataaaagtactcaatttacaagctaaaatgcgacagaaacgaaaataa

SEQ ID NO: 622 - DNA, 594 bp, Streptococcus pneumoniae
aagtactcaatttacaagctaaaatgcgacagaaacgaaaataaaggagacgttggtaagaaggcagagaatctcattcaaggccaatttgaaggctctaaagcaatggaaaagtgctacacagatgtgacagaatttgccattccagcaagtactcaaaagctttacttatcaccagttttagatggctttaatagcgaaattatcgcctataatctttcaacttcgcccaacttagaacaagtgaagagtatgttagaacaggcctttacagagaagcactacgagaatacgattctccatagtgaccaaggctggcaataccgacacgattcttatcatcggttcctagagagtaagggaattcaagcatccatgtcacgtaagggtaacagcccagacaatggtatgatggagtccttctttgggattctgaaatcggaaatgttttacggttttgagaagtcgtttcagtcgcttaagcaattggaacaagctattatagactatattgattactacaacaataaacgaattaaggtaaaactaaaaggacttatccctgtgcaatacagaactaaatccttcggataa

SEQ ID NO: 623 - DNA, 477 bp, Streptococcus pneumoniae
atgaagtggaccgcgctgcccgtgaggtcatcgaaaaagctggttatggtgagtacttcaaccaccgtctcgggcatggtatcggtatggatgtccatgaattcccatctatcatggaaggaaacgacatggtcatcgaagaaggcatgtgcttctctgttgaaccaggtatctatatccctggtaaagtcggtgttcgtattgaagactgcggtgttgttaccaaggatggcttcgacctctttacaagcaccagcaaagatttgctttattttgattaaactatatagcccctatgctttcctttcaaaatatctaggggctattttattgtcatttttctgctattatgctaaagaaattggctgcaataatctaaccctaagtgtctggaatgataacgagggtgctctccgcttttatcaaagacaagggatgaaaccccaagaaacaacaatggaaatgataattgattaa

SEQ ID NO: 624 - DNA, 1083 bp, Streptococcus pneumoniae
atgtctaaattacaacaaatcctaacatatcttgaatcagaaaaactagacgtcgctgtcgtatctgaccccgtcacaatcaattacctcactgatttttacagtgatccccatgaacgccaaatgttcctctttgtcctagcagatcaggaacctctcctctttgtcccagctcttgaagtagaacgtgcaagtagcaccgtttccttcccagtagtgggctatgtcgattctgaaaatccatggcaaaaaatcaaacatgctcttccacaacttgacttcaaacgtgtcgctgttgagtttgacaatctcatcttgaccaaataccatggtttgaaaacagtttttgagactgctgagtttgacaacctcactcctcgtatccaacgcatgcgcctcatcaaatcagctgatgaagtgcaaaaaatgatggttgcaggtctttatgctgacaaggctgttcatgttggttttgacaatatttctcttgataagactgagacagatatcatcgcacaaattgactttgccatgaaacgtgaaggttacgaaatgagctttgataccatggtcttgactggtgataatgctgcgaatccacacggcattccagcagctaataaggttgaaaatgatgctcttctcctctttgacctgggtgttctggtcaatggctatgcgtcagatatgactcgtacagtcgctgtcggcaaaccagaccaattcaagaaagatatttacaacttgactcttgaagcccaacaagctgctcttgactttatcaagccaggtgtgactgctcatgaagtggaccgcgctgcccgtgaggtcatcgaaaaagctggttatggtgagtacttcaaccaccgtctcgggcatggtatcggtatggatgtccatgaattcccatctatcatggaaggaaacgacatggtcatcgaagaaggcatgtgcttctctgttgaaccaggtatctatatccctggtaaagtcggtgttcgtattgaagactgcggtgttgttaccaaggatggcttcgacctctttacaagcaccagcaaagatttgctttattttgattaa

SEQ ID NO: 625 - DNA, 783 bp, Streptococcus pneumoniae
atggtttatacttcactttcctcaaaagatggcaattacccctatcagctcaacattgcccacctctacggaaatctcatgaatacctacggggacaatggaaacatcctcatgctcaagtatgtggctgaaaaactgggagcccatgtgaccgttgacatcgtttctctccatgatgactttgatgaaaatcactacgacatcgcctttttcggtggtggtcaagactttgaacaaagtatcattgcagacgacctacctgctaaaaaagagagcattgacaactacatccaaaacgacggtgtagttctggctatctgcggtggtttccaactattgggtcaatattatgttgaagcttcaggaaaacgtatcgaagggctaggggtcatgggacactacacgctcaaccagaccaataaccgttttatcggtgacatcaagattcacaatgaagatttcgatgaaacctactatggatttgaaaatcaccaaggtcgtaccttcctctctgatgaccaaaaaccgctgggacaggttgtctatggaaatggaaacaacgaagaaaaggtcggtgaaggggttcattataagaatgtctttggttcctacttccacgggcctatcctctctcgtaatgccaatctggcttatcgcctagttactactgccctcaagaagaaatatggtcaggacatccaactccctgcctatgaggacattctcagccaagaaatcgctgaagagtacagtgacgtcaaaagcaaggctgacttttcttaa

SEQ ID NO: 626 - DNA, 1344 bp, Streptococcus pneumoniae
atgaacttaaaaactactttgggccttcttgctggacgttcttcccacttcgttttaagccgtcttggacgtggaagtacgctcccagggaaagtcgcccttcaatttgataaagatattttacaaaacctagctaagaactacgagattgtcgttgtcactggaacaaatggaaaaaccctgacaactgccctcactgtcggcattttaaaagaggtctatggtcaagttctaaccaatccaagcggtgccaacatgattacagggattgcaacaaccttcctaacagccaaatcttctaaaactgggaaaaatattgccgtcctcgaaattgacgaagccagtctatctcgtatctgtgactatatccagcctagtctttttgtcattactaatatcttccgtgaccagatggaccgtttcggtgaaatctatactacctataacatgatattggatgccattcggaaagttccaactgctactgttctccttaacggagacagtccacttttctacaagccaactattccaaaccctatagagtattttggttttgacttggaaaaaggaccagcccaactggctcactacaataccgaagggattctctgtcctgactgccaaggcatcctcaaatatgagcataatacctatgcaaacttgggtgcctatatctgtgagggttgtggatgtaaacgtcctgatctcgactatcgtttgacaaaactggttgagttgaccaacaatcgctctcgctttgtcatagacggccaagaatacggtatccaaatcggcgggctctataatatctataacgccctagctgctgtggccatcgcccgtttcctcggcgcagattcccaactcatcaaacagggatttgacaagagccgtgctgtctttggacgccaagaaacctttcatatcggtgacaaggaatgtacccttgtcttgattaaaaatccagtcggtgcaacccaagctatcgaaatgatcaaactagcaccttatccatttagcctatctgtcctccttaatgccaactatgcagatggaattgacactagctggatctgggatgcagactttgagcaaatcactgacatggacattcctgaaatcaacgctggcggtgttcgtcattctgaaatcgctcgtcgcctccgagtgactggctatccagctgagaaaatcactgaaacgagtaatctggagcaagttctcaagaccattgagaatcaagactgcaagcatgcctatattctggcaacttatactgccatgctggaatttcgtgaactgctggctagtcgtcagattgttagaaaggagatgaactaa

SEQ ID NO: 627 - DNA, 1317 bp, Streptococcus pneumoniae
atgttaacatacgatttaattgttattggatttggtaaagctggtaaaacactagcaggtaaattggcttcagctggcaaaaaagttgccctcgttgaacgtagcaaagctatgtacggtggaacttgtatcaacatcggttgtatcccaactaaaactttgctggttgctgctgagaaagacttgtcttttgaagaagtcattgctaccaaaaacacgatcactggtcgcctcaacggtaaaaactatacgactgttgctggtactggcgtcaatatctttgatgctgaagctcacttcctttcaaataaagtcatcgaaatccaagctggtgatgaaaaacaagaattgactgctgaaactatcgtcatcaacactggtgctgtttcaaacgtcttgccaatccctggacttgctacaagcaaaaacgtctttgactcaacaggtatccaaagcttggataaattgcctgaaaaacttggagtccttggtggcggaaatatcggtcttgaatttgctggcctttacaataaactaggaagcaaggttacagtcctagatgccttggatacattcctacctcgtgcagaaccttccatcgcagctcttgctaaacaatacctggaagaagacggtattgaattgcttcaaaatatccatactactgaaattaaaaacgacggtgaccaagtgcttgtcgtaactgaagacgaaacttaccgtttcgacgcccttctctacgcaactggacgcaaaccaaatgtagaaccacttcaacttgaaaatacagatattgaactaactgaacgtggcgctattaaagtagataaacactgtcaaacaaacgttcctggtgtctttgcagttggagatgtcaacggtggtcttcaatttacttacatttcacttgatgacttccgtgttgtttacagctaccttgctggagatggcagctacacacttgaggaccgtctcaatgtgccaaatactatgttcatcacacctgcactttcacaagttggtttgactgaaagccaagcagctgatttgaaacttccatacgcagtgaaagaaatccctgttgcagccatgcctcgtggtcacgtaaatggagaccttcgcggagctttcaaagctgttgttaatactgaaacaaaagaaattcttggtgcaagcatcttctcagaaggttctcaagaaatcatcaacatcattactgttgctatggacaacaagattccttacacttacttcacaaaacaaatcttcactcacccaaccttggctgagaacttgaatgacttgtttgcgatttaa

SEQ ID NO: 628 - DNA, 873 bp, Streptococcus pneumoniae
  unsure (697): n at each above location is unknown.
atgaaatcgaatcgttatattattgcccttgctggggtcattttacacttaatgctgggttcgacttatgcttggagtgtttatcgtaaccctattattgaaaaaacgggatgggatcaggcttctgttgccttcgcctttagtctagcaatcttttgtttgggcttatcggctgcatttatggggcgtttggtagaaaaatttggtccgaaagtcatggggagtctatctgcttttctatacgcaggtggaaatatcttaacaggatttgcaatagaccgtcaggaactgtggttgttgtatctagcttatggcattttaggtgggcttggtttgggagcaggttatattacccctgtgtcaacgattataaaatggtttcctgataaacgtggtctcgcaacaggtttagcgattatggggtttggttttgcttctttattgactagtcccatagcgcaacacctcatcgcaggggtatggattgtagaaactttttatattttaggagcaagttactttattatcatgctcctagcttcacaattcattaagcgtccaaatgagcaagagcttgcaattttatcttcttcagggaaagaaaaaacagcctctttgacgcaaggaatggctgcaaatcaggctctaaaaagcaatcggttttatatgctttggattattttctttatcaacatancttgtggtttaggcttaatttcagcggcatcgccaatggcacaggaaatggctggcttgtctacaagtcatgcagcagtaatggtgggtgttttggggattttcaatggatttggtcgcttgctctgggcgagtttgtctgactatatcggtccgcctctaacctttaatatatga

SEQ ID NO: 629 - DNA, 246 bp, Streptococcus pneumoniae
  unsure (97): n at each above location is unknown.
ttgattccagctattctcagtgatattttacgaaccaaggaattggccgctctgcatggttatattttaacagcttggacaatggctggtttagcgngacctattttattagcagagacttataaaatggctcattcgtacacacaaacgttgttcgtatttctcattttatacagtatcgccttggctttgtcttattatctaggtcgttcaatcaaaaaagaaagtcaaaaaccgcttacatga

SEQ ID NO: 630 - DNA, 1575 bp, Streptococcus pneumoniae
gtgaaatttaatgaattaaacttgtctgctgatttgctagcagaaattgaaaaagctggttttgtagaagctagtcctatccaagaacaaactattcctttggcccttgaaggcaaggatgttattggtcaagctcagactggtacaggaaaaactgcagcctttggcttgcctacccttgaaaaaatccgtacagaagaagcgactatccaagctttggtcatcgctccaactcgtgaactagctgtccaaagtcaagaagaactcttccgctttggtcgtagtaagggagtcaaagtccgttcagtatatggcggatcaagcattgaaaaacaaattaaggctcttaaatctggtgcccatatcgtggtgggaactccaggtcgcctcttggacttgattaaacgcaaggccttgaaattacaagacattgaaacccttatccttgacgaagcggatgaaatgcttaacatgggcttccttgaagacatcgaagccattatttcccgtgtacctgagaaccgtcaaactttgcttttctcagcaactatgccagatgccatcaaacgtatcggtgttcagtttatgaaagcccctgaacatgtcaagattgcggctaaggaattgacaacagaattggttgaccagtactatatccgtgttaaggaacaagaaaaatttgacaccatgactcgtctcatggatgtggcacaaccagaactcgctattgtatttggtcgtaccaaacgccgtgtggatgaattgactcgtggtttgaaaattcgtggcttccgtgcagaaggaattcatggcgacctagaccaaaataaacgtcttcgtgtccttcgtgactttaaaaatggcaatcttgatgttttggttgcgacagacgttgcagcgcgtggtttggatatttcaggtgtgacccatgtctacaactacgatattccacaagatcctgagagttatgttcaccgtatcggtcgtacaggtcgtgctggtaagtcaggtcaatctattacttttgttgctccaaacgaaatgggttaccttcaaatcattgaaaacttgactaagaaacgcatgaaaggtctcaaacctgcaagtgtagaagaatccttccaatcaaaaaaacaggtagctctcaagaaaatcgaacgtgattttgcagatgaaaccattcgtgccaactttgagaaatttggtaaggatgctcgcaaattggctgctgagtttactccagaagaattggcaatgtatatcttgagtctgacagtccaagacccagatagccttccagaagtggagattgcacgtgaaaaaccactaccgtttaaaccatcaggtaatggtttcggtggtaaagctaagggaggtcgtggaggccgtcgtggggacgaccgtcgagagcgtgatcgccgtggcaatggtcgccgtgatgagttcaaaaaaggaagtcgtggcaacgatcgttttgataaggaaaaacgttaccgtaaggataataaaaaaccacgcaatactttaagcgaaaagcaaacaggctttgttattcgtaacaagggcgataaataa

SEQ ID NO: 631 - DNA, 789 bp, Streptococcus pneumoniae
atggcacatttattagaaaaaactagaaaaattacatcaattttgaaacgctcagaggagcagttgcaggatgagctcccttacaacgctattacgcgtcagttagcggatattattcattgcaatgcctgcattatcaatagtaagggacgtctgcttggctattttatgcgttataaaacaaatacagatcgcgtaaagcaattcttccaaactaagattttcccagatgactacgttcaaggggctaatatgatttacgaaacagaagcaaacttgcctgttgagcatgatatgagtattttccctgttgagagtagagatgattttccagatggcttgacgactattgcaccgattcatgtatcggggattcgccttggttctttgattatttggcgtaatgataaaaaattcgaagatgaggacttggttcttgttgagattgccagtaccgttgttgggattcagcttcttaacttccaacgtgaagaagatgagaaaaatattcgtcgtcgtactgctgtcaccatggcggtcaataccctttcttactccgaactccgtgctgtttcagcaattttaggggaattaaatggaaatgaagggaagttgactgcgtcagtgattgcagatcgtatcggaatcactcgctctgtgattgtcaatgctcttggtaaacttgagtatgcggggattattgaaagtcgctcacttggaatgaagggaacctatcttaaggtcttgatttcagatatttttgaagaagtgaagaaaagagatcactaa

SEQ ID NO: 632 - DNA, 207 bp, Streptococcus pneumoniae
gattttgttgctgatagtgggaaactaacagcaggtgctccagctcaggcgatttcggatgccatcagcaaggtatctctattagcttttgaacgagaagatcatatcttctttacaattgatgctcatgaagaaatcgattgtttccatccggaaagtaagttatttcctcctcataatctccttgggacgagtggacggaattaa

SEQ ID NO: 633 - DNA, 456 bp, Streptococcus pneumoniae
cttttgaacgagaagatcatatcttctttacaattgatgctcatgaagaaatcgattgtttccatccggaaagtaagttatttcctcctcataatctccttgggacgagtggacggaattaaaatggagatttggggatcttttatcaagagcaatggttcagacagtcgggtcatttggatggataaacgccattactcagctttttcagggactgacctagatattcgtttgagagagcgtagagtgtctaccgttatcttaacaggtgtcttgacggatatctgtgtcctacatacagctatagatgcctataatctaggatatgacatcgagattgttaaaccagctgttgcttccatctggcctgaaaatcatcaatttgccctaggtcatttcaaaaatacactcggagctaagttagtagatgaaaatctaaatgaactttctgagtaa

SEQ ID NO: 634 - DNA, 234 bp, Streptococcus pneumoniae
atggtagaattgaatcttaaaaatatttacaaaaaatatccaaacagcgaacactattcagttgaagatttcaacttgaacatcaaagataaagaatttatcgttttcgtaggaccttcaggatgtggtaaatcaactacactccgtatgattgctggtcttgaagacatcacagaaggtactgcatctatcgatggcgtggttgtcaacgacgtagctccaaaagaccagtga

SEQ ID NO: 635 - DNA, 156 bp, Streptococcus pneumoniae
ttgacaaccacgccatcgatagatgcagtaccttctgtgatgtcttcaagaccagcaatcatacggagtgtagttgatttaccacatcctgaaggtcctacgaaaacgataaattctttatctttgatgttcaagttgaaatcttcaactgaatag

SEQ ID NO: 636 - DNA, 855 bp, Streptococcus pneumoniae
ctgtttatagacaacatggctttcggtttgaaattgcgtaaatacagcaaagaagacattaacaaacgtgttcaagaagcagctgaaatacttggattgaaagaattcttggaacgtaaaccggctgacctttcaggtggtcaacgtcaacgtgttgccatggggcgtgcgattgtccgtgatgcgaaagtattcttgatggacgaacctttgtcaaacttggatgccaaacttcgtgtatcaatgcgtgctgaaatcgctaaaattcaccgtcgtatcggagctacaactatctatgtaactcacgaccaaacagaagcgatgacacttgcagaccgtatcgttattatgtcagctactaagaaccctgctggtacaggtactatcggacgtgtagaacaaatcggtactcctcaagaagtttacaaaaatccagttaacaaattcgttgcaggattcatcggaagcccagctatgaacttcatcaacgtgaaattggttggtagcgaaattgtttctgacggtttccgtttgaaagtgccagaaggagcattgaaagttcttcgtgaaaaaggctacgaaggaaaagaattgatctttggtatccgtccagaagacgtgaatgcagaacctgctttccttgaaacattcccagactgtgttgtaaaagcgactatctctgtatcagaactgcttggttcagaatctcacctttactgccaagttggtaaagacgagtttgttgcaaaagttgatgctcgtgactacttgcaaacaggtgcaacagttgagcttggatttgacttgaacaaagcacacttcttcgatgtagaaactgaaaaaacaatctactaa

SEQ ID NO: 637 - DNA, 759 bp, Streptococcus pneumoniae
atgtcagaagcaggtcataagtttttagcaaaattggggaaaaaacgcttacgtccaggtggaaagcgtgctacagattggttaattgcagaaggaggattgtcaaaagaaaagagaatactagaggttgcgtgtaataggggaactacagcaattgagttggcacagcgttttggttgcaagataactgctgttgatatggatgctcaagctttagaagtggctaaaaaatctgctggaacggcaggtgttgctcatttaatcagttttgaaagagcaaatgcaatgaaacttccttatcaagatgctagttttgatattgttataaatgaagctatgctgactatgcaagccgatcaagctaagaaaaaatgtgtaatggaatatctaagggtattaaaacctggaggtcttcttttgacacatgatgtgcttcttaaggaagctaaagagtctatcagacaggaattatcacaagcaattcatgtaaatgtaggtcctttaactcaagatggttgggaacaggtgatgatagaatcaggttattgtgatgtgaaagtattgactggtgaaatgacattaatgaaattatcgggtatgatttatgacgaaggttggctaggaactttgaaaatttgtgtaaatgcttgtaaaaaggagaatagaaagcagtttttaactatgtataaaatgtttgctaagaataaacagaaattgggctttattgcgatggctagttataaatcgtcaaaacgttag

SEQ ID NO: 638 - DNA, 531 bp, Streptococcus pneumoniae
ttgaaagaaagaaaaaagatgaatttaaaagattacattgcaacaattgaaaattatccaaaggaaggcattaccttccgtgatattagtcctttgatggctgatggaaatgcttatagctacgctgttcgtgaaatcgttcagtatgctactgacaagaaagtcgacatgatcgtgggacctgaagctcgtggatttatcgtgggttgtccagttgcctttgagttgggaattggttttgcgcctgttcgtaagccaggtaaattgccacgtgaagttatttctgctgactatgaaaaagagtacggtgtcgataccttgactatgcacgcggatgccattaagccaggtcaacgtgttcttattgtagatgaccttttggcgacaggtggaactgttaaggcaactatcgagatgattgaaaaacttggtggtgttatggcaggttgtgccttccttgttgaattggatgaattgaacggccgtgaaaaaattggtgactacgactacaaagttcttatgcattattaa

SEQ ID NO: 639 - DNA, 945 bp, Streptococcus pneumoniae
atgccgattcgaattgataaaaaattgccagctgttgagattttacggacagagaatatctttgtcatggatgatcaacgtgctgcccaccaagatatccgtcctttgaagattttaattttaaatctcatgccacagaaaatggtcacagagacccagttgttgcgccacttggctaatacacccctacaactggatattgattttctctatatggagagccaccgttctaaaacaactcgttcagagcacatggagaccttctataaaacttttcctgaagtcaaggatgagtattttgatgggatgatcatcacgggtgctccagttgagcatttaccatttgaggaagtggactattgggaggaatttagacagatgcttgagtggtctaagactcatgtctattcgacccttcatatctgttggggggctcaggctgggctttatctgcgctatggtgtagaaaaataccagatggacagtaagctatcaggtatttatcctcaggacaccctaaaagagggtcaccttctatttagaggctttgatgatagctatgtatcccctcattcacggcacacggagatttctaaggaagaggtcttaaacaagaccaatctcgagattttatcagaaggacctcaggttggggtttctattttggccagtcgtgatttacgagaaatttatagttttggtcatttggagtatgaccgtgataccttggcaaaagagtattttcgagatcgtgatgcaggtttcgacccacatattccagaaaattactttaaagatgatgatgttaatcaggttacttgtctttgttggtcttcatctgcagccctctttttcagtaattgggtaaaccatgcggtctatcaggagacgccttttgattggagaaagatagaagatgatgcatctgcatatgggtatttataa

SEQ ID NO: 640 - DNA, 678 bp, Streptococcus pneumoniae
atgacatatttagacgcttttaaatcaggtaccttggttttaccgagtgccctgctcttgcattttaaggaactatttccttctagcgacgattttctggtttggcaatttttctatttgcaaaatacgacaggcttagaagaaatgtcgccaagccagattgctgaaaggattggcaaggaaatttcggatgtcaaccagtccatttctaatctgacggaaaggggactgctccagtatcgtactatcgaattaaatggcgaaattgaattgctctttgatgctagtttggccttggaacgtttggatgacctgtttggagcagttcattcaagttcagaccagctaacacctcaaaaccagctcaaggatttggtggaaaccttccagcaggagttgggacgattgttgacgccttttgagattgaggatttgaccaagacactaaaggaagatggaaccagtgctgacttgattaaggaggctcttcgtgaagctgttttgaatggaaaaccaaactggaagtacattcaggcgattttgagaaactggcgccatgaaggaatcaagagtgtggctcaaattgaggccaagagagcagaaagagaagcaagcaatcctcagttgacacaggtatctgcagatttcagaaatgccatggatctctggaaggattaa

SEQ ID NO: 641 - DNA, 375 bp, Streptococcus pneumoniae
ttgttcattttccagttaccagcgataaatggtttacgtgacatttcacatacctcttttttcaatttattttctatttattctatcacaattatacacagcttgcaaatcttactcggatttcaagcctacttgcatggattaatccttccagagatccatggcatttctgaaatctgcagatacctgtgtcaactgaggattgcttgcttctctttctgctctcttggcctcaatttgagccacactcttgattccttcatggcgccagtttctcaaaatcgcctgaatgtacttccagtttggttttccattcaaaacagcttcacgaagagcctccttaatcaagtcagcactggttccatcttcctttag

SEQ ID NO: 642 - DNA, 759 bp, Streptococcus pneumoniae
atgtcacgtaaaccatttatcgctggtaactggaaaatgaacaaaaatccagaagaagctaaagcattcgttgaagcagttgcatcaaaacttccttcatcagatcttgttgaagcaggtatcgctgctccagctcttgatttgacaactgttcttgctgttgcaaaaggctcaaaccttaaagttgctgctcaaaactgctactttgaaaatgcaggtgctttcactggtgaaactagcccacaagttttgaaagaaatcggtactgactacgttgttatcggtcactcagaacgccgtgactacttccatgaaactgacgaagatatcaacaaaaaagcaaaagcaatctttgcgaacggtatgcttccaatcatctgttgtggtgaatcacttgaaacttacgaagctggtaaagctgctgaattcgtaggtgctcaagtatctgctgcattggctggattgactgctgaacaagttgctgcctcagttatcgcttatgagccaatctgggctatcggtactggtaaatcagcttcacaagacgatgcacaaaaaatgtgtaaagttgttcgtgacgttgtagctgctgactttggtcaagaagtcgcagacaaagttcgtgttcaatacggtggttctgttaaacctgaaaatgttgcttcatacatggcttgcccagacgttgacggtgcccttgtaggtggtgcgtcacttgaagctgaaagcttcttggctttgcttgactttgtaaaataa

SEQ ID NO: 643 - DNA, 1506 bp, Streptococcus pneumoniae
atgtctgttacattttttataggagagcaaagattgaaaacaaaaattggattagcaagtatctgtttactaggcttggcaactagtcatgtcgctgcaaatgaaactgaagtagcaaaaacttcgcaggatacaacgacagcttcaagtagttcagagcaaaatcagtcttctaataaaacgcaaacgagcgcagaagtacagactaatgctgctgcccactgggatggggattattatgtaaaggatgatggttctaaagctcaaagtgaatggatttttgacaactactataaggcttggttttatattaattcagatggtcgttactcgcagaatgaatggcatgaaaattactacctgaaatcaggtggatatatggcccaaaacgagtggatctatgacagtaattacaagagttggttttatctcaagtcagatggggcttatgctcatcaagaatggcaattgattggaaataagtggtactacttcaagaagtggggttacatggctaaaagccaatggcaaggaagttatttcttgaatggtcaaggagctatgatgcaaaatgaatggctctatgatccagcctattctgcttatttttatctaaaatccgatggaacttatgctaaccaagagtggcaaaaagtgggcggcaaatggtactatttcaagaagtggggctatatggctcggaatgagtggcaaggcaactactatttgactggaagtggtgctatggcgactgacgaagtgattatggatggtgctcgctatatctttgcggcctctggtgagctcaaagaaaagaaagatttgaatgtcggctgggttcacagagatggtaaacgctatttctttaataatagagaagaacaagtgggaaccgaacatgctaagaaaatcattgatattagtgagcacaatggtcgtatcaatgattggaaaaaggttattgatgagaacgaggtggatggtgtcattgttcgtctaggttatagcggtaaagaagacaaggaattggcgcataacattaaggagttaaaccgtctgggaattccttatggtgtctatctctatacctatgctgaaaatgagaccgatgctgagaatgacgctaaacagaccattgaacttataaagaaatacaatatgaacctgtcttaccctatctattatgatgttgagaactgggaatatgtaaataagagcaagagagctccaagtgatacagacacttgggttaaaatcatcaacaagtacatggacacgatgaagcaggcgggttatcaaaatgtgtatgtctatagctatcgtagtttattacagacgcgtttaaaacacccagatattttaaaacatgtaaactgggtagcggcctatacgaatgctttagaatgggaaaacccttattattcaggagaaaaaggttggcaatatacctcttctgaatacatgaaaggaatccaagggcgcgtagatgtcagcgtttggtattaa

SEQ ID NO: 644 - DNA, 519 bp, Streptococcus pneumoniae
atggtagaattgaaaaaagaagcagtaaaagacgtaacatcattgacaaaagcagcgccagtagcattggcaaaaacaaaggaagtcttgaaccaagctgttgctgatttgtatgtagctcacgttgctttgcaccaagtgcactggtatatgcatggtcgtggtttccttgtatggcatccaaaaatggatgagtacatggaagctcttgacggtcaattggatgaaatcagcgaacgcttgattacactcggtggaagcccattctctacattgacagagttccttcaaaatagtgaaatcgaagaagaagctggtgaataccgtaatgttgaagaaagcttggaacgtgttcttgttatctaccgttacttgtcagaacttttccaaaaaggtttggatgtcactgatgaagaaggtgacgatgtgacaaacggtatctttgcaggcgctaaaactgaaacagataaaacaatttggatgcttgcagccgaacttggacaagcacctggtttgtaa

SEQ ID NO: 645 - DNA, 639 bp, Streptococcus pneumoniae
atgaatgtgagtgacaatcacttcatcaaggtaaggttcaaaagcctgaaaaatttgcttcccaccgataatgtagagattcttttcttgagcctgataccagtcaagaacagactggacgtcctgaaaagtagcaaccccatctatcttttcttccggattacgcgtcaaaatcagggtttcccgttttggaagcaagcgacgccccatcccatcaaaggtcacacgccccatcaagatagcatgattcagagttgtttctttaaagtgctgcaattctgctggcaaatgccaaggcagacgattttccttaccaatcacaccctcttcatcctgggcccaaatagctacgattttcttagtcatgcttccatccttttcactgatagtactattttatcaaaaaactcaaaaaaagactggtttggaatagcttacaaaatagaaaaaatctgtaagaaatttcctacagatttatctatgtttccttatttcttacaaaccaggtgcttgtccaagttcggctgcaagcatccaaattgttttatctgtttcagttttagcgcctgcaaagataccgtttgtcacatcgtcaccttcttcatcagtgacatccaaacctttttggaaaagttctga

SEQ ID NO: 646 - DNA, 507 bp, Streptococcus pneumoniae
atgactaagaaaatcgtagctatttgggcccaggatgaagagggtgtgattggtaaggaaaatcgtctgccttggcatttgccagcagaattgcagcactttaaagaaacaactctgaatcatgctatcttgatggggcgtgtgacctttgatgggatggggcgtcgcttgcttccaaaacgggaaaccctgattttgacgcgtaatccggaagaaaagatagatggggttgctacttttcaggacgtccagtctgttcttgactggtatcaggctcaagaaaagaatctctacattatcggtgggaagcaaatttttcaggcttttgaaccttaccttgatgaagtgattgtcactcacattcatgctcgggtggaaggagatacctatttccctgaagaacttgacttgtctctttttgagacagtttcaagcaaattttacgccaaagatgagaagaatccttatgattttaccatccaataccgcaagagaaaggaagtctaa

SEQ ID NO: 647 - DNA, 207 bp, Streptococcus pneumoniae
ttttaccatccaataccgcaagagaaaggaagtctaatggaacggagtttatttggtctattcacggcttttctgtgtttcatctgctttctggcaggagcacaagcttttcgtaaaaagcgttacgggctttctatcctcctttggttaaatgcctttaccaatctggtcaatagtattcatgctttttacatgaccttattttag

SEQ ID NO: 648 - DNA, 1233 bp, Streptococcus pneumoniae
atgtctacaaatagaaaaaatgatatgatggtttattgctcattttgtggcaaaaaccaagaagaagtacaaaaaataattgctggcaacaatgcttttatttgtaatgaatgcgtggagttagctcaggaaatcattcgagaagaattggttgaggaagtcttggcagacttgtctgaggtgccaaaaccaattgaactcctccatatcttgaaccactatgtaattggccaagatcgtgccaagcgtgccttggcagtggcggtttataaccactacaaacgcatcaatttccacgatacacgcgaagagtcagaagatgtggatttgcagaagtcaaacattttgatgattggcccaactggttcagggaaaactttccttgcccagaccttggctaagagcttgaatgtaccttttgctattgcggatgcgacagctctgacggaggctggttatgtgggtgaggatgtggaaaatatcctcctcaaactcttgcaggttgctgactttaacatcgaacgtgcagagcgtggcattatctatgtggatgaaattgacaagattgccaagaagagtgagaatgtgtctatcacacgtgatgtttctggtgaaggggtgcaacaagcccttctcaagattatcgagggaactgttgctagcgtgccgcctcaaggtggacgcaaacatccacaacaagagatgattcaagtggatacaaaaaatatcctcttcatcgtgggtggtgcttttgatggtattgaagaaattgtcaaacaacgtctgggtgaaaaagtcatcggatttggtcaaaacaataaggcgattgatgaaaacagctcatatatgcaagaaatcatcgctgaagacattcaaaaatttggtattatccctgagttgattggacgcttgcctgtttttgcggctcttgagcaattgaccgttgatgacttggttcgcatcttgaaagagccaagaaatgccttggtgaaacaataccaaaccttgctttcttatgatgatgttgagttggaatttgacgacgaagcccttcaagagattgctaataaagcaatcgaacggaagacaggggcgcgtggacttcgctccatcatcgaagaaaccatgctagatgtcatgtttgaggtgccgagtcaggaaaatgtgaaattggttcgcatcactaaagaaactgtcgatggaacggataaaccgatcctagaaacagcctag

SEQ ID NO: 649 - DNA, 588 bp, Streptococcus pneumoniae
atggaacttaatacacacaatgctgaaatcttgctcagtgcagctaataagtcccactatccgcaggatgaactgccagagattgccctagcagggcgttcaaatgttggtaaatccagctttatcaacactatgttgaaccgtaagaatctcgctcgtacatcaggaaaacctggtaaaacccagctcctgaacttttttaacattgatgacaagatgcgctttgtggatgtgcctggttatggctatgctcgtgtttctaaaaaggaacgtgaaaagtgggggtgcatgattgaggagtacttaacgactcgggaaaatctccgtgcggttgtcagtctagttgaccttcgtcatgacccgtcagcagatgatgtgcagatgtacgaatttctcaagtattatgagattccagtcatcattgtggcgaccaaggcggacaagattcctcgtggtaaatggaacaagcatgaatcagcaatcaaaaagaaattaaactttgacccaagtgacgatttcatcctcttttcatctgtcagcaaggcagggatggatgaggcttgggatgcaatcttagaaaaattgtga

SEQ ID NO: 650 - DNA, 381 bp, Streptococcus pneumoniae
atggcaaaaacaattcatacagataaggccccaaaggctatcgggccctatgttcaaggaaaaatcgttggcaaccttttgtttgctagcggtcaagttcccctatcccctgaaactggggaaattgtaggagagaatatccaagaacagacagagcaagtcttgaaaaacatcggtgctattttggcagaagcaggaacagactttgaccatgttgtcaaaacaacttgtttcttgagcgatatgaacgactttgttccttttaatgaggtttaccaaacggccttcaaagaggaattcccagctcgttcagctgtggaggtagctcgtcttcctcgtgatgtaaaagtcgaaattgaagtcatcgcagagattggataa

SEQ ID NO: 651 - DNA, 891 bp, Streptococcus pneumoniae
atgacaaagaaacaacttcacttggtgattgtgacagggatgagtggcgcagggaaaactgtagccattcagtccttcgaggatctaggttatttcaccattgataatatgccgccagctctcttgcctaagtttttgcagctggttgaaattaaggaagacaatcctaagttggccttggtagtggatatgcgtagccgttctttcttttcagagattcaagctgttttggatgagttggaaaatcaagatggtttggatttcaaaatcctctttttggatgcggctgataaggaattggtcgctcgttacaaggaaaccagacggagtcacccactagcagcagacggtcgtattttagatggaatcaagttggaacgtgaactcttggcacctttgaaaaatatgagccaaaatgtggtggatacgactgaactcactccacgtgagctgcgcaaaacccttgcagagcagttttcagaccaagaacaagcccagtctttccgtatcgaagtcatgtctttcggatttaagtatggaatcccgattgatgcggacttggtctttgatgtccgtttcttgccaaatccctattatttaccagaactgagaaaccaaacgggtgtggatgaacctgtttatgattatgtcatgaaccatcctgagtcagaagacttttatcaacatttattggccttgattgagccgattctgccaagttaccaaaaggaaggtaagtccgttttgaccattgccatgggatgtacgggtggacaacaccgtagtgtggcatttgctaaacgcttggtgcaggacttatccaagaattggtctgttaatgaagggcatcgcgacaaagaccgcagaaaggaaacggtaaaccgttcatga

SEQ ID NO: 652 - DNA, 978 bp, Streptococcus pneumoniae
atgagaaaaccaaagataacggtgattggtggagggactggaattcccgtcattctaaaaagtctgcgggaaaaagatgtggaaatcgcagctatcgtgacggtggcagatgatggtggttcttcaggtgaactccgaaaaaatatgcaacagttgacaccgccaggtgatcttcgtaatgtccttgtggccatgtcggatatgcctaagttttatgagaaggtctttcagtatcggttctctgaggatgccggagcctttgctggccatccattgggaaatctcatcattgctggcttgtcagaaatgcagggttcaacctataatgccatgcagttattgagcaaatttttccatacaacagggaaaatttatccttccagtgaccatcctttgacccttcatgcagtctttcaggatgggacagaagtggctggagagagtcatattgtagaccatcgaggcataattgacaatgtctatgtgaccaatgccctaaacgatgatacgcctctggccagccgtcgagtagtgcagaccatccttgaaagtgacatgattgtcctagggccaggttccctctttacctctattttgcccaatatcgtgattaaggaaattgggcgggctcttttggaaaccaaggcagaaattgcctatgtctgcaatatcatgacccaacgtggggagacggaacactttacagatagcgaccacgtggaagtcttgcatcgtcaccttggtcgcccttttatcgacactgtcttggtgaatattgaaaaagtgcctcaggaatacatgaattccaaccgttttgatgaatacttggtgcaagtggaacacgattttgtaggtctttgtaagcaagtttcgcgcgtgatttcatctaacttccttcgtctggaaaatggcggtgccttccacgatggagatttgattgtggacgagttgatgcgcattatacaggtgaaaaaatga

SEQ ID NO: 653 - DNA, 912 bp, Streptococcus pneumoniae
atgagtttcacagtagcagtaaaagaagaaatcctgggccaacaccatctgagctggcatgaattatctgccattatcaaaatgtctggtagcatcggtctctcgacttcgggcttgactttgtcagttgtgacagaaaatgccaaactggcccgtcacctctatgagtcctttctccatttctatgaaatcaaatctgaaattcgtcaccaccaacggagcaatcttcgcaagaatcgcgtctataccgtttttacagatgaaaaggtgcaggatttgttaagtgatttgcacttggcagactctttctttggcctggaaacaggtattgatgaggcgattttatcggatgaggaagcaggtcgtgcctatctctgtggcgctttcttggcaaatgggagcattcgtgaccctgagtcaggcaagtaccagttggaaatcagttctgtttatctggaccacgcgcaaggaattgcctcccttctccaacagtttttactggatgccaaggtgcttgagcgcaagaagggggctgtgacctatctccagcgagcagaagacattatggacttcttgatagtaatcggagccatgcaggcacgtgatgattttgagcgggttaagattttgcgagaaacccgtaacgacctcaatcgggctaataatgccgagacagctaatatcgctcggacagtttctgccagcatgaagaccattaacaatatcagtaaaatcaaagatatcatgggcttagaaaatttgccagtagatttgcaggaagtggcgcaactgaggattcagcacccagactactctatccagcagttagcagatagtctcagcacccctctgaccaaaagtggtgtcaatcacagactcagaaaaatcaataagatagcggatgaattataa

SEQ ID NO: 654 - DNA, 969 bp, Streptococcus pneumoniae
atgtctcaactctatgatattaccattgtgggtggtggtcctgtcgggctttttgcagccttttatgcccacctacgccaagccaaggttcaaatcatcgactctcttccccagctaggtggacaacctgctattctctaccctgaaaaggaaatcctagacgtaccaggcttcccaaacctgactggagaagagttgactaaccgcttgattgaacagctaaatggatttgatacccctattcatctcaatgaaacggttcttgagattgacaaacaagaagaagaatttgccatcacaacttctaaaggaagtcacctgactaaaacagtcatcatcgctatgggtggcggtgccttcaaaccacgtccgctggaacttgaaggtgttgagggctatgaaaatatccactaccacgtttctaacattcagcaatacgctggtaagaaagtgacgattcttggtgggggagactcggctgtggattgggctttggcttttgaaaaaatcgcaccaactacccttgttcaccgcagagataatttccgtgccttggaacacagtgttcaagccttgcaagaatcatctgtaaccatcaagacaccattcgcccctagccaactccttggaaatggaaaaacacttgataaacttgaaatcacaaaagtcaaatctgatgaaactgaaaccattgacctagaccacctctttgtcaactatggtttcaaatcttctgtcggtaaccttaaaaactgggggctcgacctcaaccgtcacaagattatcgtcaacagcaaacaggaatccagccaagcaggtatctatgctatcggtgactgctgctactatgacggaaaaattgatctgattgcgacaggcctcggagaagctccaactgctgtcaacaacgctatcaactacattgaccctgaacaaaaagtacaaccaaaacactctactagtttataa

SEQ ID NO: 655 - DNA, 816 bp, Streptococcus pneumoniae
ttgtttgcaagtccatggacgatagctatcaatctgattgatattttgattgttgcttatattttataccattttacaaaaggtattgcaggaaccaagattatgattttggtacgtggagttttggtatttattttagctcaaatccttgcaaatatgattggtttgactacgatttattggttattcaatcaaattattacttatggggttattgcggcggttgttatcttctctccagagattcggactggtttggaacgtttgggaagagcgacagatttcttttccaatgcccctattagtgctgaggaacagatgattcgtgcctttgttaagtctgttgaatacatgagtcctcgtaaaatcggggccttggttgctattcagcgtgtacgtaccttgcaggagtatatttcgacaggaatccccttggatgctaagatttctgcagaacttctcattaacatttttattcccaacactcccctacatgacggtgcggtgattatcaaagaagaacgtatcgctgtgacgtctgcctatctgcccttgacaaaaaacacaggtatttccaaggaatttgggaccagacaccgggcggctatcggtttatcagaagtctcagatgccttgacttttgtcgtatcagaggaaacgggaggaatttcgataacctataatggaaggtttaagcacaacctaacacttgatgaatttgaaacagaattacgtgaaatcttacttccaaaagaggaagtgggtcttagttttaaagaacgatggctaggaggatggaaacatgaaaaaaaatag

SEQ ID NO: 656 - DNA, 780 bp, Streptococcus pneumoniae
atgaaaaaaaatagtttatatatcatatcctcactcttttttgcttgtgtcttatttgtctatgctacggcgacgaattttcaaaacagtaccagtgctaggcaggtaaaaacggaaacctatactaatacagtaacaaatgtccctattgacatacgctataatagtgataagtattttattagcggttttgcttcagaagtatcagtggtcttgactggtgcaaatcgcctatcgctagctagtgaaatgcaagaaagtacacgtaaattcaaggttactgctgacctaacagatgccggtgttggaacgattgaagttcctttgagcattgaagatttacccaatgggctgaccgctgtggcgactccgcaaaaaattacagtcaagattggtaagaaggctcagaaggataaggtaaagattgtaccagagattgaccctagtcaaattgatagtcgggtacaaattgaaaatgtcatggtgtcagataaagaagtgtcgattacgagtgaccaagagacattggatagaattgataagattatcgctgtcttgccaactagcgaacgtataacaggtaattacagtggttcagtacctttgcaggcaatcgaccgcaatggtgttgtcttaccggcagttatcactccgtttgatacaataatgaaggtgactacaaaaccagtagcaccaagttcaagcacatcaaattcaagtacaagcagttcatcggagacatcttcgtcaacgaaagcaactagttcaaaaacgaattaa

SEQ ID NO: 657 - DNA, 192 bp, Streptococcus pneumoniae
ttcgtttttgaactagttgctttcgttgacgaagatgtctccgatgaactgcttgtacttgaatttgatgtgcttgaacttggtgctactggttttgtagtcaccttcattattgtatcaaacggagtgataactgccggtaagacaacaccattgcggtcgattgcctgcaaaggtactgaaccactgtaa

SEQ ID NO: 658 - DNA, 1353 bp, Streptococcus pneumoniae
atgggtaaatattttgggactgatggagtccgtggagaagctaacctagaactaacaccagaattagcctttaaactaggacgttttggaggctatgttcttagtcaacatgaaacggaagcgccgaaagtctttgtaggacgtgacacacgtatttcaggggaaatgctggaatcggccttggtggcaggtctcctttcagtagggattcacgtatacaaacttggtgtccttgcaacaccagcagtagcttacttggttgaaactgaaggagcaagtgccggtgtcatgatttctgctagccacaacccagcccttgataacggaatcaagttctttggcggtgatggcttcaaactagatgatgaaaaagaagcagaaattgaagccttgctagatgctgaggaagacactcttcctcgtccaagtgcagaaggcttaggaattttggtagattatccagaaggcttgcgtaagtatgaaggataccgtgtgtcaactggaactcctcttgatggaatgaaggttgccttggatacagctaatggagcagcttctaccagtgcccgtcaaatctttgcagaccttggtgcccaattgacggttatcggggaaacaccagacggtcttaacatcaaccttaatgttggttcaacacatccagaagcccttcaagaagtggtcaaagaaagtgggtcagctattggtttggcctttgatggagacagtgaccgcttgattgctgttgatgagaatggtgacatcgtcgatggtgacaagattatgtacatcatcggaaaatacctttctgaaaaaggacaattggctcaaaatacaattgtgacaactgttatgtctaaccttggtttccacaaggccttgaatcgcgaaggtattaacaaggcagttactgcagttggtgaccgctacgttgttgaagaaatgagaaaatcaggctacaaccttggtggtgaacagtctggtcacgttatcttgatggattacaataccacaggtgatggtcaattatcagcagttcaattgactaaaatcatgaaggaaactggtaagagcttatcagagttggcggcagaagtaacgatttatccacaaaaattagttaatatccgagtggaaaacgtcatgaaggaaaaggccatggaagtgccagctatcaaggccatcatcgagaagatggaagaagaaatggcggggaacggccgtatccttgttcgtccaagtggaacagagcccctcttgcgtgttatggcagaagcgcctacaacagaagaagtggactactatgttgataccatcacagatgtagttcgtgctgaaattgggattgactaa

SEQ ID NO: 659 - DNA, 363 bp, Streptococcus pneumoniae
gtgaacaagaatttgttagtcagtatcattttgatgcgcgtatattttgaatgggaaaatgaaaatggagctcctgaaaccaaggtggatgtgaatttccaattgctccaacatgaccaagaaaatcaagtgacttccttgattgtcatcttgagctttatgattgtatttgataagtttgtcattagtggaacaatctcacaagtaaaccatatcgatggccgtattgtcaatgaaccaagtgaattgaaccaagaagaggtggaaaccttggctcgtccatgtttgaacatgctcaatcgtttgacttacgaagtgactgaaattgcattagacttaccaggaattaatttggagttctaa

SEQ ID NO: 660 - DNA, 849 bp, Streptococcus pneumoniae
atgaaattagctgttttcacagattcctctgcttatctcagtgaagagaccttgcaaagagaagacttgtttgtcttggatattcctgtcaatattgatggtgaggaatatgtcgaaggcatcaatctgtctgctgaggaattttaccaaaaaatggctcaggcttctgaattgcctaagaccagtcaaccaagtattgccaagttagatgagatcttaacttcgctcaaagaacaaggctatacacatgccttggggcttttcctatcttctggaatttcaggtttttaccaaaatatccagtatatggtcgatgactatgagggcttaaccattgctttcccagacactttgattacaagtgctcccctaggcatcatggttgaaagcgtctttaattggcgtgatcagggcgatgattttgccagcattcaggataagctagccattcaaatcagccgtacgtcagcctttatcatggtagatgacttggatcatttggtaaaaggtggacgcctttcaaatggggctgccattttgggcaatttgcttagcattaagccaatcctttattttaacgatcaaggtgtgattgaagtttacgaaaaagttcgtactgaaaagaaggccaccaagcgcttaattgaaattatcaaggaaacaacggcttcaggtcaataccgggtcattgtcattcatgggaatgctcctgaaaaggctgaagaattgcgtcagcacttgcttgattttggcttgggttcggatgtttcacttgctacatttggtagtgtcattggaacgcacctaggagcaggaagtattgctctgggttatattccagtgatttag

SEQ ID NO: 661 - DNA, 768 bp, Streptococcus pneumoniae
atgagtattcgagtaattattgccggttttaagggaaagatgggccaggctgcttgtcagatggtattgactgatccagacttggacttggtggcagttttggatccttttgagtctgagtcagaatggcagggtattcctgttttcaaggataaggctgatttagctggttttgaagcggatgtctgggtagattttactactccagctgttgcctacgaaaatacacgttttgctcttgaaaatggctttgctccagtagttggaacgactggtttcacgagtgaagaaattgcagagctaaaagaattttctcgtgcccaagacttgggtggcctgattgcccctaactttgccttgggtgctgtcttactcatgcaatttgcgacgcaggctgccaaatatttcccaaatgtggagattattgagctccatcatgacaagaaaaaggatgctccgagtggaacagccattaaaacagctgagttgatggcagaggttcgagagtcaattcagcaaggtgcagcagatgaggaagagctgattgctggtgctcgtggtgctgactttgatggtatgcgcatccactcagttcgtttgccaggcttggtagctcatcaggaagtcatctttggcaatcagggagaagggttgaccctccgtcatgactcctatgatcgcatctccttcatgacaggagtcaatttgggaattaaagaagttgtcaagcgtcatgagcttgtctatggattagaacacttattatga

SEQ ID NO: 662 - DNA, 1200 bp, Streptococcus pneumoniae
atgagattaacgcaaatgccttctgaatttcagaaggctttaccagtattagaaaaaattaaagaagcaggctttgaggcttattttgttgggggctctgttcgagatgcccttctccatagccctatccacgatgtggatattgcgacgtcttcttatccagaagagaccaagcagatttttccgcgaacagccgatatcggaatcgagcatggaaccgtcttggtcttagatggggatgaggagtatgaggtaacaacctttcggacagaggatgtctatgtggactatcgcagacccagtgcggtttcctttgtacgatcgctagaagaagacctcaaacgccgtgatttcacagtcaacgcctttgccttggatgagacaggagaaatcgttgacttgttccatggtttagaagatttggaaaagcaagtcttgcgagcagttggagtggctagtgagcgtttcaacgaagatgctttacggattatgcgtggtttccgttttcaggctagtcttggttttgcacttgagccagaaacatttaaagctatgaagaccttgacgccgcttttggagaaaatttctgtagagcgtaccttcgtcgagtttgataaactcttgctggctccattttggagaaggggcttggcttccatgattgagagtcaagcttatgactatctccctgatatggcatctagccaggacaagctcaacagactgtttgatttggagactgattttacttttgaatcctctgaacaagcctgggcggctttactatgggctttggagattgaaaatgcgcagtcatttttgaaatcttggaagacctcacgccagtttgccaagcaagttcaggatttgctgattattttggctctgcgtgaaaatggagaattgagcaagcgagattgttatcgctttgacatagatttgcttttacaggctgaaaatcttcgtcaagctcaaggaaaagaagtcaacccacaagccatcacagaaaaataccaaagcttgactatccatgacaagaaagagattcagattaatggcggtattttgatcaaggaatatggctatcagccaggcccagacttgggagagattttaacagagattgagtttgccattgtcgatggagaattggagaataatcgtgaagccatccatgcttacctgagggagaaaaaatga

SEQ ID NO: 663 - DNA, 1872 bp, Streptococcus pneumoniae
atgagtgattttatcgttgaaaaactaagtaaatccgttggtgacaagaccgtttttagggatatttcctttattatccatgacttagacagaattggtttaatcggtgtcaatgggactggcaagaccacccttttggacgtcctttctggtgtttctggatttgatggggatgtcagtcctttttcagctaaaaatgattaccagattggttacttgactcaggatcctgattttgatgatagaaagacagttttggatacggttctatctagtgaactcaaggaaatccagctcattcgtgagtatgaattgattatgctcgactatagtgaggacaagcaggcgcgtttggaacgtgtcatggcagagatggactctctccaagcttgggaaatcgaaagtcaggtcaagaccgttcttagcaaattgggcattcaagacttatctactcctgttggggaattgtcaggtggtctgagaagacgggtacagttggcacaagtcttacttggcaaccacgacctcttgcttttggatgagccgaccaaccatctggatattgcgattattgagtggctgaccctctttttgaaaaattctaagaagaccgtcctttttatcactcacgatcgttatttcttagacgctttgtcaacacggattttcgagttggatcgtgcaggcttgaccgagtaccagggaaattaccaggactatgttcgcctaaaggcggaacaggatgagcgcgacgcggctcttcttcacaaaaaagaacaactctacaaacaagaattggcctggatgcgcagacaaccgcaggcgcgtgcgaccaagcaacaagctcgtatcaatcgtttccatgatctgaaaaaggaagtttcaggcagtagtgctgagacagacttgactatgaactttgaaaccagtcggattgggaagaaagtcatcgagtttcaggctgtttcctttgcctatgaaaataagcccattttgcaaaattttaatctcttagttcaggctaaagaccgtattggaattgttggggacaatggtgttggaaaatcaaccctacttaacctgattgcaggaagtcttgagccgacagcaggacaagttgtgattggggaaactgttcgcatcgcctatttctctcaacaaattgagggtttggatgaaagcaagcgtgtgatcaattacctgcaggaagtggcagaggaggtcaagaccagtggtggttctacgacttccatcgctgagttgctggagcaattcctcttcccacgttcgacgcatgggactttgattgagaaattgtcagggggtgagaaaaaacgtctttatctcctcaaactgcttttggaaaaaccaaatgttcttcttttagacgagccaaccaatgacctagatattgcaactttgacagtcttagagaatttcttgcaaggttttgcaggtcccgttttaacagtcagtcacgaccgctatttcttggataaggtagcgaccaagattctcgcttttgaggatggcaagattcgtcctttctttggtcattacaccgactatcttgatgaaaaagcttttgaaacagatatggccaatcaagtgcaaaaggccgaaaaggaaaaagtggtcaaggttcgagaagacaagaaacgcatgacctaccaagaaaagcaggagtgggcaagtattgaaggtgatattgaaaccttggaaaaacgtatcgctgctattgaagaggaaatgcaggctaacggctctgactttggtaagctggctactctccaaaaagaattggatgagaaaaatgaagcactccttgaaaaatacgaacgctatgagtatctcagtgaatttgatagttaa

SEQ ID NO: 664 - DNA, 432 bp, Streptococcus pneumoniae
ttgcactttgattttcgaatagtcttaactatcaaattcactgagatactcatagcgttcgtatttttcaaggagtgcttcatttttctcatccaattctttttggagagtagccagcttaccaaagtcagagccgttagcctgcatttcctcttcaatagcagcgatacgtttttccaaggtttcaatatcaccttcaatacttgcccactcctgcttttcttggtaggtcatgcgtttcttgtcttctcgaaccttgaccactttttccttttcggccttttgcacttgattggccatatctgtttcaaaagctttttcatcaagatagtcggtgtaatgaccaaagaaaggacgaatcttgccatcctcaaaagcgagaatcttggtcgctaccttatccaagaaatagcggtcgtgactgactgttaa

SEQ ID NO: 665 - DNA, 1182 bp, Streptococcus pneumoniae
atgaagcatctatctaaatctaagttagctgagcgtggagccattatcagtatttcgacctatttgatcttgtctgcagccaaattagcagctggtcatctccttcattcatccagtttggtggccgatggttttaataacgtatcggacatcattggaaatgtggccctcttaatcgggattcggatggcgcgccagcctgcagaccgtgaccaccgttttggtcattggaagattgaagatttggcaagcttgatcacttctatcatcatgttctatgtcggtttcgatgttctaagagataccattcaaaagattctcagtcgggaagaaacggtcattgatcctcttggtgcaactctaggaatcatttctgcagcgattatgtttgtggtctatctctacaatactcgcctcagtaagaaatccaactccaaggcgctgaaggcagctgctaaggacaatctttctgacgctgttacctcacttggaaccgccattgccatcctagctagtagtttcaattatccgattgtggataaactggttgctatcatcatcactttctttatcttgaagactgcctatgatatcttcatcgagtcttcctttagtctttcagatggctttgacgaccgcctgctcgaggactaccaaaaggctatcatggaaattcccaaaatcagcaaggtcaaatcgcaaagaggtcgcacctacggtagcaacatctacctggatattacactagagatgaatcctgacttgtctgtttttgaaagccatgaaatcgcggatcaggtcgagtctatgctggaggagcgttttggcgtctttgataccgatgtccatatcgaaccagcacctatccctgaggatgaaattttagacaatgtctataaaaaattgcttatgcgtgaacaattgattgaccaaggaaaccaactagaagaactcttgactgatgattttgtctatattcgccaagatggagagcagatggataaagaggcttataagaccaaaaaagagttaaattctgctatcaaggacattcaaattacttccatcagtcaaaaaaccaaactcatctgctatgagttagatggtatcatccataccagtatctggcgtcgccacgaaacctggcaaaatatctttcatcaagaaaccaaaaaagaatag

SEQ ID NO: 666 - DNA, 2697 bp, Streptococcus pneumoniae
atgtcaaaagaacaaaaacgccaagcgttttatactcagagccctgaagaggtcttgcaggctgtggatgcgaccgagcaaggtttgtcatcaagtgaggcggaaaagcgccttgccgaatttgggcacaatgaactcgaagaaggcgagaaacgatcaatcttggtcaaattcatcgagcaatttaaggatttgatgattatcatcctagttgcggcagcaatcttgtcagtcgtgacttctggtggggaagatatcgcagatgccattatcatcctagctgtggttatcatcaacgctgcctttggtgtttaccaagaaggaaaagctgaagaagctattgaagccctcaaatccatgtctagtccagttgcccgcgttcttcgtgatggacacatggcagagattgactctaaagaattggtaccaggcgatatcgttgcccttgaagcaggtgacgtggtaccagcggacctacgtttgctagaagccaactctcttaaaattgaagaagcagccttgacgggtgaatctgtaccagtcgaaaaagacttgtcagtcgagcttgcgacagatgctggtattggtgaccgtgtcaacatggccttccaaaactcaaacgtaacctatggtcgtgggatgggtgttgttgtcaatacaggtatgtacactgaagttggtcatattgctggtatgcttcaagatgcggatgagactgatacaccactcaaacaaaacttgaacaacctttctaaggtcttgacctatgctatcttggtcattgcccttgttacttttgtagtgggtgtcttcattcaagggaaaaatccacttggtgagttgttgacttctgttgcccttgctgttgcagccattccagaaggacttcctgctatcgttaccatcgttctttctcttggtactcaagttttggccaaacgacattccatcgttcgtaagttgccagcagttgaaacacttggttcaactgaaatcatcgcttctgataagactggtacgctgactatgaacaagatgacagtcgaaaaagtcttctacgatgcggttctacatgactcagctgatgatattgaactaggtcttgaaatgccactacttcgttcagttgtcttggccaatgatacgaaaatcgatgtggaaggtaacttgattggtgacccaaccgaaacagcctttatccaatatgccttggacaagggctatgatgtcaaaggtttcttagagaaatatcctcgtgtagctgaattgccatttgactctgaccgtaagctcatgtcaacagttcacccattgccagatggtcgtttccttgtagcagtcaagggtgcgccagaccaactcttaaaacgttgtcttcttcgtgataaggctggggatattgctccgattgatgagaaggttacaaatctcattcatacaaacaattctgaaatggctcatcaagccttgcgtgtccttgcaggtgcttataagattatcgatagtattccagaaaatctcacttctgaagagcttgaaaatgatttaatttttactggtttgattgggatgattgatcctgaacgtcctgaagctgctgaggctgttcgtgtggctaaggaagctggaattcgtccaattatgattacaggtgaccaccaagacaccgcagaagctattgccaaacgtttgggaatcattgacgcaaacgatacagaagaccacgttttaactggtgctgagctcaacgaattatctgatgaagactttgaaaaagttgttggtcaatactctgtttatgcccgtgtgtctccagagcacaaggttcgtatcgtcaaggcttggcaaaaacaaggtaaggtcgttgccatgacaggtgacggtgtcaatgatgccccagctctgaaaacagcagacatcggtatcggtatgggaatcactggtacagaggtttctaagggggcttctgatatgattcttgcagatgataactttgcgactattatcgtcgcagtggaagaaggacgtaaggtcttctcaaatattcaaaagactattcagtacctactttctgccaatactgctgaagtattaaccatcttcctatcaaccttgtttggttgggacgtcttgcagccagttcatcttttgtggattaacttggtaacggataccttcccagcaattgcactaggtgttgaacctgcggaacctggtgtcatgaatcataaaccacgtggacgcaaggcaagcttcttctcaggtggtgttttgagttctatcatttatcaaggtgtactccaagcagctcttgttatgagtgtttatggccttgcgattgcttacccagttcatgtgggtgacaatcatgctattcatgcagatgccctaacgatggcctttgcaacccttggtttgattcagctcttccatgcctacaatgtcaagtctgtctaccaatccatcttgacagttggcccattcaagtctaagacctttaactggtccatcttggtatcctttatccttctcatggcaacaatcgttgtagaaccgcttgaaggaatcttccacgtaaccaaactagacttgtcacaatggggaattgttatggctggaagcttctcaatgattatcatcgtcgaaatcgttaagtttattcaacgcaaactcggttttgacaagaatgcgatttaa

SEQ ID NO: 667 - DNA, 291 bp, Streptococcus pneumoniae
atgttgacacggtcaccaataccagcatctgtcgcaagctcgactgacaagtctttttcgactggtacagattcacccgtcaaggctgcttcttcaattttaagagagttggcttctagcaaacgtaggtccgctggtaccacgtcacctgcttcaagggcaacgatatcgcctggtaccaattctttagagtcaatctctgccatgtgtccatcacgaagaacgcgggcaactggactagacatggatttgagggcttcaatagcttcttcagcttttccttcttggtaa

SEQ ID NO: 668 - DNA, 249 bp, Streptococcus pneumoniae
atatttgagaagaccttacgtccttcttccactgcgacgataatagtcgcaaagttatcatctgcaagaatcatatcagaagcccccttagaaacctctgtaccagtgattcccataccgataccgatgtctgctgttttcagagctggggcatcattgacaccgtcacctgtcatggcaacgaccttaccttgtttttgccaagccttgacgatacgaaccttgtgctctggagacacacgggcataa

SEQ ID NO: 669 - DNA, 792 bp, Streptococcus pneumoniae
atgtcagcatatcaattaccgaccgtatggcaggatgaagctagtaatcaaggagcttttacggggctaaacagaccaacagtaggtgcccgtttcgaacaaaacttgccaaaaggagaacaagcttttcagctttattcactgggaacaccaaatggtgtgaaggttactatcttattggaagaattactagaagctggttttaaggaagcggcttacgacttgtataagattgctatcatggatggggatcaattcggatcagactttgtgaagctcaatccaaattccaagattccagccttattggaccagtcaggtactgaagatgtaagagtctttgagtctgctcatattcttctttaccttgctgagaaatttggagcctttttaccaagtaatcctgtggaaaaggtagaagttttgaattggctattctggcaagcaggtgcagcaccttttctaggtgggggatttggacatttcttcaattatgctcctgaaaaattggaatatcctattaaccgttttacaatggaagtgaaacgccagttggatttattggataaggaattggctcagaaaccttatattgcaggcaatgactatacgattgcagatattgctatctggtcttggtatggacagttagttcaaggaaatctttaccaaggttctgcaaaattcttggatgcctcaagttatcaaaatctagtaaaatgggcagaaaaaattgccaatcgtccagctgttaagcgtggcttggaagtaacttatacagaaattaaatag

SEQ ID NO: 670 - DNA, 456 bp, Streptococcus pneumoniae
tatagtaaaaagcaagaggagtgtgaggaagtggaaaagaaaattgtgaaggatatcttatttttatctcaagtgtctcagccggcaagtcaggaggacctttatcttgccagagatttgcaggatacactcttagcaaatcatgatacctgtgttggtctagctgccaatatgattggggtgcagaagcgcgtgattatctttaatcttggcttggttcccgtggtcatgtttaacccagtgcttctgtcctttgaaggatcctatgaggcagaagaaggctgtttgtccttggtaggtgtgagatcaactaagcgttatgaaaccacaaggcttgcctatcgtgacagcaagtggcaggaacagaccattaccttgacaggcttcccagctcagatttgccagcatgagctggatcacttggaaggacgaatcatttaggaggaaagcaaatga

SEQ ID NO: 671 - DNA, 1596 bp, Streptococcus pneumoniae
atgaaacgaatagtctttgaacttatttttatcgcaacgacctggtatatctttttaccgccccttaacctgaccagctgggaatttctcttcttcctctgtgggcatttgttagttgtggcaatcttatttggctttggcaaggggataaaccttgtcaaaacggttcatgtgcgccacggtaaggcggaagctgccttaaatcttgagggtttcaaaatcaatcggttagggaaaattctgttagcttcgattggaggaattcttctcttggcagctttggtttccttggtaacttccagcatgtttcaggctaaaaattatgccaatgtagtcacggttacggaaaaagactttactgaatttcctaggagtgacaccagtaaggttcctatcctagatagaagtactgctgaaaaaattggagaccgctacttgggttccctaaccgataaggtgtcgcaatacgtagcggcagatacctatacccaattgacaattgatgggaaaccttatcgggtcacaccactagaatatgcagaccctatcaaatggtttaacaatcaagccaagggaatcggtgaatatatcaaggtggacatggtaactggaaatgcggatttggtggacttgaagacaccaatcaagtattcagactcggagtattttaaccgtgatgtcaaacgtcacctgcgcttgaagtacccgaccaaaatctttaaaactccatcttttgaggtggacgatgagggcaatcctttctatgtagcaacggtttaccaaaagcaatttggacttgctgttcctcgtcctgcttcagtcattatcttggatgctacaaatggagaaaccaaggaatacagcttatcagatgttccagaatgggtggacaggatctatccagcagaggaaaccattgagcaaatcaactacaacggcaagtacaaggacggtttcttgaatgccatgatttccaagaaaaacgtgacccagactaccaagggctataattacttgtctatcggtaatgacatctatctctacacaggtgtgacgtcggctaatgcggatgagagtaatcttggtttcatccttgaaaatatgcgaacaggagaaatcactaagtatagcttggcttctgcgacagaagaatcagcccgtgaatcagcagaaggtgctgttcaggagaaatcctacaaagcaaccttcccaatcctcatcaacctcaatgacaagcctctctacatcatgggcttgaaggacaatgctggcttggtcaaagagtacgccctggtagacgcagtcgagtaccaaaatgttatcgttgctactacagtggaagagatgctcagcaagtatgccaataaaaacgaccttgaaattgacaatgcaacgacagaaagcatcaatggagtagtagcagacctcaaatcagctgttatcaagggagacactgtctacttctttaaagttgatggcaagatatacaaggtcaaggcttcagtatccgatgaccttccttaccttgaaaatggtaaaaccttcgaaggtcaagtaggaaaagacaattatctcaagacctttaagctacggtaa

SEQ ID NO: 672 - DNA, 180 bp, Streptococcus pneumoniae
atggaggacaaagaaatgggtttttatttgatggttgcttcaatgctactcggactgctcgctttgaagataggtttttctcagttcaaggagaaaaaagataaattcttatctatcttaacaagtttagctggcacacgccttgttctcgtggctgtctggttaggatggcccaaataa

SEQ ID NO: 673 - DNA, 729 bp, Streptococcus pneumoniae
atgaaaattttaatcccaacagcaaaagaaatgaacacagacttgccaagtatcgaggcaatttctttaacaccagaaagtcaggccgtgcttgatgccttggctctctattctgccagtcaattggagagtttctacaaggtatcagctgagaaagcggcggaagaatttcaaaaatatccaagctttgaaaaggcagactactcaccctatccagccttgatactttttgatgggcttatgtaccgcaacattaagagagataagctgaccgaggcggaacaagattatcttgaaaatcatgtcttcattacctcggctttgtacggtgttgttccagccttgtcacccatggctcctcaccgtttggattttttgatgaaattaaaagttgctggtaagactttgaagagccattggaaggcagtctatgatgaagctctgaagatggaagaagtgattttctctctcttgtcatcagagtttgagactgtattttctaaggaaatcagagcaaagatggtgaccttcaatttcatggaggatagagagcggtcactgaagattcactcaactatctccaagaaagcgcgcggggcctttttaacagctttaatagaaaatcaagtacaaactgtgggggaagcacgtcgcttgaactttgctggatttgtttaccgagaagatttgtcacaaccacagggattggtttttgtaaaggaagtatag

SEQ ID NO: 674 - DNA, 630 bp, Streptococcus pneumoniae
ttgcaagttgttttgctttggtgtaatatattttataacaacgagaaaattctcgtaaatttaagaaaaaggagacacatcatgtctaaaaaagtattatttatcgtcggatcactacgccaaggttctttcaaccaccaaatggccctcgaagctgagaaagcacttgctggtaaagcagaagttagctaccttgattattcagcccttcctctcttcagccaagatttggaagttccaactcatccagctgtagcggcagctcgtgaagctgtccttgctgcggatgccatctggatcttctctccagtctacaacttctctatccctggaacagtgaaaaacttgcttgactggctatctcgtgcccttgacttgtctgatacacgcggcgcttctgcccttcaagacaagttcgtcacagtatcatctgtagccaatgcaggtcacgatcaactcttcgctatctacaaagacctcttgccatttatccgtacacaaggcgttggtgatttcactgctgcacgtgttaatgactctgcctgggcagacggaaaattggttcttgaagaaacagtcctaaactcacttgaaaaacaagctcaagacttgatcgaagctatcaagtaa

SEQ ID NO: 675 - DNA, 489 bp, Streptococcus pneumoniae
gtgaaaaaaagacaaaacaaagcaaaaaataatctactgtggcagtatggtctagggatgacgattttgtttgtggttatcagtgcttcctttctgtatatggtttctcttagcatgaaaccctatcaaacagctaaaagtgaaggagaaaaattagctcagcagtatgcaggattagagcaggccgatcaggttgatttatacaatggcttggaatcttattacagcgttcttggtcgtaataaacagcaagaagcacttgctgttctgattggaaaagatgatcataagatttacgtttatcagctaaatcagggtgtttcacaagaaaaagcagaaacggtttctaaggaaaagggagctggcgaaattgacaagattatctttggtcgttatcaagataagccaatctgggaagtcaagtcaggatctgatttttatctagtagattttgaaacaggagcattggtcaacaaggagggcctatga

SEQ ID NO: 676 - DNA, 1188 bp, Streptococcus pneumoniae
atgaaattatccaaccgtgttttagaaatggaagaaagtgtgactttggctgctggagcccgtgccaaagcactgaaggctgagggcagagatattttgtctctaaccttgggtgagccagatttcactactcccaaaaatatccaagatgccgccattgcatcgattcgagatgggcgtgcttctttttatacagtaacctcaggtctgccagagcttaaggcggtggtcaatagctactttgagcgcttttacggctattctgtagcgccaaatcaagtgacagtcgctgcgggagccaaatattctctctataccttctttatggctgtggtcaatccaggtgatgaagtcatcatcccaaccccatactgggttagctatggagatcaggtcaagatggcagaaggcgttcccgtctttgtttctgctaaggaagacaatcactttaaggtgaccgtagagcagttagaagcagctcgcactgacaagaccaaggttttggtgctgaattcgccatctaatcccacaggtatgatttacacccgtgaggaactcttggcaattggaaactgggctgtagaaaatgatattctcatcctagcagatgatatctatggccgcttggtttataatggtcatgagttcacaccgatttctagcctatcggaagcgattcgcaagcaaacagtggtcatcaatggtgtgtctaaaacctatgccatgactggttggcggattggttatgccgttggagaagcagacattatcgctgccatgtccaagattgcaggtcaaacaacttcgaatccgtcagcagtagcccaatatgcagcagttgaggctctatcaggtgagcaagatactgtagaaagcatgcgtcaggcctttgagaaacgtcttaataccatctatcccctccttgcagaggtgccaggatttgaagtggtcaaaccacaaggggctttctatctattcccaaatgtcaaaaaggccatggagatgaaaggctacacggatgtgacagactttacaactgctatattagaagaagccgaagtggccttggtaacaggagctggatttggagcaccagaaaatgtccgcctcagctatgcgacagacctagacacgcttaaagaagcagtcgaacgcttgaaagcatttatgggtagtgagaatgattga

SEQ ID NO: 677 - DNA, 372 bp, Streptococcus pneumoniae
gtgagaatgattgatcattttgagattaaggtaaaggatttacaaatttcagaaggattttataggagttttctcgctcctttggactataaattggcttttaagactagttctctaattagttttctatccccgaacagccctcatcctggtggtgatttttggctgactcagggaacacaagatcctgttcattttgcttttttagcagaaaataaggaagaagttcaggcttgttatgaggctggcatagaggcaggtgggcgagacaatggggttcctggttatcgaagtgagcatccgatttactatgctgcttttatgattgacctggatgggaacaatatagaggtggtttgccataaagaataa

SEQ ID NO: 678 - DNA, 1344 bp, Streptococcus pneumoniae
atgacaaaacgtgtaacgattattgacgtaaaagactatgttggtcaggaagtgacgattggcgcttgggttgccaacaaatcaggaaaaggaaaaatcgctttcttacaattgcgtgatggaacagccttctttcaaggtgtggcttttaaaccaaactttgtcgaaaaatttggtgaagaagtgggacttgagaagtttgatgttatcaaacgcttgagccaagaaacgtctgtttatgtgacaggtattgtcaaagaggacgaacgttctaaatttggctatgagttggacatcacagacatcgaagtgatcggtgaatctcaagactacccaatcacaccaaaagaacacggaacagactttttgatggataaccgtcacttgtggctacgctctcgtaagcaagtagctgtgttgcaaatccgtaacgctattatctatgcaacttatgagttctttgacaagaacggttttatgaagtttgacagcccaattctttcaggaaatgcggcagaagattctacagaactctttgaaactgactacttcggaacgccagcctacttgagccaatcaggtcagctttacctagaagcaggggctatggctcttggtcgtgtctttgactttggtccagttttccgtgctgaaaaatcaaaaacacgccgtcacttgactgagttctggatgatggatgctgagtactcatacttgacacatgatgagtcgcttgacttgcaagaagcttatgtgaaagctcttctacaaggtgttcttgaccgcgcgcctcaagccttggaaaccttggaacgtgatacagaactcttgaaacgctacattgcagagccattcaaacgtatcacttacgatcaagccattgacctcttgcaagagcatgaaaatgatgaagatgctgactacgagcatcttgagcatggtgatgactttgggtcaccacacgaaacttggatttcaaaccactttggtgtgccaacatttgtcatgaactatccagcagccatcaaggccttctacatgaaaccagttcctggaaatccagagcgcgtgctttgtgcagacttgcttgctccagaaggctatggagaaattatcggtgggtctatgcgtgaggaagattacgatgcccttgtcgctaagatggatgaacttggcatggatcgtacagaatatgaattctaccttgaccttcgtaaatacggtacagttccacacggaggatttggtatcggtatcgaacgtatggtaaccttcgcagcaggaacaaaacatatccgtgaagctattccattcccacgtatgttgcaccgtatcaaaccataa

SEQ ID NO: 679 - DNA, 387 bp, Streptococcus pneumoniae
atgggcgttttcctgttcttatggtttgatacggtgcaacatacgtgggaatggaatagcttcacggatatgttttgttcctgctgcgaaggttaccatacgttcgataccgataccaaatcctccgtgtggaactgtaccgtatttacgaaggtcaaggtagaattcatattctgtacgatccatgccaagttcatccatcttagcgacaagggcatcgtaatcttcctcacgcatagacccaccgataatttctccatagccttctggagcaagcaagtctgcacaaagcacgcgctctggatttccaggaactggtttcatgtagaaggccttgatggctgctggatagttcatgacaaatgttggcacaccaaagtggtttga

SEQ ID NO: 680 - DNA, 291 bp, Streptococcus pneumoniae
atggctaaatacgaaattctttatatcattcgtccaaacattgaagaagaagctaaaaacgctttggtagcacgttttgactctattttgactgacaacggtgcaactgttgttgaatcaaaaacttgggaaaaacgtcgtcttgcatacgaaatccaagatttccgtgaaggactttaccacatcgttaacgttgaagcaaatgacgatgcagctcttaaagagtttgaccgtctttcaaaaatcaacgctgacattcttcgtcacatgatcgtcaaaattgacgcgtaa

SEQ ID NO: 681 - DNA, 471 bp, Streptococcus pneumoniae
atgattaacaatgttgtacttgtagggcgtatgacacgtgacgctgagttgcgttataccccatcaaatgtagcagttgcgacttttactcttgcagtaaaccgtacatttaagagtcaaaatggtgaacgtgaggctgattttatcaatgtcgttatgtggcgccaacaggctgaaaatcttgctaactgggctaaaaaaggctcacttatcggggtgacaggtcgtatccagactcgtagttacgataaccagcaaggacaacgtgtctacgtgacagaggtcgtggctgagaatttccaaatgttggaaagccgtagtgtgcgtgagggccacacaggtggagcttactctgcaccaactgcaaactattcagcacctacaaattcagtaccagacttttcacgtaatgaaaatccatttggagcaacaaacccattggatatttcagatgatgatttaccattctaa

SEQ ID NO: 682 - DNA, 261 bp, Streptococcus pneumoniae
acttataaaggagaaaaaacatggctcaacaacgtcgtggcggattcaaacgccgtaaaaaagttgattacatcgcagcaaacaaaattgaatatgttgattacaaagatactgagcttcttagccgtttcgtttcagaacgtgggaaaatccttccctcgtcgtgtaacaggaacttcagctaaaaaccaacgtaaagtaacaacagctatcaaacgcgctcgcgtaatggctttgatgcctttcgtaaacgaagattaa

SEQ ID NO: 683 - DNA, 336 bp, Streptococcus pneumoniae
agtaggcaaatcccctattttcaaaaagtttatcatttttattttaatttcttggatgagaaaaaagacatatttatgaaaaagctccatcgtgcttttaatgtgttctcttgttttcaaactcgtaaaaagggagccactgagcctaactcgctctctcatttcaaagcttgtgaaaaaagacccgttggggtcttaattcgctttcttgttttcaagctcatgaaaaagagacccaaccgggtcttttctttaatcttcgtttacgaaaggcatcaaagccattacgcgagcgcgtttgatagctgttgttactttacgttggtttttagctga

SEQ ID NO: 684 - DNA, 1401 bp, Streptococcus pneumoniae
atggacgcgaaattaagatacaaggcaaagaagatcaagattgtcttttttgatattgatgatacattgcggaattcaaagacagggtttattccaactacaattcccactgtttttaaacagttgcgtgaaaaaggaattttaacaggaatcgcctctggacgtggcatttttggtgttgttccagagattcgtgatctcaagcctgacttttttgtaactttgaatggggcttatatcgaagataaaaaaggtcaggtcatttatcagcatcagattgaaaagtcatatgttgaggagtatatctcttgggctaagcaagaaggaattgagtatggcttggttgggagtcatgatgccaagttgtcgactcgcaccgatatgatgagtgaagctatcaatccaatttatcccgacttagatgtagatcccgatttccatgaaaaagaagatatctatcagatgtggacttttgaagataagggagatgacttgcacttgcctgacagtctctcagacaaacttcgcatggttcgttggcatcaacattcgtctgatattgtgccgatttcaggctccaaagcgacgggggtggaaaaggttgtggaacaccttggcttgaaaccagagaaggtcatggtttttggagatggtctcaacgacttggaactctttgattatgctggaatcagcgttgccatgggaatttctcatgataaaatcaaagaaaaagcagattatattacaaaaacattagaagaagatggcatttttgatgccttagaagtatttggtatggtagaaaaagaattgcattttccacaagtagacattgaaacagtagaaggtcctcttgcgactattaagaccaatcacggagacttacgtatcaagcttttccctgaacatgctcctaaaacagtggctaactttgtatctctttcaaaagatggctactatgatggtgtcattttccaccgtattatcaaggactttatgatccaaggtggagacccaactggaactggtatgggtggcgagtcaatctacggcgaatcttttgaggatgaattctcagaagagctttacaatatccgtggtgctctttccatggcaaatgctggtccaaataccaacggcagccagttctttatcgtgcaaaaccaacacctaccttattctaagaaagaaattactcgtggtggttggccagaaccgattgcagaaatctatgccaatcaaggtgggacacctcacctagaccgccgtcacacggtttttggtcagttagctgatgaagcatcttacgctgtcttggatgtcattgctgctgttgagacaggagctatggacaagccagttgaagatgttgtaattgaaactattgaaatcgaggactaa

SEQ ID NO: 685 - DNA, 252 bp, Streptococcus pneumoniae
atgaaaatcggtgataagctaaaggggcgtattacagggattcagccctacggtgcctttgttgagttagagacgggtgatacggggctgattcacatttcagaaattcggacaggatttattgaaaatattcacgaaaccttgaaagtcgatgaagaagttcaagttcaggtagtggatttagatgaatttacgggggaaagccagtctttctatccgcactttggaggaagaaaagtaccagtttcctag

SEQ ID NO: 686 - DNA, 261 bp, Streptococcus pneumoniae
atggaagaagaacaattattaaaatcaggagagcgcattaaccagctcttttcgacagatatcaaaatcattcaaaatagagaggtttttagctattcggtggatagtgttctcttatcacgatttccacgttttcctaagaaggggttgattgtggatttctgtgctgggaatggagcagtggggctttttgctagcactcgtactcaagcacagatattgtctgttgagatttcaggagcgtttggcggatatggctga

SEQ ID NO: 687 - DNA, 201 bp, Streptococcus pneumoniae
ttgtggatttctgtgctgggaatggagcagtggggctttttgctagcactcgtactcaagcacagatattgtctgttgagatttcaggagcgtttggcggatatggctgaacgctctgtccgtttgaatggattagaggagcaaatgcaggtcatctgcgatgatttgaaaaatatgcctgctcacattcaggggaagtaa

SEQ ID NO: 688 - DNA, 387 bp, Streptococcus pneumoniae
ttgtgtaatccaccctatttcaaggtgaatccttattctaatctgaacgagagtgaacattatctcttggctcgacacgaaatcacgactaatttggaagaaatctgtcgtagtgcccagagtattctcaagtctaatgggcgtttggccatggttcatcgtcctgatcgacttctggatattttggatacgttaaaacgacataatctagcccctaagcgcctgcagtttgtttatccaaaaagagaaaaggaagccaatatgcttttgattgaggcgatcaaggatggctcaacaagtggctttaaggtcttacctcctttgattgtccacaatgatgatggctcttatacgcccgaaatcgaagagatttattatggatcataa

SEQ ID NO: 689 - DNA, 279 bp, Streptococcus pneumoniae
atggatcataaggcttatatgtacgttctggagtgtcgtgatggatcctactatataggctatacgactgatatgagaagacgcctcgctatccacaatagtgggaagggagccaaatatacacgagcacgcttgccagtcaaacttatctatgctcaaggttttgccagtaaggaagaagccatgtcggctgaagctcttctcaagcgtaagaagaggccacagaaggaagaatttttatctgaaaatcaagatagaaatttactccgtttattttga

SEQ ID NO: 690 - DNA, 180 bp, Streptococcus pneumoniae
ttgactgaccacaatgaattccaacaatctgtatcagatatcgctgaagtagaagtttacggtgttgtagaccaccaccgtgtgctaactttgaaactgcaagcccactttacatgcgtttggagccagttggatcagcgtcttcaatcgtttaccgtatgttcaaagaacatggtgtag

SEQ ID NO: 691 - DNA, 666 bp, Streptococcus pneumoniae
agtagaagtttacggtgttgtagaccaccaccgtgtgctaactttgaaactgcaagcccactttacatgcgtttggagccagttggatcagcgtcttcaatcgtttaccgtatgttcaaagaacatggtgtagctgtgcctaaagagattgcaggtttgatgctttcaggtttgatttcagatacccttcttttgaaatcaccaacaacacacccaacagataaaatcattgctcctgaattggctgaattggctggtgtaaacttggaagaatatggtttggcaatgttgaaagctggtaccaacttggctagcaaatctgctgaagaattgattgacatcgatgctaagacttttgaactcaacggaaataatgtccgtgttgcccaagtgaacacagttgacatcgctgaagttttggaacgccaagcagaaattgaagctgcaatgcaagctgccaacgaatcaaacggctactctgactttgtcttgatgattacagatatcgtcaactcaaactcagaaatattggctcttggtgccaatatggacaaggtcgaagcggctttcaatttcaaacttgaaaacaatcatgccttccttgctggtgccgtttcacgtaagaaacaagtggtacctcaattaactgaaagctttaatacgtaa

SEQ ID NO: 692 - DNA, 513 bp, Streptococcus pneumoniae
atgttagaaaatggcgatttgatttttgtgagagatgggtcagacatgggacaggccatccagacttccacaggtaactatagccatgttgccatttatttggatgggatgatttatcatgctagtggacaggctggtgttgtctgtcaagaaccggcagacttctttgagtccaatcatttatacgacctctatgtttacccagaaatggatatccagtcggtgaaggaaagagcttgcagacatcttggagcaccctacaatgcttctttctatccagatgcagctggtttctactgctcccagtatatagcagaaatcctacctatttttgaaactattcctatgaaatttggagatggggaacaggagattagtgatttttggagggagtattacatagaactaggtctgcctgttcctctgaaccaagctgggaccaatcctagtcagttggcagcatcgcctctgttacaatgtaaagaaaggaatcttcatgattcagatttttaa

SEQ ID NO: 693 - DNA, 315 bp, Streptococcus pneumoniae
ttgatccgctatctggaccagtatgaggatgtgattctacgggaaattaaggctcaatttccagatgttgcagttgataaactcatggaagagtatataaaggcaggcttgattctacgtgaaaataagcgctattacctcaattttcctacgcttgaatcacttgatagtcttgaactggatcaagagatttttgtcagagaagctagtccggtctatcaagccttgttggagcagagttttgagacggaattgcgcaatcaaatcaatgcagctattttagttgaaagacggactttgcgcgcattaaaatga

SEQ ID NO: 694 - DNA, 285 bp, Streptococcus pneumoniae
atgaccctgtccaattatttttacaaggtcaaacagcagtatcctttgacagaaaaacagcaggagctctatgacattttaggagatgttaatcctgagtatgccctcaagtatatgacggcttttttgttgaaatttctcaaaaaagaccagcttatgcagaaatgccgtgatatctttgtggacagtttggttgtcttaggctatattgtgcaaaatgaagatagaaagtatgagttggctatcgattttgataaggagagattaactttctacttagcgtga

SEQ ID NO: 695 - DNA, 195 bp, Streptococcus pneumoniae
atgtcacttgaaaacaaattggaacaagcaacaggcgctgtcaaagaaggttttggtaaagttactggagacagcaagacagaacttgaaggagctgttgaaaaaacagttgctaaggcaaaagacgttgtagaagacgcaaaaggtgctgtagaaggtgccgttgaaggtttgaaaaacgtttttactaaataa

SEQ ID NO: 696 - DNA, 939 bp, Streptococcus pneumoniae
catgatgaatcaggctgtgaaaatgaccgtacccacctcatcatggaagtctccagtcaagcctatctagtccatcgagtctatggactgacctttgatgtaggagtctttcttaacatcactcctgaccatatcggcccgattgaacaccctagctttgaagactatttctaccacaagcgtctcttgatggaaaatagccgagcagtcatcattaacagtgacatggaccacttctcagtcttgaaagaacaggttgaagatcaagaccatgatttctatggtagccaatttgataaccaaatcgagaattccaaagcctttagcttttcagctacgggtaaactcgctggagattatgatatccaactcattggcaacttcaaccaagaaaatgcagttgctgctggacttgcttgtctccgtctcggagcaagtcttgaggacatcaaaaaaggcatcgctgcaacccgcgttcctggtcgtatggaagtcctcactcagaaaaatggagccaaggtcttcatcgactatgcccacaatggggatagtctgaaaaaactcatcaatgtggttgaaactcatcaaaccggaaagattgctctggttctgggatcaacaggaaacaagggagaaagtcgtcgtaaggactttggcctcctcctcaatcaacaccctgagattcaagtctttctgactgctgatgaccctaactatgaagacccaatggccattgcagatgaaattagtagctacatcaatcatcctgttgaaaagattgcggatcgccaagaagccatcaaggcggcaatggctatcacaaatcacgaattagatgcagttattattgcgggtaagggagccgattgttaccaaatcatccagggcaagaaagaatcctacccaggagatacagccgtcgcagaaaattatttataa

SEQ ID NO: 697 - DNA, 576 bp, Streptococcus pneumoniae
atgattaagattgaacccgtattagatattttaaagaaagatggcctttttcgcgaaattattgaccaaggtcattaccactacaactacagcaaagttatttttgatagcatcagctacgacagccgaaaagtaacagaagacactcttttttttgcaaaaggcgctgcctttaaaaaagaataccttctttctgctataacacaaggtttagcttggtatgtagctgaaaaggactacgaagtcgatatccctgtcatcattgtgaacgatataaagaaagccatgagtttgattgccatggagttctatggtaatccacaagagaaactcaaactccttgcctttactggtactaagggtaagacaacagcaacctatttcgcctataacatcttatctcaggggcatagacctgctatgttgtcgaccatgaacacaactcttgatggcgagactttctttaagtcagcgttgacaacccctgagagtattgacctctttgacatgatgaatcaggctgtgaaaatgaccgtacccacctcatcatggaagtctccagtcaagcctatctag

SEQ ID NO: 698 - DNA, 1623 bp, Streptococcus pneumoniae
atgtcgcacgaaaacaatcaccagcaggcccagatgttacgggggactgctttgctaacggctagtaactttatcagtcgcctactcggggctgtttacattatcccttggtacatctggatgggggcttatgcagctaaggcaaatggtctctttaccatgggttacactatctatgcttggttcttgttggtttcaacagcggggattccagttgcggtggccaagcaagttgccaagtataataccatgcgagaagaagagcatagctttgccctgattcggagcttcttaggctttatgacaggactaggcctggtttttgctttagtcttgtatgtctttgctccttggctagcagacttgtctggcgtgggcaaagacttgatcccaatcatgcaaagcttggcttggggagtcttgattttcccgtctatgagtgttatccgaggatttttccaagggatgaataacctcaaaccctatgccatgagccaaattgctgagcaggtcattcgtgttatctggatgctcctagcaacctttatcattatgaagctcggttcaggagattatctagcagccgttacccaatcaacctttgctgcctttgtcggtatggtagccagttttgcagtcttgatttatttccttgcccaagaaagttcactcaaaagagtctttgaaacaggagataagattaacagtaagcgtctcttggttgataccattaaggaagccattccttttatcctgacagggtctgccatccagatcttccagattttggatcagctgacctttatcaatagtatgagctggtttaccaactacagcaatgaggacttggttgtcatgttttcttatttctcagccaatcctaataaaatcacgatgattttgatttctgtaggggtttcgattgggagtgttggtttgccacttttgacggaaaactatgtcaagggggacttgaaagcggcttctcgtctcgttcaggacagtctcaccctactctttatgttcttgctaccagcaacggttggagtggttatggtaggagaacctctttatacggtcttctatggtaagccagatagtttggctctgggcttatttgtctttgcagttttgcagtctattattttaggcttgtacatggtcttgtctccaatgcttcaggccatgttccgcaaccgcaaggccgttctctattttatctatggttctattgccaagctagtcttgcaactacctaccatcgccctcttccacagttatggtcctttgatttcaacaaccattgctctcatcattcctaacgtcttgatgtatcgggatatttgtaaagtaactggtgtcaagcgcaaggtgattttgaagcgaaccattttaatcagtttgctgaccctagtcatgtttctgttaataggaaccatccagtggctgttaggatttttcttccaaccaagtggacgtttgtggagcttcttttatgtagctcttgtcggtgccatggggggtggactttatatggttatgagtctgcgtacctatttattagataaggtaataggaaaagcccaagcagatcgcctgcgagcaaaatttaagctttcgtaa

SEQ ID NO: 699 - DNA, 1959 bp, Streptococcus pneumoniae
atgaaaaagtctaagagcaaatatctaaccttggcaggtcttgtcctgggtacaggagttttattgagcgcgtgtggaaattctagcacggcgtcaaaaacctacaactatgtttattcaagtgatccatctagcttgaactatctagcagaaaaccgcgcagcaacatccgatattgttgcaaatttggtagacgggttattagaaaatgaccaatatgggaatattattccatcattagcagaggattggactgtttctcaggacggtttgacctatacctacaaacttcgtaaggatgccaagtggtttacttctgagggagaagaatatgcgcctgtaactgcccaggattttgtgacaggtttgcaatatgcagctgataaaaaatcagaagccttgtatctagtgcaggactctgttgctggtttggatgactatatcactggtaaaacaagcgacttttcaactgtcggtgtcaaggcacttgatgaccaaacggttcaatatactttggttaaaccagaactttactggaattcaaaaacacttgcaacgatactttttcctgttaatgcagatttcctgaaatcaaaaggggatgattttgggaaggcggatccatctagtattttgtacaatggacctttcttgatgaaagcacttgtctcaaaatctgctattgaatataagaaaaaccctaattactgggatgctaagaatgtctttgtagacgatgtgaaattgacctactatgatggtagcgaccaagaatcactggaacgtaattttacagctggtgcttatactacggctcgtctttttcctaacagctccagctatgaagggattaaagaaaaatacaaaaacaatatcatctatagtatgcaaaattcaacttcatatttctttaattttaacctagataggaagtcttacaattatacttctaaaacaagtgacattgaaaagaaatcgactcaggaagcagttctcaataaaaacttccgtcaggctatcaattttgcttttgacagaacatcttatggggctcagtctgaagggaaagaaggtgcaacaaagattttgcgtaacctagtggttcctccaaactttgtcagtatcaagggaaaagactttggtgaagttgtagcctctaagatggtcaactatggtaaggaatggcaaggtatcaactttgcggatggtcaagacccttactacaatcctgagaaagccaaggctaagtttgcggaagctaagaaagaactcgaagcaaagggtgttcaattcccaatccacttggataagactgtggaagtaacagataaagtaggcatacaaggagttagttctatcaaacaatcaattgaatctgttttaggttctgataatgtagtgattgacattcagcaattaacatcagatgagtttgacagttcaggctactttgctcaaacagctgctcagaaagactatgatttatatcatggcggttggggacctgattatcaagacccgtcaacctatctcgatatttttaatactaatagtggaggagttctacaaaatcttggactagagcctggagaagccaatgacaaggctaaggcagttggactggatgtctatactcaaatgttggaagaagctaataaagagcaagatccagccaaacgttatgagaaatatgctgatattcaagcttggttgattgatagttctttagttcttccaagtgtttcgcgtgggggaacaccatcattgagaagaaccgtaccatttgctgctgcctatggtttaaccggtacaaaaggggttgaatcatataaatacctcaaagtacaagataagattgtcacaacagacgaatatgcaaaagccagagaaaaatggttgaaagaaaaagaagaatccaataaaaaagcccaagaagaattggcaaaacatgtcaaataa

SEQ ID NO: 700 - DNA, 555 bp, Streptococcus pneumoniae
ggagtatttatgaaattaaaattattaagagtagatactaaggtgattatggggagtttcttacttgttctgtctagtctacttgctttgttgcttccccttatcttaaagggtttaatagatgggagttctattgaaaatataggttccaaagtatttcaatcgtttttgatttttattggtcaagccttgttttcttctattggttactatctgtttagtcaatcgggtgaaaaaaagatagcaaaaatcaggaaaaaagtgatagaggggttgatttatgcagagaaatccttctttgataagagccaaagtggggagttgacttctgccattgtcaatgacatgagtgtcattcgtgagtttttaattacgactttcccaaatattattctgagtttagttatggtacttggttccattgtagtcttatttagtcttgattggaatctttctctacttttattcatcactcttccttgtatgatgtttattatcttgcccctttccaatatcagtgaaaagtatagtcgtcgtttacaggaggaaatttaa

SEQ ID NO: 701 - DNA, 540 bp, Streptococcus pneumoniae
ttgactgaaaagattcaagaacatgaattaattaagactaaccaagcagagaaaagtgtacaggatgttttggataattgtattgaaagggtacaaaacaattcactgaaatcagatagggttacttcttttgagaccccgtttgctctcttatttatctttgcgactatagctgtgatgctaacctatgggggttatcgggtcagcgcaggatatatatctgtgggaaccttggtttcgtttttgatttacctctttcaattacttaatcctattagtaatatagctaattttgtaactgtttattctaggagcaagggatcttcagttgcactggataacttgcttgcagttcctaaagaaaaatttgagggaggaaaatcggtatcaggacaagggttgaattttaaccatgtctattttggttatgatgaaaatcgacctgtcttaaaggatattacttgttcaattttcaaggggcaaaaattgcttttgttggaccatctggatcaggaaaatcaacgattgtgcgtttgttag

SEQ ID NO: 702 - DNA, 546 bp, Streptococcus pneumoniae
atggagcaatcaagtatatatgattttaacttaaaagaatggagaagtaaaatcgcttgggtttcacaaaataatgcagtcttatctggcagtattcgtgacaatctttgtctcggtttgaatcgcttagtaactgatgatgaattgatgaaagtgctagacttagtatcactaggtgatgagattcgctccatgaaagagggactagatactgaagttggtgaacgcggacgattcttgtcaggggggcaaagccaaagacttcaaatagctagaacctacttaaaagatgctgaaattcttatatttgatgaagctactgctaatcttgatgcggattctgagtatgcgattatcagtagcctctattctgtattaaaggagaagacggttgtgattatagcgcatagtttgtcaacggtaaaagatgtggattgtattttcttcttagaggaggggaaaatcactggctcaggaactcataaggaactactggaaaatcatgagcgttatgctcgttttgtgcaggagcaaatgatagagtga

SEQ ID NO: 703 - DNA, 1095 bp, Streptococcus pneumoniae
atgagcaaggaattacacattaacacaattttggcccaggcgggtattaagtcagatgaagcgacaggtgcattggtgacaccgcttcatttttcaacgacctatcagcatccagagtttggtcgatctactgggtttgactatacgcgcactaaaaatccaactcgtagtaaggctgaggaagtcttggcgactattgagtcagcagactatgccttagcgactagctcagggatgtcagctattgtactggcctttagcggctttccagtaggaagtaaggtcttggcagtgcgtgatctttacggcggttcttttcgctggtttaaccaagtggagcaggaaggtcgtttccattttacctatgccaatacagaagaagagttgattgccgagttagaaaaggatgtggatgttctctatatcgaaaccccaaccaatcccttgatgttggaatttgatatcgaaaaactagcaaaattggctcatgctaagggtgccaaagtggtggtggacaataccttctatagccctatctaccaacgtccgattgaagatggagcagatatcgttctccattcagcaaccaagtatctagcaggccacaatgatgtcttggctggagtggttgtgaccaatagtttagaactatacgagaagcttttttacaatctcaatacaacaggggcagtcttgtctccatttgacagctaccagttgcttcgtggtctcaagaccttgtctcttcgtatggagcgctcaacagctaacgcccaagaagtggttgcctttttgaaggattctccagcagttaaggaagttctctacactggtcgtggaggcatgatttcctttaaagtagccgatgaaacacgcattcctcatattttgaacagtctcaaggtcttctcttttgcggaaagtttgggcggagtggaaagtcttattacttatccaacgactcaaactcatgctgatattccagcagaagtacgccattcttatggtttgacagatgacctcttgcgtttgtctattgggattgaggatgctagagatttgattgcagatttgcgccaagccttagaaggataa

SEQ ID NO: 704 - DNA, 1167 bp, Streptococcus pneumoniae
atgggaaaatatgattttacaagcctgcccaaccgtttagggcaccatacctataaatggaaagaaacagaaacggatagtgaagttctaccagcttggatagcggatatggactttgtggtcttgcctgaaatccgccaagccgtgcaaacttacgcagaccaactggtttatggttatacctatgccagtgaagacttaattaaggaagttcaaaagtgggaagctacacaatacggttacaactttgacaaagaggctcttgtctttatcgagggtgtggtaccagccatctcaacagctattcaaacctttacaaaagaaggcgaggcggttttaattaacacgcctgtctacccaccctttgctcgcagtgtcaagttgaataatcgtagattgattactaattccttagtggaaaaggatggtctgtttgagattgactttgaccaacttgaaaaggatttggtggaagaggaggttaaactctatattctttgcaaccctcacaatcctggtggacgtgtttgggaaaaagaagtgttggagaagattggccaactctgccaaaaacacggtgttttgttagtttcggatgagattcaccaagatttgaccctctttggtcacaaacaccagtctttcaataccatcaatcctgccttcaaaaattttgctatcgtcttgagcagtgccactaaaacatttaatattgctggaacaaaaaattcctatgcagtcattgaaaatcctaagttgagactagctttccagaaacgcctgttggccaataatcagcatgaaatttcaggcttgggttatttggcgacagaagctgcctatcgatacggtaaagattggctagaggaactcaagcaagtctttgaagaccacatcaattatgtggtggatctatttggaaaagagactaaaatcaaggtcatgaaaccgcaaggtacctacttgatttggcttgacttttcagcttatgacctgactgatgaaacattgcaagagttgttgagaaatgaagccaaggttatcctcaaccgtggtttggattttggagaggaaggaagtctccatgcccgcatcaatatagctatgcccaaatctctgttgcaagaagtctgtcagcggattgtggctacttttgccaaacgttaa

SEQ ID NO: 705 - DNA, 3099 bp, Streptococcus pneumoniae
atggctaaattgattccggggaaaattcgtatcgaaggtgttgccctttatgaaactggtaaggttgatatcatcaaggaaaagaacaatcggctctacgctcgcgttgcagaagaagaactgcgctatagtttagaggatgatttggttttttgtgcctgtgatttttttcaaaagaggggttactgtgtgcatttggcagcgctagagcattttctgaaaaatgatgagcgtggtcaggaaatcttgtggagtctggaagaaggtcatgaagaaaaagaggctgttgaaaccaaggtgaccttgggtggcaagtttttggatcgaattttatctccaaaatcagaatgcgcctatgagttatcagctgtgggtcaggtggaagcaggaaccaatcatatcttgtggactctgagaatcggtcaaatcaatagccaaaaatactatgtcattcgggatattccactttttttaaggattgtcgagcagagaaagtcgtatatgattggcaagatttatgaggagtctctttcttgggaagcctttgatgatgccagccaagaacttttgactttcttgcacggactaacggaggaagggctggtttcagacctcttttgccaaaaccaaggtcggcacctctttttccctctgaccttttttgagcagggtgtgaatttactgatggccttgccccattttcaatttgaccatcaagtggatagctaccaaaccctgctttttcaggatatgcatgctgatgccaatctatttgcctttacagtaacagaatactcggactattttgaaatggaaatcagtgagagtcctagggtcaatgtcttttatcagggagcagtacttttccataaaggtcaggtttattttttaacagaccagcagatgcgtcttctcaaggaaattaaagcgttacctgtgggtcaacaaggaaagaaatacctgcaatttgatagcagtgatcgagacaaattggcctcctgtctgactctttttatccagatgggcaccgtttcagctccagaacgtctacaaatcaaaacttttgcgccctctttttactttgacagggaagaagataatcggattcgtttagaaattcagtttgattatggaaatagacaggtatctagccgacaagagctagaagaattaccattttcaagtgacgcggacttagaagaaagaattttccaagtctgtttggctgcgggctttgaagccgattttcaatcttggcgtcaggccttaaaagcggagtctgtctatcatttttttcatgatatcattccagtctttgaaaaactcgggcatgttgacctatcagataaactagaagagctttatagcctagcgagtcctcaggtgcagattgcctccaagggaggtctcttggaaatccagtttgattttcaagatattgcccaggaggaaatcgaccaagccatgcaggccttggttgccaatcaggatttttatattgattcgtctaatcaagtttactttttcgatgaagaaaccaagaaaattcgccaaaatctacaggaactggggcaatttgaattaaaagatgggaccttgcaggctcggaaatccttggcctacagtttagctcatctctttgaagggcgagaccgtgtttctttttcacaagaattccagaatctggcccaggatttgacacatccagaggactttcctcgacaggcaactcaggttcaggctgacttgcgagattatcaggaaaagggaattggctggttgcagatgctccatcattatggttttggtgggattttggctgatgatatgggacttgggaaaacccttcagaccattgcttttttgactagtcaagtgacaaaagaaagtcgggttttgattctcgctccgtcaggtttgatttacaactgggcagatgagtttcagaaatttgccccacagttggatgtggctgttgttcatggtttgaaagcaagtcgtgaggagattcttgccgagagccatcaaatctatgtgactagctatgccaccttccgtcaggacagtgagttttatcaggggatggccttttacttccttttcttagatgaggctcaggtcatgaaaaatgcccagaccaagattgcccagaccttgagacaatttgtggtgccgtcggtctttgccttgtcaggaactccgattgaaaaccatctgggtgagttgtggtctattttccaaatcgtcatgcccggacttttgccaagcaagaaagaatttatgaaattgccagcagagcgagtggctcagtttatcaagcctttcgtgatgcgacgcaagaaagaagaagttctgactgaattgccagacttgattgaggtggtttataaaaatgaactggaagaccagcaaaaggctatttaccttgcccagttacaacagatgcgagaccatctggctcaagtgtcagaacaggaatttcagcgaagtcgtgtggaaattttatctggtttgatgcgcttgcgtcaaatatgtgacactcctgccctgtttatggaagattatcagggagccagcggcaaactagatagtctccgagacctactggtacaggtggcagacggcagacaccgtgtcttgattttctctcagttcaagggaatgttggaaaaaattgaacaagaactgccagacttgggcctgacatcctttaaaattacgggttcaaccccagccaaggaaagacaagacatgaccaaggcctttaaccaaggagaaagagatgcctttctgatttccctcaaggctggtggggtcggtctgaacctgacaggtgcagatacagtgatcttggttgacctttggtggaatcctgcggtggaagcgcaagccattggccgtgcccatcggatgggtcaggaagaaacggttgaggtctatcgcttggtgaccaagggaaccattgaagaaaaaattcaggaactccaagaacaaaagaaacatctggtgtcacaagtattggatggcacagagtcacgtggtagtctgaccctagcagaaattagagaaattttgggaatttctgaagccaacacttga

SEQ ID NO: 706 - DNA, 618 bp, Streptococcus pneumoniae
atgaaacaagaacgatttccattggtgtcagatgacgaggtcatgttgactgaaatgccagtcatgaatctctatgatgagtctgatctgatcagtaatatcaagggtgagtatcgagataaaaattatttagaatgggctcctattactgaagaaaaaccagtaaaaccgattgaaaagcaagtcgaaaaacctaaaaaggctcctttaggggttaaaaaagaaggaaagagctatgcggaggtggcgcgtgaagaagcgcgtgcggacttgaaaaagaaacgctctgctaactacctaactcaggatttcagtcttgcgagacgtcattctcagcccagtctagttagacagggcaatcaaccgacagctcctttccaaaaggaaaatcctggtgaatttgtcaaatatagccaaaaattgacccagtctcattatatcttggcggaagaagttcattctatccctaccaagaatgaagaagtgtcagcacctgctccaaagaaaaacaattatgattttctaaagaagagccaaatctacaataaaaaaagtaaacaaacagaacaagaacgtcgggttgcccaagagttgaatctgaccagaatgacagaatag

SEQ ID NO: 707 - DNA, 1335 bp, Streptococcus pneumoniae
atgtcaaagacatatcattttatcggaattaagggatcagggatgagtgccttggccttgatgttgcaccagatggggcacaaggttcagggatcagatgttgaaaagtactactttacccaacgcggtcttgagcaggcaggaattaccattcttccttttgatgaaaagaatctagacggtgatatggaaattatcgctggaaatgcctttcgtccagataacaacgtcgaaattgcctatgcggaccaaaatggtatcagctacaaacgttaccatgagtttctaggtagctttatgcgtgactttgttagcatgggagtagcaggagcacatggaaaaacttcaacgacaggtatgttgtctcatgtcttgtctcacattacagataccagcttcttgattggagatgggacaggtcgtggttcggctaatgccaaatattttgtctttgaatctgacgaatatgagcgtcacttcatgccttaccacccagaatactctattatcaccaacattgactttgaccatccagattatttcacaagtctcgaggatgttttcaatgcctttaacgactatgccaaacaaattaccaagggtctttttgtctatggtgaagatgctgaattgcgtaagattacgtctgatgcaccaatttattattatggttttgaagctgaaggcaatgactttgtagctagtgatcttcttcgttcaacaactggttcaaccttcaccgttcatttccgtggacaaaacttggggcaattccacattccaacctttggtcgtcacaatatcatgaatgcgacagccgttattggtcttctttacacagcaggatttgatttgaacttggtgcgtgagcacttgaaaacatttgccggtgttaaacgtcgtttcactgagaaaattgtcaatgatacagtgattatcgatgactttgcccaccatccaacagaaattattgcgaccttggatgcggctcgtcagaaatacccaagcaaggaaattgtagcagtctttcaaccgcatacctttacaagaaccattgccttgttggacgactttgcccatgctttaaaccaagcagatgctgtttatctagcgcaaatttatggctcggctcgtgaagtagatcatggtgacgttaaggtagaagacctagccaataaaatcaacaaaaaacaccaagtgattactgttgaaaatgtttctccactcctagaccatgacaatgctgtttacgtctttatgggagcaggagacatccaaacctatgaatactcatttgagcgtctcttgtctaacttgacaagcaatgttcaatag

SEQ ID NO: 708 - DNA, 465 bp, Streptococcus pneumoniae
atggaaattccaattaagatcattcaggcaagcaagtctgatttgcctgagataggggcacttcagacctcgtcttttccagctgaaaagcagcaactttcccatattttagaagaaagtatccgtaagtgtgcggatacctttcttctagctagggatgaaaatcaacttttaggctatattttatcaagtccccagtcagacaatccgcaatgtctaaaagtacattctttagtcatcgagtctgaccatcagagacagggcttgggaacacttcttcttgcagccttgaaagaggtggcagttgagctggattacaaagggattcgtttggagagtcctgatgagctgctttcctattttgaaatgaacggttttgttgatgaagaagcaactttgctctatgcaactagccagggctatagtatgatttggtttaatcccttttatctggaggaacaatga

SEQ ID NO: 709 - DNA, 357 bp, Streptococcus pneumoniae
atgaaaatcagacaagcaagattagaagatttggatcggattgttgaacttgaatttgaaaatttttcggtcgaagaagccattcctccttctgtctttgaagcacatttgagagaaattcagacctcttttctggttgctgaaaaagaaggaagaatcatgggttatatcgaaggaccagttggcctgcaccgccatctgcaagaccagtcttttacagaagaaataaaagactctcgtcatgaacctggtggttatatctctgtgacctggctgtctattgccaaggaggcacagggactcggactgggtcagaaattgctgacagccttgaaagaagttgctcttgaagaataa

SEQ ID NO: 710 - DNA, 213 bp, Streptococcus pneumoniae
gttaggaaaggtatcataatttgcttttttggaacttttaagataaaaaataatggaattatccacaaggaggaaaaacttttgagtgaaaagtcaagaaaaaaagagaaattaagctttaaagagcagattttgagagatttagaaaaagtaaaaggttatgatgaagttctgaaagaagataaggcagtaggttcgcactcctgcaaatga

SEQ ID NO: 711 - DNA, 1506 bp, Streptococcus pneumoniae
atggctgattccttgtcaccggtagagaagattatgagaaaagctcctaccgtgcctactcacccaagtcaaggtgtaccagcttctccagcagatgagattcaaagagaaactcctggtgttccaagtcatccaagtcaagatgtaccttcttctccagcggaagaaagtggatcaagaccaggtccaggtcctgttagacttaagaaacttgaaagagaatacaatgaaaccccaacaagggtagctgtttcctatacgacggcagagaaaaaagcagaacaagcaggtccagaaacacctacgcctgctacagaaacagtggatatcatcagagatacatcacgtcgtagccgtagagaaggagcaaaacccgttaagcctaagaaagagaagaagtcacatgtgaaagcttttgtgatttcattccttgtattccttgccttgctctcagcaggtggttactttggttaccagtacgtgctagattccttattacctatcgatgctaattctaagaaatatgtgacggttggaattccagaaggttcaaacgttcaagaaatcggtacgacgcttgaaaaagctggtttggtaaagcatggtctgatttttagtttttatgccaagtataaaaattataccgacttgaaagcaggttactacaatttgcaaaagagtatgagtacagaagacttactcaaagagttgcaaaaaggtggaacagatgaaccgcaagaacctgtacttgcgactttgacaattccagaaggttataccttggatcagattgctcaaactgtgggtcaattgcaaggtgacttcaaagagtctttgacagcggaggctttcttggctaaagttcaagatgagacgtttatcagtcaagcagtagcgaaatatcctactttactggaaagtttgcctgtaaaagacagcggtgcgcgttatcgtttggaaggataccttttcccagctacatactctatcaaggaaagcacaactattgagagcttgattgatgagatgttagctgctatggataagaacctatctccttactatagtactatcaaatctaaaaacttgactgtcaatgagttgttgaccattgcttccttggtcgaaaaagaaggtgccaagacagaagatcgtaagctcattgcaggtgtattctacaatcgtttgaatcgtgatatgccacttcaaagtaatattgcaatcttgtatgcccaaggaaaactggggcaaaatatcagtctagctgaggatgttgcgattgataccaacattgattcaccttataatgtttataaaaatgtaggtctcatgcctggtccagtcgatagtccaagtctggatgcgattgagtcaagcatcaatcaaactaagagcgataacctctactttgtagcagatgtcacagaaggcaaggtctactatgctaacaatcaagaagaccacgaccgcaatgtcgctgaacatgtcaacagcaaattaaactaa

SEQ ID NO: 712 - DNA, 483 bp, Streptococcus pneumoniae
atggcagaaaaaacatatcctatgacccttgaggaaaaggaaaaacttgaaaaagaattagaagaattgaaattggttcgtcgaccagaagtggtagaacgcattaagattgcccgttcatacggtgacctttcagaaaacagtgagtacgaagcagctaaggatgaacaagcctttgtcgaaggacaaatctctagcttagaaacaaaaatccgctatgctgaaatcgtcaatagcgacgcagttgcccaggacgaagtagcgattggtaaaacagtcaccatccaagaaattggtgaggacgaagaagaagtttatattatcgtaggttcagctggtgcggatgcctttgcaggtaaggtttcaaatgaaagcccaattgggcaggccttgattggcaagaaaacaggtgatacagcaaccattgaaacgcctgttggtagctatgatgtaaaaatcttgaaggttgaaaaaacagcctaa

SEQ ID NO: 713 - DNA, 183 bp, Streptococcus pneumoniae
gtgcttcactcactcctttttccattttgctactcttcgaaaatctcttcaaaccacgtcagcgtcgccttgccgtatgtatggttactgacttcgtcagtttcatctacaacctcaaaacagtgttttgagcaacctgcggctagtttcctagttttctctttgatttttattgagtattag

SEQ ID NO: 714 - DNA, 489 bp, Streptococcus pneumoniae
ttgatttctaagacattgttagaaattagattaaattccttaatcgatttgcgcatgttttatttcatttcactatactttagattggaaaataaggaatcacataaatcgcaagaaatagggaatctgattcgtgtttataaccgttcaaaaagagaagaggctgaaagtgagccacttaatctttatgtcgaagatgaaaagggcaatctcctggcaggtttgatagcagagacttttggaaattggctagaactagaaatcgagtatttgtttgtaaaagaggaactgcgaggacaaggaatcggttcaaaactattgcaacaggcagaaagtgaagctaagaatcgaaattgttgttttgcctttgtcaatacttaccagttccaggcaccggacttttatcagaaacatggctacaaggaagttttttctttgcaagactatctctacattaggcaaagatattattaccaaaagaatctgtaa

SEQ ID NO: 715 - DNA, 198 bp, Streptococcus pneumoniae
ttgattcctaattttggggctacgattatattgtcctcaatatcgtctagaaagacacaatttctaggttataactggtatttatcgatagttactcatatacatcagtccacctccatacttatgtgcgagcctctctttgtattatacctccatactcaccttacagattcttttggtaataatatctttgcctaa

SEQ ID NO: 716 - DNA, 210 bp, Streptococcus pneumoniae
cctagaaattgtgtctttctagacgatattgaggacaatataatcgtagccccaaaattaggaatcaagacttatcaggttaagaaaagaagtgatgttgttgatattttaaacaatttatttaaactaaaaactctctatctattaatccgagattcccctctcggattttgtgttgctttcattaaatttacaggtaagacttgctag

SEQ ID NO: 717 - DNA, 444 bp, Streptococcus pneumoniae
gtgttatacttgttgttcaaccacaaacacaagaaaggcacagaaatgcaagacaattatactacaaaaggtaaacatttgacaatcgatagccgtcgcttaatcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaataatcgcaagcactcggtcaagagatcaagcgtgaccaaggaactaaaggaaaagattctccactatcataaccaaaaatttttgcctgaaatgatggttatggctaaaggggttaacgtgggaatttcaaccatttactattggattcatcatggaaaattggggtaa

SEQ ID NO: 718 - DNA, 492 bp, Streptococcus pneumoniae
ttggagaatgggcattatgagattgatacggttctacttacgagagcgaaaaactactgcttgcttgtcttgacggatcgaaaaagtagacatcagatcatccgattgattccaaataaaagtgctgaggtggtcaatcaggctctaaaactcatcttaaacaacacaagattctttccatccgggcaaataatggaccggaattcaatcgcttgtctaatgtatttcttgaggagcacaatttattatgcacatccctatgcctcttgggaaaggggaactaatgagaatcacaacaggctcattcgtagatggttacctaagggaaccaagaaaatgactcccaaagaagtcgcattcatcgaaaagtggattaacaactatcctaaaaaatgcttggactacaagtcacccagagaagacttctggatggctaacttgaacttgaaatttagcaaaatggaaataatttttattaaacgcttccaatag

SEQ ID NO: 719 - DNA, 201 bp, Streptococcus pneumoniae
atgaatttaacatttttaggcttatgtattgcctgtatgggcgtatctgtcggtgaaggtttattgatgaatggactgtttaaatcagtagcacgccaaccagatatgctttctgagtttcgtagtttgatgtttttaggtgttgcctttattgaaggaactttctttgtaactcttgtcttctcatttattatcaaataa

SEQ ID NO: 720 - DNA, 717 bp, Streptococcus pneumoniae
atggaagaaagtattaatccaatcatctctattggtcctgttatcttcaatctgactatgttagccatgactttgttgattgtgggagttatttttgtctttatttattgggcaagccgcaatatgaccttgaaacccaaaggaaagcaaaatgtacttgagtatgtctatgactttgttattggatttacagaacctaacattggttcgcgctacatgaaagattactcactctttttcctttgtttattccttttcatggtgattgccaataaccttggcttaatgacaaagcttcaaacgatcgatgggactaactggtggagttcgccaaccgctaatttaccgtatgacttaaccttatcttttcttgtcattttgttgacacatatagaaagcgttcgtcgtcgtggatttaaaaaaagtataaaatcttttatgagtcctgtttttgtcataccgatgaatatcttggaagaatttacaaacttcttatctttggctttgcggatttttgggaatatctttgcaggagaggtcatgacgagtttgttacttcttctttcccaccaagctatttattggtatccagtagcctttggagctaatttggcttggactgcattttctgtctttatttcctgcatccaagcttatgtttttactcttttgacatctgtgtatttagggaataagattaatattgaagaggaatag

SEQ ID NO: 721 - DNA, 495 bp, Streptococcus pneumoniae
atgcacgtaacagtaggtgaattaattggtaattttattttaatcactggctcttttattcttttgctagtcttgattaaaaaatttgcatggtctaatattacaggcattttcgaagaaagagctgaaaaaattgcttcagatattgacagagctgaagaagcccgtcaaaaagcagaagtattggctcaaaaacgcgaagatgaattggctggtagccgtaaagaagctaagacaatcattgaaaatgcaaaggaaacagctgagcaaagtaaggctaatatcttagcagatgctaaactagaagcaggacacttaaaagaaaaagccaatcaagaaattgctcaaaataaagtagaagctttacagagtgttaagggtgaggtcgcagatttgaccatcagcttagctggtaaaatcatctcacaaaaccttgacagtcatgcccataaagcactcattgatcagtatatcgatcagctaggagaagcttaa

SEQ ID NO: 722 - DNA, 537 bp, Streptococcus pneumoniae
atggacaagaaaacagtaaaggtaattgaaaaatacagcatgccttttgtccaattggtacttgaaaaaggagaagaagaccgtatcttttcagacttgactcaaatcaagcaagttgttgaaaaaacaggtctgccttcttttttaaaacaagtggcagtagacgagtcggataaggaaaaaacaattgcttttttccaagattctgtgtcacctttattacaaaactttatccaggttctggcctacaatcacagagcaaatcttttttatgatgtgcttgtagattgcttgaaccgacttgaaaaagaaacaaatcgatttgaagtgacgattacgtctgctcatcctctaactgatgaacagaagactcgtttgctccctttgattgagaaaaaaatgtctctgaaagtaaggagtgtaaaagaacaaatcgatgaaagtctcattggtggttttgtcatttttgccaatcacaagacaattgatgtgagtattaaacaacaacttaaagttgttaaagaaaatttgaaatag

SEQ ID NO: 723 - DNA, 1506 bp, Streptococcus pneumoniae
ttggcaattaacgcacaagaaatcagcgctttaattaagcaacaaattgaaaatttcaaacccaattttgatgtgactgaaacaggtgttgtaacctatatcggggatggtatcgcgcgtgctcacggccttgaaaatgccatgagtggagagttgttgaattttgaaaacggctcttatggtatggctcaaaacttggagtcaacagacgttggtattatcatcctaggtgactttacagatatccgtgaaggcgatacaatccgccgtacagggaaaatcatggaagtccctgtaggtgaaagtctgattggtcgtgttgtggatccgcttggtcgtccagttgacggtcttggagaaatccacactgataaaactcgtccagttgaggcaccagctcctggtgttatgcaacgtaagtctgtttcagaaccattgcaaactggtttgaaagctattgacgcccttgtaccgattggtcgtggtcaacgtgagttgattatcggtgaccgtcagacagggaaaacaaccattgcgattgatacaatcttgaaccaaaaagatcaagatatgatctgtatctacgtcgcgattggacaaaaagaatcaacagttcgtacgcaagtagaaacacttcgtcagtacggtgccttggactacacaatcgttgtgacagcctctgcttcacaaccatctccattgctcttcctagctccttatgctggggttgctatggcggaagaatttatgtatcaaggtaagcatgttttgattgtatatgatgatctatcaaaacaagcggtagcttatcgtgaactgtcgctcttgcttcgtcgtcctccaggtcgtgaagccttcccaggggatgttttctatctccacagccgtttgcttgagcgctcagctaaagtttctgatgaacttggtggtggatcaattacagccctaccatttatcgagacacaagcaggagatatctcagcctatatcgcaaccaacgtgatttctatcactgatggacaaatcttccttggcgatggcctcttcaatgcaggtattcgtccagccatcgatgcgggttcatctgtatctcgtgtaggtggttctgcacaaatcaaagccatgaagaaggttgctggtacacttcgtatcgaccttgcttcataccgtgagttggaagcctttactaagtttggttctgacttggacgcagcaacacaggctaagttgaaccgtggacgtcgtaccgttgaggtcttgaaacaacctgttcacaaaccattacctgttgagaaacaagtaaccattctttatgctttgacacatggtttcttggatactgttccagtagatgatattgttcgtttcgaggaagagttccatgccttctttgatgctcaacatccagagattttggaaaccattcgtgatacaaaagacttgccagaagaagcagtcttggatgctgcgattacagagtttctcaatcaatctagcttccaataa

SEQ ID NO: 724 - DNA, 879 bp, Streptococcus pneumoniae
atggcagtgtctctaaatgatattaaaacaaaaatcgcctcaacaaaaaatacgagtcaaatcactaatgccatgcaaatggtatcggctgctaagctaggtcgctctgaagaagctgctcgcaacttccaagtttacgctcagaaagtgcgtaaacttttgacagatatccttcatggtaatggagctggtgcttcaactaatccgatgttgattagccgttctgtgaagaagacaggctatatcgttatcacttcagaccgcggtttggttggaggttataattcctctattttgaaagctgttatggagttgaaagaagaataccacccagacggtaaaggttttgaaatgatctgtatcggtgggatgggagctgatttctttaaggctcgcggtattcaaccactttatgaattacgtggcttggcagaccaacctagctttgatcaagttcgtaagattatttcaaaaactgttgaaatgtaccaaaatgaactctttgatgagctttatgtttgctacaaccaccatgtcaatacgctaaccagtcaaatgcgtgtggaacaaatgcttccgattgttgacttggatccaaatgaagcggatgaagagtacagcttgacttttgaattggaaaccagccgagaagaaattctggagcagttgttgcctcagtttgcagaaagtatgatttacggtgccattatcgatgccaagacagctgagaatgctgcgggtatgacagccatgcaaacagcgacagataatgctaagaaagtcatcaatgatttgacaattcagtataaccgtgccagacaggcggctattacacaagaaattacagaaatcgtagcaggtgctagtgccttagaatag

SEQ ID NO: 725 - DNA, 1407 bp, Streptococcus pneumoniae
atgagttcaggtaaaattgctcaggttatcggtcccgttgtagacgttttgtttgcagcaggggaaaaacttcctgagattaataatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctctatccaggctatctatgtgccagcggatgactatactgacccagcgccagcaacagccttcgctcacttagattcaacaacaaacttggaacgtaagttggtacaattgggtatctacccagccgttgacccacttgcttcaagctcacgtgccttggcacctgaaatcgttggagaagagcactatgcagttgctgctgaagtaaaacgtgttcttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtaggttctatcgaagatgtgattgcaaaagctgaaaaaatgggattttaa

SEQ ID NO: 726 - DNA, 420 bp, Streptococcus pneumoniae
atggctcagttaactgtccagatcgtgacaccagatggtctcgtctatgatcaccatgccagctatgtatcggttcgaactctggatggtgagatggggatcttgccacgacatgaaaatatgattgcggttttagcagttgatgaagtaaaggtaaaacgtatcgatgataaagatcacgtgaactggattgcagtaaacggtggcgttattgaaattgccaatgatatgatcacaatcgtcgctgactctgcagaacgtgctcgtgatatcgatatcagtcgtgcagaacgtgccaaacttcgtgcagaacgtgcaattgaagaagcacaagacaaacatttgattgaccaagaacgtcgtgctaagattgctttgcaacgtgccattaaccgtattaatgtcggaaatagactataa

SEQ ID NO: 727 - DNA, 753 bp, Streptococcus pneumoniae
atggatagaggctatgaaagttacaatctcatggctcattttcaagaaaaaggttggctttatatcatccgtattcgagatggaaaacaatccatgccttcctccttcaacttgccaaatacggagtgttttgatcaaaaagtttctctaaaattatcacgaaagcaaactaatcagctcaaaaaactttatcgtgattttcccaatgactatcattttattccacacaattctatttttgattttcttccagaaacaagtcgaaaacaagatcctgtaacactctatgaactcctttttcgtatggtgcgtttagaagtggagaaaggaaaatacgaaactttagtgacgaatacagactattcagtccaagaattaaaaaatctctacgccagtagatggggcatagagactagttttcgtgacctgaaatacagtattggcttggtcaattttcacgccaaaaagaagggagggattctccaagaaatctttgctcgctttacaaattttaacttttgtcgttgggtaacctcgcaagttgccatcgacagtagtcacaaaaaacaaagatataaagtgtgtttctcagatgcggcttatgcctgccgtttgttttttaacggttccctttcttccctccagttgaaaaactacctcaagaaacagttatctattattcgaccgaatcgaaaatattcaagaaagataaaagctcaatcggtagttgatttcatctatagagtaacataa

SEQ ID NO: 728 - DNA, 195 bp, Streptococcus pneumoniae
ttgttttttgtgactactgtcgatggcaacttgcgaggttacccaacgacaaaagttaaaatttgtaaagcgagcaaagatttcttggagaatccctcccttctttttggcgtgaaaattgaccaagccaatactgtatttcaggtcacgaaaactagtctctatgccccatctactggcgtagagattttttaa

SEQ ID NO: 729 - DNA, 546 bp, Streptococcus pneumoniae
atgataaaacagataaaagcccacttgaataagagtattcagagtatcattggccaaaaagttgagttcgtcaaacaagatgaacaggcctttactcgtaaaagaaggttatcactagaaactatgattcgtacaattctgggcatgggaggaaaatcactatcaaaagaattactagatgccagactgacagtttcaaattcagcctttgttcaaagacgctatcagataaaacctgaagctttctatgctctatttaaagaatttacagcacctattccacttaatactgattttccaatattcgctgcagatgggagtgatatctgtattcctcgaaatcccatggatacagaaacctctatccaaacccaaacggatgttaaatcctataatctcatacacataaatgccctatacgacttgacgactggagtgtatagagatgtctctattcaagacaaacatgcacaacatgagcgcttagctctgattcagatgatggaggcttctccctttcgagaaagctcttgttatcatggatag

SEQ ID NO: 730 - DNA, 1014 bp, Streptococcus pneumoniae
atgaaagaaactgtttattttggaacttatacacgtcgtacttctcaagggatttacaaggcagactttgatacagaaactggtcagctttcaaatctagaactttttgcagctgagccaagtccaacctaccttgcctttgaccagcaccaacatttatacactgttggtagccaagacgataaggggggaattgcagcctatcaaactgacgggactgtgttaaatcatgttgttgaagaaggagctccccactgttatgttgctgtcgatgaaaagcgtgatttggtttacgcagctaactatcacaagggacaagtccttgtttataaacgccaggaagatggtagtcttctacttagtgatatggatcaacacagtggccaaggtccacatgaaaatcaagcttccccccatgttcactatacagatttaacacctgaccactatctagtgacctgcgacttgggaactgaccaagtcatcacctatgacctcgatcaagaaggaaaattatctaagctctatacctatcacagcaagccaggagcaggctcacgccatatcattttccataaccactataaaatcgcttatctcatttgtgaactcaatagtactatcgaagttttaatctacgatggcgttggcgaatttgaacgtatgcaggtcatttcaactttaccggaagcttacgaaggctttaatggaaccgctgctattcatctctctaaagacggtaaatacctctacgcttctaaccgtggccatgattctatcgcagtatataccatccttgcggacggtagcttagagttattagaaatcgttccaacgcatggtcagactccacgtgattttgatttgacacccgaccaaaaatttctcattgttgtccatcaagactctgacaatgcaactgtctttaaacgtaattgtgacaatggtcgtctagcagaactctccaacgacttccatgttcccgaagcagtctgcatccgttttgctccttaa

SEQ ID NO: 731 - DNA, 234 bp, Streptococcus pneumoniae
atgactggcaacatcacaactgctaaaaagtctaaaacaggtgaaaatagaaaactaatcttacttaaaataaaaagattcagtcccaataataaggttactaaaaataccgtaattgccttgttatctaaaaaccacttgaaaaaccaagataggctaaaatgtttctctttttgctccataaatacttcctttctattgttctctcattataccatttttgaaacaaaataa

SEQ ID NO: 732 - DNA, 1167 bp, Streptococcus pneumoniae
atggagcaaaaagagaaacattttagcctatcttggtttttcaagtggtttttagataacaaggcaattacggtatttttagtaaccttattattgggactgaatctttttattttaagtaagattagttttctattttcacctgttttagactttttagcagttgtgatgttgccagtcattttgtctggtttgttatattatttgttgaatcctattgttgattggatggagaagcataaggttaatcgtgttatagctatcactattgtctttgttatcatcgctctctttatcatttggggcttggcagtcgccattccaaatctgcaacgtcaggttttgacctttgcaagaaacgttcctgtttacttagaagatatagataggattgttaatggattggtagcccagcacctgccagatgatttcagacctcaattagagcaagttttgaccaatttttctagccaggctacagttttggcaagtaaggtttcatctcaggcagtcaactgggtgagtgcctttattagcggggcttctcaagtgattgttgccttgattatcgttcctttcatgctcttttatctcttgcgtgatgggaaaggcttgcgtaactatttgacccaattcattccaagaaaattgaaggaacctgttggacaagttttatcagatgtgaatcaacagttgtccaactatgttcgagggcaagtgacagtggctattattgtagcagtaatgtttatcatcttcttcaagattattggtctacgctatgcggttacgctgggggttactgctggtattttaaatctggtcccttatcttggtagctttctagccatgcttcctgctctagtattgggtttgattgctggtccagtcatgcttttgaaagtagtgattgtctttatcgtagaacaaactattgaaggccgttttgtctctccattgattttgggaagtcaattaaacatccaccctattaatgttctctttgttttgttaacttcaggatctatgtttggtatctggggagttttacttggtattccggtttatgcctctgctaaggttgtcatttcagccattttcgaatggtataaggtagtcagtggtctatatgaattagagggtgaggaagtcaagagtgaacaatag

SEQ ID NO: 733 - DNA, 1230 bp, Streptococcus pneumoniae
gtgaacaatagtcaacagatgttacaggctttggaggagcaagatttaactaaggctgagcattatttcgccaaagctttagaaaatgattcaagtgatcttctgtatgaattggcaacttatcttgaagggattggtttctatcctcaggccaaggaaatttacctgaaaattgtagaggattttccagaggttcatcttaatctagctgcaattgctagcgaggatggtcaaatagaagaagcctttacctatcttgaggaaatccaagctgacagtgactggtatgtctcgtctttggctctgaaggcagacctttaccagctggaaggtttgacagatgtggcacgtgagaaattattggaggccttgacctactcagaggattctctcttgatattgggtttggcagagttggatagtgagttggaaaattaccaagcggctattcaagcctatgcccagttagataatcgctcgatttatgagcaaacgggcatttccacctatcaacgaattggctttgcctatgctcagttagggaaatttgaaacggctactgagtttttagaaaaagccctggagttagaatacgatgacttaacagcttttgagttggccagtctttattttgatcaagaagaatatcaaaaagccaccctctactttaagcagcttgataccatttctcctgactttgaaggctatgagtatgggtacagtcaggctttacataaggaacatcaagttcaagaagccctgcgtatcgctaagcaaggattagagaaaaatccctttgaaactcgcctcttgctagctgcttcacaattttcttatgaattgcatgatgctagtggtgcagaaaattatctccttactgcaaaagaagacgctgaggatacagaagaaatcttgcttcgtttagccactatttatctggagcaggagcgttatgaggatattctagaattgcagagtgaggagccagaaaatcttttgaccaagtggatgattgctcgttcttatcaagaaatggacgatttggatactgcttatgagtattatcaagagttgacaggagatttgaaggacaatccagaatttctggaacactatatctatctcttgcgtgaattgggacattttgaagaagcaaaagtccatgctcacacttacttaaaactggttccagatgatgtgcaaatgcaagaactgtttgagagattgtaa

SEQ ID NO: 734 - DNA, 642 bp, Streptococcus pneumoniae
atgtcttatttatttgagatattaccgagtttactgaatggtgcgagcacgactgtacaggtctttgcactggtcttgctattttcgattcccttgggcgttttgattgcctttgccttgcaagtccattggaagcccctccattatctgattaacatttacatctgggttatgcgaggaacccccttactcttgcaactgatttttatctattatgtgctcccaagtattgggattcgtttagaccgccttcctgcagctattattgcctttgttctcaactatgcagcttactttgcagaaattttccgtgggggaattgacactattccaagaggacagtatgaggccgccaaggtcttgaagtttagcccttttgacagagtgcgctatattatcttgccccaagtgaccaagatcgttcttcctagtgtctttaatgaagttatgagtttggtcaaggatacttctttggtctatgctctcggaatttcagaccttatcttggctagtcgaacagctgctaaccgcgatgctagtctagttcctatgttcttggcaggagccatttatttgattttgattgggattgtgacaattatttccaaaaaagttgagaagaagtatagttattatagatag

SEQ ID NO: 735 - DNA, 630 bp, Streptococcus pneumoniae
atgttagaattacgaaatatcaataaagtctttggagacaaacaaatcctgtctaatttcagtctaagtattcctgaaaagcaaatcctggctatcgttggaccttctggtggaggtaagacaactcttttacgtatgcttgcaggtcttgaaaccattgattcagggcaaatcttttataatggacaacctttagagctggatgaattgcagaagcgcaatctactgggatttgtcttccaagattttcaactatttcctcatctatcagttctggaaaatttgactttatcgcctgtgaagaccatgggaatgaagcaggaagaggctgagaagaaggcgagtggactcttggaacagttaggactaggaggacacgcagaggcctatcctttctcactatctggtgggcaaaagcagcgggtggctttggcgcgtgctatgatgattgacccagaaatcattggctacgatgaaccaacttctgccctggatccagaattacgtttggaagtggagaagctaatcttgcaaaatagggaacttgggatgacccagattgtggttacccatgatttgcagtttgctgaaaatatcgcagatgtattattgaaagtagaacctaaatag

SEQ ID NO: 736 - DNA, 837 bp, Streptococcus pneumoniae
atgaaaaaatggatgcttgtattagtcagtctgatgactgctttgttcttagtagcttgtgggaaaaattctagcgaaactagtggagataattggtcaaagtaccagtctaacaagtctattactattggatttgatagtacttttgttccaatgggatttgctcagaaagatggttcttatgcaggatttgatattgatttagctacagctgtttttgaaaaatacggaatcacggtaaattggcaaccgattgattgggatttgaaagaagctgaattgacaaaaggaacgattgatctgatttggaatggctattccgctacagacgaacgccgtgaaaaggtggctttcagtaactcatatatgaagaatgagcaggtattggttacgaagaaatcatctggtatcacgactgcaaaggatatgactggaaagacattaggagctcaagctggttcatctggttatgcggactttgaagcaaatccagaaattttgaagaatattgtcgctaataaggaagcgaatcaataccaaacctttaatgaagccttgattgatttgaaaaacgatcgaattgatggtctattgattgaccgtgtctatgcaaactattatttagaagcagaaggtgttttaaacgattataatgtctttacagttggactagaaacagaagcttttgcggttggagcccgtaaggaagatacaaacttggttaagaagataaatgaagctttttctagtctttacaaggacggcaagttccaagaaatcagccaaaaatggtttggagaagatgtagcaaccaaagaagtaaaagaaggacagtaa

SEQ ID NO: 737 - DNA, 348 bp, Streptococcus pneumoniae
atggaacaatttttagataacatcaaagaccttgaagtcactacagttgtgcgtgcgcaagaagctcttgataaaaaagaaactgcaaccttctttatcggtcgcaaaacttgcccttactgccgtaaatttgcaggtacattgtcaggtgtcgtagctgaaaccaaagctcacatttacttcatcaatagtgaagaaccaagccaactcaatgatttgcaagcattccgctcacgctatggaatcccaactgtaccaggttttgttcatattacagatggacaaatcaacgtccgttgcgactcttcaatgtcagcacaagaaatcaaagatttcgcaggattgtaa

SEQ ID NO: 738 - DNA, 1719 bp, Streptococcus pneumoniae
atgtcttaccaagaaaattaccagaaatgggttgattttgtggagcttcctgactaccttcgtcaagatttggaaaatatggacgaaaaaactaaggaagatgccttctatacaaatcttgaatttggtactgcaggtatgcgtggcttggttggtgctggtacaaaccgtatcaacatctacgttgttcgccaagctactgaaggattggctcgtttgattgagtcaaaaggtggaaacgagaaagaacgcggtgtagcaattgcctacgatagccgtcacttctcacctgagtttgcctttgaatctgcggcagttcttgctaaacacggcatcaaatcttacgtatttgaaagccttcgtccgactccagaactatcatttgcagttcgtcatctcaactgtttcgcaggtatcatggtcacagccagccacaaccctgctccatttaacggttacaaggtttacggtgaagacggtggacaaatgcctccacacgatgcggacgctttgactacttatatccgtgcaatcgaaaacccatttgcagttgaagttgctgatgtggaaactgaaaaagcttctggcttgattgaagttatcggcgaagctgttgacgtagaataccttaaagaggttaaggacgtaaacatcaacccagccttgattgaagaatttggtaaagacatgaagattgtctacacaccacttcatggtactggtgaaatgttggctcgtcgtgctcttgcccaagcaggatttgactctgttcaagttgttgaagcgcaagcaactgctgacccagacttctcaactgtaacatctccaaacccagaaagccaagcagcctttgcccttgctgaagaacttggtcgtcaagttggtgcagatgttcttgtcgcaactgacccagacgctgaccgtgttggtgttgaagttcttcaaaaagatggtagctacctcaacctttcaggtaaccaaatcggtgctatcatggctaaatacatcttggaagctcacaaaaacgctggaactcttcctgaaaatgccgctctctgcaaatctatcgtttcaactgacttggtaacgaagattgctgaaagctacggcgcaactatgttcaacgtcttgacaggtttcaaatttatcgctgaaaaaatccaagaattcgaagaaaaacacaaccacacttacatgatgggatttgaagaaagcttcggttacttgattaaaccatttgtacgtgataaagatgccatccaagccgttcttgtcgttgctgaacttgctgcctactaccgttctcgtggtttgacacttgctgacggtatcgaagaaatctataaagaatatggctactacgcagaaaaaacaatctctgttactctttcaggtgtcgatggtgctgaacaaatcaaagcgattatggctaaattccgcaacaatgctccaaaagaatggaacgcaacagctatcactgtcgtagaagacttcaaggcacaaactgctactgttgctgacggtactgttacaaacttgacaactcctccaagtgatgtgttgaaatacacacttgctgacggttcatggattgccgttcgcccttcaggtacagaaccaaaaatcaagttctacattgcagttgtaggggaaaccaacgaagaatcacaagctaagattgctaacatcgaagcagaaatcaatgcatttgtaaaataa

SEQ ID NO: 739 - DNA, 327 bp, Streptococcus pneumoniae
atggcatataatactgattttaaacaaggagcattagattccatcaaaggagggcacagacatgtcgaggcggccaaagttttttggtgttggcgtcagaactctcttcacgtgggaaaagaaagacgtgaacaaaggaacttagagcggaaaaagcgagtcgtcaaaaagcgtaagatccctttagaagaattgaaagcctttgtagaggctcatccagatgcttttttacgggaaattgcggcacattttgattgtgctgttccttcagtatgggcagctttaaagcagattaaggtcactttaaaaaaagatgacgatctttaa

SEQ ID NO: 740 - DNA, 300 bp, Streptococcus pneumoniae
atgatttacaagaaaagcatgacaagcgatttctttgtggagtggttcaaaacgcaactcctacctgctttgaagacacctcatgttattgtcatgggcaatgctagttttcatcccaagaacattttggatgaactctgcatccaagataaacactttttcttacctctaccaccttattcaccagatttgaatcctattgagcaagcttgggctatcttgaaaaagaaagtgacggatgtattaagggaagtttcaactatttttgaatgtttggaatgcttttttaaaactagatga

SEQ ID NO: 741 - DNA, 285 bp, Streptococcus pneumoniae
gagaagacggtatacgatcaaaccattcaccgtgtagccgaaatcgttcagaatgaagacttgtataagaaaggtttgaatgttgaacttgcgcaccaacaaattaagggattttttgaagcagagtttaaaaatcgtattaatggagttcttaatactaaaataaaaaatagtacattaaatcgtgtaaataaaaaaactatacaccagagcaacaaaaactccatgatcaatttgaagcagaagcaacggaagatgctaaaaaacaaggcgatattgtgttga

SEQ ID NO: 742 - DNA, 255 bp, Streptococcus pneumoniae
gtgttgaatgttgaccaggatttcatgagcatatctaagtctaataaaagtggttcagactggaagaaaactttcacagtgaggacaaccaataggctagcaaatgacttgaataatgtcttgaaacaggctgataaagatactcctaataccccaacttggctaaactcagctgcttctaaagctaaagatgatgacagagcatataaactactgaagactcttataccaggagaaaattacctatcatgttaa

SEQ ID NO: 743 - DNA, 213 bp, Streptococcus pneumoniae
agactcttataccaggagaaaattacctatcatgttaaggataatcagctagaagtagaaacagataaatacacatatactgccgctagaaatggtagtaaggaagttggtattcaagagtcagatatagcagcaactctaagtgccgatgaatataattctaatcgccaaacttttgagagagaatacaaatacaaaagcaaatgcccttaa

SEQ ID NO: 744 - DNA, 1113 bp, Streptococcus pneumoniae
gtgccgatgaatataattctaatcgccaaacttttgagagagaatacaaatacaaaagcaaatgcccttaataatggttgggctagatctggttctgaagagttcaaaaagttctcccactttgtaggggtagacaaagggattgtgcgaacgaatgtactgactggtaaaaaactatctgataagattaggaaagaagtgggctctggagatagcaaactaggaaaaggcggctatttctctactggggatgttctattaggaaaagatgttgtttcttataccgtacaagtattttcagagaataatgaaagagtaggagtaaacactcaaagtcaccgtgttcagtataatctcccaattctagctgacttttcagtcatccaagatactgtggaaccatcacgaaccgttgttgaaaaaatcattccaaaactaaatattcccgaagaagagaaagggaaaataaccgaagaaatcaagaaaaagaaaaaaacctcagaattggcagaactaatctcagaaaatgtgaaagttcgctatgttgatgaacaagggcgtttgctatcattgaaaaatgatactggaattggagaaaaagaaagtgacggaacctacattaccaataaaaaacaactgattggtaccagctacaatgtcacagataaaaaactcagtagcatgactactactgacggaaaatattatacttttaaagaagcagatacaaattctgcaagtttaactgggaatattgtaagcgaaggtagaacagtgaccttagtttatagagaaagcgaagcgccaaccactgctacagtaacagccaattactataaagaaggtagccaagagaagttggcagagtctgttataaaagctgatttagcgataggttctgagtataccacagaatcaaaaactattgaagggaaaacaacaactgaggacaaagaagaccgagttatcacaaggaaaacaacatacaccttggtagcaactcctgcaaatgcgtaccagaagacggtgcaacagttgactattactaccgtgagaatgttgaggaaacagtggttcccaaaacagcaacctctactgagacgaagactataa

SEQ ID NO: 745 - DNA, 522 bp, Streptococcus pneumoniae
gtggttcccaaaacagcaacctctactgagacgaagactataacgcgtatcattcattacgttgataaagttacgaaccaaaatgtaaaagaagatgttgttcaacctgtaaccttaagccgtacaaaaactgagaacaaggtcacgggagttgtaacctacggtgaatggacaacaggaaactgggacgaggttgtatctggtaagattgacaagtacaaagatccagatattccaacagttgaatcacaagaagttacgtcagactctagtgataaagaaataacggtaaggtatgaccgtttatcaacaccagataaaccaactccagacccaggtactccaaaaactgaaactccagtgaatccagacccagaagttccgacttatgagacaggtaagagagaggaattgccaaacacaggtacagaagctaatgctaccttggctagtgctggtatcatgaccttgttagctagtctaggattaggattcttcaagaaaaaagaagatgaaaaataa

SEQ ID NO: 746 - DNA, 870 bp, Streptococcus pneumoniae
atggatttcacatgggcactgaagtatgccactgaatttttgggaactgccattttgatcattcttgggaatggtgcagttgccaacgttgaacttaaaggtacgaaaggtcaccaaagtggctggatcgtcatcgctgttggttatggtatgggggttatgatccctgccttgatgtttggtaacgtatctgggaatcacatcaaccctgctttcactctagggcttgcagttagcggtcttttcccttgggcacaagtggtaccttatattatcgcgcaagtcttgggggctatctttggccaagccttagttgtggcaacataccgtccattctacttgaaaactgaaaacccaaataacatcttgggaactttctcaactatttcaagtattgaccatggtacaaaagaaagtcgctatgcagcaactgtcaatggtttgattaatgagtttgttggttcatttgttttgttctttgcagctcttggtttgactaaaaacttctttggtgctgaagtgcttcaattcatgaaacaaaaggcaatagaagcaggacaaacagttgatttttctgacttggctattaaagcacaggtggctccacacactgcttcaggactttctgtggctcacttggcacttggattcctcgttatggctttggtaacatcacttggaggacctacaggacctgccttgaacccagcccgtgacttgggaccacgtctccttcatgctttccttccaaaatcagttcttggtgagcataaaggcgattcaaaatggtggtattcttgggtaccagtagtagcacctatcgcagcagcaattgcggcagtagctgtattcaaattcctttatctctaa

SEQ ID NO: 747 - DNA, 1197 bp, Streptococcus pneumoniae
atggcaaaagaaaaatacgatcgtagtaaaccacacgttaacattggtactatcggacacgttgaccacggtaaaactaccctaactgcagctatcacaactgttttggcacgtcgcttgccttcatcagttaaccaacctaaagactatgcgtctatcgatgctgctccagaagaacgcgaacgcggtatcactatcaacactgcgcacgttgagtacgaaactgaaaaacgtcactacgctcacatcgacgctccaggacacgcggactacgttaaaaacatgatcactggtgctgctcaaatggacggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaattgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactacattctctatccgtgagggtggacgtactgttggttcaggtatggttacagaaatcgaagcttaa

SEQ ID NO: 748 - DNA, 384 bp, Streptococcus pneumoniae
gtttcttctttgataccaacaatttcgatttcgtcgttgactttaacgataccacggtcgatacgtcctgaagcaactgtaccacgtccagtgattgagaatacgtcctcgactggaagaagcaatggtttgtcagtgtcacgttctggttctgggatatactcatcaactgtgttcatcaattccataacgatgtcttcgtatttagagtcaccttcaagagctttaagtgctgaaccttggataactggaagatcgtcacctgggaagtcgtattctgacaataggtcacggatttccatttcaaccaattcaagcaattcttcgtcgtcaaccaagtcaactttgttcatgaagacgataaggtgtttaacaccaacctga

SEQ ID NO: 749 - DNA, 414 bp, Streptococcus pneumoniae
ttgaagagattttcgaagagtataatactagactcaaatcaaaaagcattatacaatagtaatatgaaatcaactaaagaagaaatccaaaccatcaaaacacttttaaaagactctcgtacagctaaatatcataaacgccttcaaatcgttctatttcgtctgatgggcaaatcttataaagagattatagagcttttagactgtaatcaaacaacgatttggcgaaatgtaaaaaaatatgaggagttcggactcgactctctccttcaagaaacacgtggtggtcgtaaccatgcatatatgacagttgaggaagagaaagcctttcttgcccgccatttgaaggctacagaggcaggagaatttgttacaataccttatttcaggcttatatcgttcctacacacgtga

SEQ ID NO: 750 - DNA, 186 bp, Streptococcus pneumoniae
ttgttacaataccttatttcaggcttatatcgttcctacacacgtgatgccttctatcaactgttgaagcgccatggttggcgaaatattatgccacgtccagaacatcctaagaaagcagacgctcaaaccattgtcgcgtctaaaaataaaatctcaattcaagaagaaaagaaagcgctttaa

SEQ ID NO: 751 - DNA, 654 bp, Streptococcus pneumoniae
atggttggcgaaatattatgccacgtccagaacatcctaagaaagcagacgctcaaaccattgtcgcgtctaaaaataaaatctcaattcaagaagaaaagaaagcgctttaaaaccagtagacgttttcataaggttcgctcgatgtaccaagatgaggctggtttcggtagaatcagtaaactgggatcttgttggtctccaataggagtaggtccacatgtccatagtcactatatacgagaatttcgctattgttatggagctgttgatgcccatacaggcgaatcatttttcttaagagctggtggatgtaatactgagtggatgaacgcctttttagaagagctttcacaagcttatccagatgattatcttttactcgttatggacaatgctatatggcataaatcaagtaccttaaaaattccgactaatattggctttgcatttattcctccatacacaccagagataaaccccgttgaacaagtgtggaaagagattcgtaaacgtggatttaagaataaagcctttcgaactttggaagatgtcatgaatcaacttcaagatatcatacaaggactggagaaggaggtgataaagcccatcgttaatcggagatggactagaatgctttttgaaagcagatga

SEQ ID NO: 752 - DNA, 1083 bp, Streptococcus pneumoniae
atgaaaaccaaactaccgactgaatggcaagaactgagtgaccaactcggtttccaagaattcacccccattcaaactcaactatttgatccccttcttactggagaaaacctcctaggagtgagccaaaccggaactggtaagaccctagcgtatctcctaccaagtcttctcagactacaaaagaaaaaagcccaacaactcttgattctagcaccaaacacggaacttgctggacagatttttgatgtatgtaaaacgtgggcagaagctatcggattgactgctcaactcttcctttcaggttcaagtcagaaacgacaaattgaacgccttaaaaaggggccagaaattctgattggaactcctggccgtatctttgaactcattaaacttaaaaaaatcaagatgatgaatgtggaaaccatcatcctggatgaatttgaccaattactagatgattctcagattcactttgtagaaaaaatcactcactacgcacctcgtgaccaccaactggtctacatgagtgccacgaccaagtttgatcaagaaaagattgtgccgaatacacgcactattgatctctctaatcaaaaattggacaatatccagcatttctacatgcaggtagaccaacgtcatcgagtggatatactacgaaaactggctcatgtagaggatttccgtggtctagtcttcttcaatagcctgtcagaccttgggaatgccgaggaaaaactacagtatcgtgatatattggctgtttccctcgctagtgatgttaatgttaaatttagaaaagtcatcttagaaaagtttaaagataaccaactaaccctgcttcttgcaactgaccttttggctcgtggaattgatatcgatagcctagaatgtgtcgtaaactttgatattcctagagatagcgaaacctacacacaccgtgctggccgtactggccgtatgggcaaggaaggatatgttattactctcgtcactcatccagaagaaatcaaaaaacttaaaaagtttgcaagtatccgagaaattgtcctaaaaaaccaagaactctatatcaaataa

SEQ ID NO: 753 - DNA, 1062 bp, Streptococcus pneumoniae
ttgaaattttctcctctctgttggatagtcccgtctatctatgttataatgaaagaaggatttaaaatcggaaaaggagtatttatgctaaaattaggtgtcatcggaactggcgctatcagccatcatttcatagaagcagcccataccagtggagaataccaactggtcgcaatctattctagaaaactagaaactgcagcaacctttgcttctcgctatcagaatatccaactattcgatcaattagaagtcttcttcaaatcttcttttgatttagtctatatcgccagtccaaactccttacattttgctcaggcaaaagctgccttgtctgctggtaaacatgttattctcgaaaaaccagctgtcactcaaccacaagaatggtttgatttgattcaaacagctgaaaaaaataactgttttatctttgaagcagctcgtaattaccacgagaaagcctttactactatcaaaaactttttagcagataagcaagtgttaggagcagatttcaactatgccaaatactcttccaagatgcctgacttgttgactggacaaacaccaaatgtcttttcagaccgttttgctggtggagccctcatggatttggggatttatcccctctatgctgctgttcgtctttttggaaaagccaatgacgcgacttaccatgctcaacagcttgacaatagcattgacctaaatggagatggtatcctcttctacccagactatcaagttcacatcaaggctggaaaaaacatcacttccaatcttccttgcgagatttatacaacagatggaaccttgactctcaacacgattgagcatattcgctcagctatttttaccgaccaccaaggaaatcaagtccagcttcctatccaacagactcatcatacgatgactgaggaagtcgctgcatttgcacacatgatccagcaaccagatctgaatctctaccaaacttggctggatgatgcaggctctgttcatgagctactatataccatgcgccagactgctggtattagatttgaggcagaaaaatga

SEQ ID NO: 754 - DNA, 186 bp, Streptococcus pneumoniae
gaatcctccttttcctccttctattatagcacatttttaaatctaggtttgctagattctatgcttctatctatttattcggaaaagaaggcttttcttcagaagaaagctaatagcttatttgaaattttctcctctctgttggatagtcccgtctatctatgttataatgaaagaaggatttaa

SEQ ID NO: 755 - DNA, 378 bp, Streptococcus pneumoniae
atgatttgtcaatttatccgcgatatgctggacttgccagcaaaaaatgtgacgattttggagggaagtaacattcacgtcttgccttccatgccctactcagcgcaggatttctatactagtatagacgtcttggcggagttagataatggaatccaagttatcatcgaaattcaggttcatcatcagaattttttcatcaatcgcctatgggcttatctgtgcagtcaggttaatcaaaacctagaaaaaattcgccaacgtgaaggtgatacccaccagagctacaaacaaatcgcaccagtatacgctatcgcaattgtcgatagtaattacttctcagatgacctagcttttcatagttttatagtaaaatga

SEQ ID NO: 756 - DNA, 1443 bp, Streptococcus pneumoniae
ttgccaaattgtatcattgaaattattgctcaaatttgttatgatataaatatgaataaaagtagactaggacgtggcagacacgggaaaacgagacatgtattattggctttgattggtattttagcaatttctatttgcctattaggcggatttattgcttttaagatctaccagcaaaaaagttttgagcaaaagattgaatcgctcaaaaaagagaaagatgatcaattgagtgagggaaatcagaaggagcattttcgtcaggggcaagccgaagtgattgcctattatcctctccaaggggagaaagtgatttcctctgttagggagttgataaatcaagatgttaaggacaagctagaaagtaaggacaatcttgttttctactatacagagcaagaagagtcaggtttaaagggagtcgttaatcgtaatgtgaccaaacaaatctatgatttagttgcttttaaggttgaagagactgaaaagaccagtctaggaaaggttcacttaacagaagatgggcaaccttttacacttgaccaactgttttcagatgctagtaaggctaaggaacagctgataaaagagttgacctccttcatagaggataaaaaaatagagcaagaccagagtgagcagattgtaaaaaacttctctgaccaagacttgtctgcatggaattttgattacaaggatagtcagattatcctttatccaagtcctgtggttgaaaatttagaagagatagccttgccagtatctgctttctttgatgttatccaatcttcgtacttactcgaaaaagatgcggccttgtaccaatcttactttgataagaaatatcaaaaagttgtcgctctaacctttgatgatggtccaaatccagcaacgaccccgcaggtattagagaccctagctaaatatgatattaaagcgactttctttgtgcttgggaaaaatgtttctgggaatgaggacttggtgaagaggataaaatctgaaggtcatgttgttggaaaccatagttggagccatccgattctctcgcaactctctcttgatgaagctaaaaagcagattactgatactgaggatgtgctaactaaagtgctgggttctagttctaaactcatgcgtccaccttatggtgctattacagatgatattcgcaatagcttggatttgagctttatcatgtgggatgtggatagtctggactggaagagtaaaaatgaagcatctattttgacagaaattcagcatcaagtagctaacggctctatcgttttgatgcatgatattcacagtccgacagtcaatgccttgccaagggtcattgagtatttgaaaaatcaaggttatacctttgtgaccataccagagatgctcaatactcgcctaaaagctcatgagctgtactatagtcgtgatgaataa

SEQ ID NO: 757 - DNA, 768 bp, Streptococcus pneumoniae
atgaatacctatcaattaaataatggagtagaaattccagtattgggatttggaacttttaaggctaaggatggagaagaagcctatcgtgcagtgttagaagccttgaaggctggttatcgtcatattgatacggcggcgatttatcagaatgaagaaagtgttggtcaagcaatcaaagatagcggagttccacgtgaagaaatgttcgtaactaccaagctttggaatagtcagcaaacctatgagcaaactcgtcaagctttggaaaaatctatagaaaaactgggcttggattatttggatttgtatttgattcattggccgaacccaaaaccgctcagagaaaatgacgcatggaaaactcgcaatgcggaagtttggagagcgatggaagacctctatcaagaagggaaaatccgtgctatcggcgttagcaattttcttccccatcatttggatgccttgcttgaaactgcaactatcgttcctgcggtcaatcaagttcgcttggcgccaggtgtgtatcaagatcaattcgtagcttactgtcgtgaaaagggaattttattggaagcttgggggccttttggtcagggagaactatttgatagcaagcaagtgcaagaaatcgcagcaaatcacggaaaatcgattgctcagatagccttggcctggagcttggcagcaagggatttttaccacttccaaaatctgtcacaacctctcgtattcaagctaatcttgattgctttggaattgaactga

SEQ ID NO: 758 - DNA, 231 bp, Streptococcus pneumoniae
caagcaagtgcaagaaatcgcagcaaatcacggaaaatcgattgctcagatagccttggcctggagcttggcagcaagggatttttaccacttccaaaatctgtcacaacctctcgtattcaagctaatcttgattgctttggaattgaactgagtcatgaggagagagaaaccttaaaaacgattgctgttcaatcgggtgctccacgagttgatgatgtggatttctag

SEQ ID NO: 759 - DNA, 762 bp, Streptococcus pneumoniae
gtggacaacctttatcttgtaaaagacgatagtcaactagctgcatttcgtgattttgtagtaagaaatactgaaaagttgaaagattatcaatcttttttaaagaatgaacttgcagtctgtgatttaccgcaagccgttatttggtcaagttttaatgctgctacacagattattagggaaagcgctgttccagcctatacaaataatagacgaatggttatgacgcctgatttagctgtatggaaagagttgtatttgtatcagttgatggactacgagtgttctcagcaaactcaagcaatagaaagccattatcattctttatctgaaaatttcctcttacagattgtaggacatgagttagctcattggtcggagtattttttagatgattttgatggttacgactcttacatctggtttgaagaggggatggttgaatatattagtcgcaagtatttcttgacagaagaggaatttcaagcggaaaaaatttgtaatcagtctcttgtagaactttttcagaagaagtatggttggcattcattgaatgattttggttcttcgacttatgataagaattatgcaagtattttttacgaatactggcgtagttttttgacaatagataagttggtagaaaatctaggtagtgtacaagcggtcttcgattcttatcatttatgggcaaatacagataaaactcttcccttgttaaattggtttgttcagcagaaattaattgaaaaagagatataa

SEQ ID NO: 760 - DNA, 918 bp, Streptococcus pneumoniae
atgtctaagaaattaacatttcaagaaattattttgactttgcaacaattttggaatgaccaaggttgtatgcttatgcaggcttatgataatgaaaaaggtgcgggaacaatgagtccttacactttccttcgtgctatcggacctgagccatggaatgcagcttatgtagagccatcacgtcgtcctgctgacggtcgttatggggaaaaccctaaccgtctctaccaacaccaccaattccaggtggtcatgaagccttctccatcaaatatccaagaactttaccttgagtctttggaaaaattgggaatcaatcctttggagcacgatattcgttttgttgaggacaactgggaaaacccatcaactggttcagctggtcttggttgggaagtttggcttgacggaatggaaatcactcagttcacttatttccaacaagtcggtggattggcaactggccctgtgactgcggaagttacctatggtttggagcgcttggcttcttacattcaagaagtagactctgtctatgatatcgagtgggctaatggtgtaaaatacggagaaatctttatccagcctgagtatgagcactcaaaatattcatttgaaatttcggaccaagaaatgttgcttgaaaactttgataagtttgaaaaagaagctggtcgtgcattagaagaaggcttggtacaccctgcctatgactatgttctcaaatgttcacatacctttaatctgcttgacgcgcgtggtgccgtatctgtaacagagcgtgcaggctatatcgctcgtatccgtaacttggcccgtgttgtagccaaaacctttgttgcagaacgcaaacgcctaggttacccacttttggatgaagaaacacgagttaaacttttagcagaagacgcagaatag

SEQ ID NO: 761 - DNA, 2037 bp, Streptococcus pneumoniae
atgacaaaaaacttattagtagaactcggtcttgaagaattaccagcctatgttgtcacaccaagtgaaaaacaactaggcgaaaaaatggcagccttcctcaaggaaaaccgcctgtcttttgaagccattcaaaccttctcaacaccacgtcgtttggctgttcgtgtgactggtttatcagacaaacagtctgatttgacagaagatttcaagggaccagcaaagaaaattgccttggatagtgatggaaacttcaccaaagcagctcaaggatttgtccgtgggaaaggtttgactgttgaagatatcgaattccgtgaaatcaagggtgaagaatatgtctatgtcactaaggaagaagttggtcaatcagttgaagccattgttcctggtgttgtagatgtcttgaagtcattgactttccctgtcagcatgcactgggctggaaatagctttgaatacatccgccctgtccacactttaactgttctcttggatgagcaagagtttgacttggatttccttgatatcaagggaagtcgtgtgagccgtggccatcgtttcttggggaaagaaaccaaaattcagtcagcattgagctatgaagaagaccttcgtaagcagtttgtaatcgcagatccatgtgaacgtgagcaaatgattgttgaccaaatcaaggaaattgaggcaaaacatggtgtacgtatcgaaattgatgcggatttgctgaatgaagtcttgaatttggttgaatacccaactgccttcatgggaagttttgatgctaaataccttgaagttccagaagaagtcttggtgacttctatgaaggaacaccagcgttactttgttgttcgtgatcaagatggaaaactcttgccaaacttcatttctgttcgtaacggaaacgcagagcgtttgaaaaatgtcatcaaaggaaatgaaaaagtcttggtagcccgcttggaagacggagaattcttctggcgtgaagaccaaaaattggtgatttcagatcttgttgaaaaattaaacaatgtcaccttccatgagaagattggttcccttcgtgaacacatgattcgtacgggtcaaatcactgtacttttggcagaaaaagctggtttgtcagtggatgaaacagttgaccttgctcgtgcagcagccatttacaagtttgacttgttgacaggtatggttggtgaatttgacgaactccaaggaattatgggtgaaaaatacacccttcttgctggtgaaactccagcggtggcagctgctattcgtgaacactacatgcctacatcagctgaaggagaacttccagagagcaaggtcggcgcagttctagccattgcagacaaattggatacgattttgagtttcttctcagtaggattgattccatcaggttctaatgacccttatgcccttcgtcgtgcaactcaaggtgtggttcgtatcttggatgcctttggttggcacattgctatggatgagctgattgatagcctttatgcattgaaatttgacagtttgacttatgaaaataaagcagaggttatggactttatcaaggctcgtgttgataagatgatgggctctactccaaaagatatcaaagaagcagttcttgcaggttcaaactttgttgtggcagatatgttggaagcagcaagtgctctcgtagaagtaagcaaggaagaagattttaaaccatctgttgaatcactttctcgtgcctttaacctggctgagaaggcagaaggggttgctacggttgattcagcactatttgagaatgaccaagaaaaagctttggcagaagcagtagaaacactcgttttatcaggacctgcaagtcagcaattgaaacaactctttgcgcttagcccagtcattgatgctttctttgaaaatactatggtaatggctgaagatcaggctgtccgtcaaaatcgtttggcaatcttgtcacaactaaccaagaaagcagctaagtttgcttgttttaaccaaattaacactaaataa

SEQ ID NO: 762 - DNA, 258 bp, Streptococcus pneumoniae
atggatccgaaaaaaattgctcgtatcaatgagcttgctaaaaagaaaaaaacagaaggcttaacaccagaagaaaaagtggaacaagccaaactacgtgaggagtacatcgaaggttatcgccgcgctgttcgtcaccacattgaaggaatcaaaattgtggacgaagaaggaaacgatgttacaccagaaaaactacgccaagtacaacgtgaaaaaggattacatggccgtagtcttgatgatccaaattcataa

SEQ ID NO: 763 - DNA, 1245 bp, Streptococcus pneumoniae
atgaaatttgttggacttgttggatcaaactacgatcaatcatataaccgcaaactcttggaatttatccgtcgcaatttcaaattcaaatttgaattagaagtacttgaaatcgacgaagttccaatgtttaaccaagacgaaaaatgggacgaaagcttccaattgcgtttcttgtataacaagattacacgtgctgatggtgtcattatcgccactcctgagcacaaccacactatctcagcttcactcaaatctgtacttgaatggctttcatacgaagttcatccatttgaaaacaagcctgttatgattgtgggtgcatcatactatgaccaaggaacatcacgtgctcaagttcaccttcgtaaaatccttgatgctccaggtgttaatgcctacacgcttccaggtaacgaattccttcttggtaaagctaaggaagcttttgataacaacggaaatatcaccaacgaaggcactgttaaattccttgaaacttgcttagataactttgttaaatacgtaggagtcgtttcgaaattgaaaaaaccaaaaccaatcgaatcagaagacttggattgtggaaaaccaatcgctacaaccatcacagaagttgaccctgacgatccagaatgggtagaaaaagttgcagcaatcactggtgctgtttctggtgatacctatgtcaaattggaccacggtatcctaacagttaaccaaattgatatgttcttgaaagctatgccatttgaattgacatacgctgacgacaacaaccaattcctctactacaacaacgctcaccaagatccagacactatgttcgctaaacgtgtaccacctcaatcaggtagccgtatgtcgactgttcatggttctcttccaccagcacgtatgaagaacgtagagtgggttatcggaacacttcgcaacggaaaccaagaatacgtccgtacgatcgttccaggttctcctgcaggtgttatcaacactcacaactaccaagcaatgtactatcctgatggatcatacgctggtatcaatgaaatcgtctttaacttccaaccatggcttgactggtacctaaaagagactggtcaacgtttggtgggtggtagcggaccatttgctcctgctgccggaggtcatggagacgccgatgctacttctggcgcttctgattcaggggatgttggaggccacggtggtgacgcagacgctacagccggtgcaagttactaa

SEQ ID NO: 764 - DNA, 237 bp, Streptococcus pneumoniae
atgattgatcgtagtttgatccaacaagtccaacaaatttcattctttcggtctcctatcttacaaattttcccagtcaaagtcttcagcatctttgcgaagcaattcttgcgcattgcgcaatttctcagtaatcttcacgaagatacggaagtcatcaaagatggcatccaatttcttgataacatcaaggtcaaccaagtcgccacttgggttaaatgcttgaagagagtgtga

SEQ ID NO: 765 - DNA, 606 bp, Streptococcus pneumoniae
atgttaaaacttattgctattgttggaacaaattcaaaacgttctacaaaccgtcaattgcttcaatacatgcaaaaacactttgctgacaaagctgaaattgaacttgttgaaatcaaggccattcctgtcttcaacaaaccagctgacaagcaagtacctgctgaaatattggaaattgctgctaaaatcgaagaggcagatggcgttattatcggtactcctgagtatgatcactctattccagctgttttgatgagcgctcttgcttggttgtcttatggtatttacccacttttgaacaaaccaatcatgattacaggtgcttcttacggtacgcttggttcatctcgtgcccaattgcaacttcgtcaaatcttgaatgctcctgaaatcaaggcaaatgttcttccagatgaattcttgctctcacactctcttcaagcatttaacccaagtggcgacttggttgaccttgatgttatcaagaaattggatgccatctttgatgacttccgtatcttcgtgaagattactgagaaattgcgcaatgcgcaagaattgcttcgcaaagatgctgaagactttgactgggaaaatttgtaa

SEQ ID NO: 766 - DNA, 924 bp, Streptococcus pneumoniae
ttgactcttcgttcacattctgaacggctaatggggactactatcactatttcattagtggatgagcaagccgatatctttctccaaaaatcctttgacttgctcaaagagcttgaataccgcttcaacgccaatagtcaagaatctgagttgatggaaatcaattatcaagcaggagtatcccccgtcacggttcatccagacctgtttgagctgatttcacttgggttagagcatagcctagcgctctctagccacctcaatatcagcattggtcccttaattcaaacctggcgtatcggtttttcagatgccaaggtcgcccagcctcaagaaattgaatcggtgctgcctctaatcaatcctcatggtatcgagttagattcttctacttctactgtgtttttaaaacagaaaggaatgaagatcgatctaggttgtttagccaaaggatacagtgcggataaggttgcccaatttcttaggaaagagggggtgacttctgccttgatcaatctgggagggaatatcctgaccattggaaaaaatcaggcaagaggggataacccatggcaaatcgggattcaagacccagccaatcctaggggaaatcatttaatgaccatccctgttgtcaataaatctgtcgtgacttcaggcatttatgaacgtcacctgaccgtcgatggacaagattaccatcacatttttgacagtcaaacaggatatcctgttgaaacggaactagcgagtctaacaatcatctctgataaatcagtcgatggcgaaatctggacgactcgactctttggagaaagacctgcttctatcctctggcaagtcgaaagtttggagggcatcgaagtcatcctcatcgataaagaaggccacctaagctgttcttcaggaattcctactctatag

SEQ ID NO: 767 - DNA, 273 bp, Streptococcus pneumoniae
atttaccttactagtataccatttaccgttagcgtttacaaggggggtactattatttcagcattttttatcaaaaataattccccatttatcctgttttcaagcctcatgaattttatgagcatatttcttgactttttccaaattttgtttgtgaaaattctaactttatggtattctaataacatgaaaataaaatgtaagggcttcaatttagataattatttgatattacaacttattttctataagagaaaggagttggtagcttga

SEQ ID NO: 768 - DNA, 1380 bp, Streptococcus pneumoniae
atgagtaaaatcgttgtagtcggtgctaaccacgctggtacagcatgtatcaataccatgttggataattttggaaatgagaacgaaattgttgtatttgaccaaaactctaacatctctttcctaggatgtggaatggctctttggattggtgaacaaattgacggtgctgaaggcttgttctattctgataaagacaaattagaagctaaaggtgctaaggtttatatgaattcaccagttctttcaatcgactatgataacaaagtggttacagcagaagttgaaggaaaagaacacaaagaatcatacgagaaattgattttcgctacaggttctacaccaatcttgccaccaatcgaaggtgttgaaattgttaaaggaaaccgcgaatttaaagcaactcttgaaaacgtacaattcgtgaaattgtaccaaaatgctgaagaagttatcaataaactttctgacaagagccaacatctcgaccgtatcgccgttgttggtggtggttacatcggtgttgaacttgctgaagcctttgaacgtcttggaaaagaagttgtccttgttgatatcgttgatactgtcttgaacggttactatgacaaagacttcacacaaatgatggcgaagaacttggaagatcacaacatccgcttggctctaggtcaaactgttaaagcaatcgaaggtgatggtaaagttgaacgcttgattactgacaaagaaagctttgacgtggatatggttatccttgcagttggtttccgtccaaacacagcccttgctgatggtaagatcgaactcttccgcaacggtgccttccttgtagacaagaaacaagaaacatctatcccaggcgtttacgctgttggtgactgtgcgactgtttatgacaatgctcgtaaagatacaagctatatcgctcttgcttcaaatgctgttcgcactggtatcgttggtgcctacaatgcttgtggacatgaattggaaggaatcggtgttcaaggttcaaatggtatctcaatctacggtcttcacatggtttcaactggtttgactcttgaaaaagctaaagctgctggttacaacgcaactgaaacaggctttaacgatcttcaaaaaccagaattcatgaaacatgacaaccatgaagtagcaattaagattgtctttgacaaagatagccgtgaaattcttggtgcccaaatggtttcacatgatattgcaattagcatgggaatccacatgttctcacttgctatccaagagcatgtgacaattgataaattggcattgacagacctcttcttcttgccacacttcaataaaccatacaactacatcacaatggctgcccttacggctgaaaaataa

SEQ ID NO: 769 - DNA, 894 bp, Streptococcus pneumoniae
atgatgaggataaaacaaatgactgaaaatcgttatgaactaaataaaaacttggcacagatgctcaagggtggtgttattatggatgtgcagaatcctgaacaggctcgtatcgcagaagctgctggtgcggcagctgtgatggccttggaacgaattccggctgatattcgtgcagctggaggagtttcccgcatgagcgacccaaagatgattaaggaaatccaagaagcggttagtattccagtaatggctaaggtcagaatcgggcattttgttgaagctcagattttagaggctattgaaattgattatatcgacgagagtgaagttctatctccagctgatgaccgtttccatgtggataagaaagaattccaagttccttttgtctgtggtgctaaggatttaggtgaagccttgcgtcgtatcgctgaaggtgcttccatgattcgtaccaaaggagaaccagggacaggggatatcgtccaagctgttcgtcatatgcgtatgatgaatcaggaaattcgccgcattcaaaacttacgtgaggacgagctttatgttgctgccaaggatttgcaagtccctgtagaattggtccaatatgttcatgaacatggaaaattgccagttgtaaatttcgctgctggaggtgttgcaacgccagcagatgctgcgttaatgatgcaattaggggcagagggggtctttgtcggttcaggtattttcaagtcaggagatcctgttaaacgagcgagtgccattgttaaggctgtgactaacttccgtaatcctcaaatcctagctcaaatctctgaagatttaggagaagccatggttggtattaatgaaaatgaaatccaaattctcatggctgaacgaggaaaatag

SEQ ID NO: 770 - DNA, 234 bp, Streptococcus pneumoniae
atgcccgattctgaccttagccattactggaatactaaccgcttcttggatttccttaatcatctttgggtcgctcatgcgggaaactcctccagctgcacgaatatcagccggaattcgttccaaggccatcacagctgccgcaccagcagcttctgcgatacgagcctgttcaggattctgcacatccataataacaccacccttgagcatctgtgccaagtttttatttag

SEQ ID NO: 771 - DNA, 189 bp, Streptococcus pneumoniae
cgaacagcttggacgatatcccctgtccctggttctcctttggtacgaatcatggaagcaccttcagcgatacgacgcaaggcttcacctaaatccttagcaccacagacaaaaggaacttggaattctttcttatccacatggaaacggtcatcagctggagatagaacttcactctcgtcgatataa

SEQ ID NO: 772 - DNA, 156 bp, Streptococcus pneumoniae
atggcactcgctcgtttaacaggatctcctgacttgaaaatacctgaaccgacaaagaccccctctgcccctaattgcatcattaacgcagcatctgctggcgttgcaacacctccagcagcgaaatttacaactggcaattttccatgttcatga

SEQ ID NO: 773 - DNA, 582 bp, Streptococcus pneumoniae
atgaaaatcggaatattggccttgcaaggggcctttgcagaacatgcaaaagtgctagatcaattaggtgtcgagagtgtagaactcagaaatctagatgattttcagcaagatcagagtgacttgtcgggtttgattttgcctggtggtgagtctacaaccatgggcaagctcttacgtgaccagaacatgctacttcccatccgagaagccattctatctggcttaccagtgtttgggacctgtgcgggcttaattttgctggctaaggaaatcacttctcagaaagagagtcatctaggaactatggatatggtggtcgagcgtaatgcttatgggcgccaattaggaagtttctacacggaagcagaatgtaagggagttggcaagattccaatgacctttatccgtggtccgattatcagtagtgttggtgagggtgtagaaattctagcaacagtgaacaatcaaattgttgcagcccaagaaaaaaatatgttggtaagttcttttcatccagaattgactgatgatgtgcgcttgcaccagtactttatcaatatgtgtaaagaaaaaagttga

SEQ ID NO: 774 - DNA, 648 bp, Streptococcus pneumoniae
atgaacactagtcttaaactcagcaaacaactcagttttggagaggagattgctaatagcgtgacccatgctgtgggtgcagtcatcatgcttatcttgctgcctatttcatccatctatagttatgaagcacacggatttttatcctctatcggcgtttccattttcgtcatcagtctctttctcatgttcctatcatccaccatttatcactctatggcctatggttcgacccacaaatatgttttgcgaatcattgaccattctatgatttacgttgccattgccggctcatacacgcccgttgtcttgaccttgatgaataactggtttggctatctgattattgtcatccaatggggaacgaccatctttggtattctctataaaatctttgctaaaaaggtcaatgagaaatttagccttgctctttacctgattatgggctggttggttctggctatcattcctgccattatcaatcaaacgacacccgttttctggagtctcatggtaactggcggactctgttatacagttggagctggattttatgccaagaaaaaaccttatttccacatgatttggcatctctttatcctagctgcgtccgtactccaatacatcgctattgtttattacatgtaa

SEQ ID NO: 775 - DNA, 453 bp, Streptococcus pneumoniae
ttgaaaatgaaaactaccttttcctacccaaaatgggcagaaattccaaacattgacctctatctggaccaggttttgctctatgtcaatcaggtctgcgcccctatctctcctaataaagacaagggcctaacagcatctatggtcaacaattatgtgaaaaatggttacctgacaaagcctgacaaaaaaaaataccaacgccaacagattgcccgtttgattgctatcacaaccctcaagtctgtattttctattcaagaaatagcccagacacttaatactctacaaactcaagcaagttcagaccaactctacgatgcttttgtggactacatgaaccaaggaattgacccagctaaccctattatccaaaccagctgccaaaccgttaaactctatcatcaaactctagacttaatcgatcatactcaagaggaggtaatccaatga

SEQ ID NO: 776 - DNA, 495 bp, Streptococcus pneumoniae
atggaaattcgtttagcttttccaaatgaagtagatgccatcatgcaggtgatggaggatgccaaaaaatgtttagcagatgctggtagtgaccagtggcaaaatggctatccaaatgcagatgttattatcgatgatatcatctcagggcaagcctacgtagccttggaagagggagaactgctagcctatgctgctgtgaccaaaagtccagaggaggcctatgaagctatttatgagggaaactggcaagctggagagtcagagtatctagtctttcaccgtattgctgtggcagcagatgtgcagggaaaaggagttgctcaaaccttcttagagggcttgattgaaggttttgattatcttgattttcgctcagatactcatgctgaaaacaaggttatgcaacatatttttgaaaaacttggttttaaacaagttggtaaggtgccagtagatggcgaacgcttggcctatcaaaaattaaagaaataa

SEQ ID NO: 777 - DNA, 531 bp, Streptococcus pneumoniae
atgcaaaagaagtatgtaaaaatcctctactcctcaccaataggtattctatcacttgtagctgatgaccattatttgtatggaatttgggttcaggagcagaagcattttgagaggggactaggagatgaaacgatagaagaagttgttagtcatcctattttagacccagttattgcttgcttagatgattactttaaaggcaagcctcaggatttatccaacttgctcttggcgccaatcggaacgaattttgaaaagagagtttgggactatttacagggcattccttatggtcagacagtgacctatggacaaattgctcaagacctgcaagtggcttctgctcaagcaattggtggagcagtgggacgcaatccttggtctatcctagtaccttgtcatcgtgtgttgggagcaggcaagcgtctgacaggttatgctgcaggagtggaaaagaaagcttggctcttggagcatgaaggagtagattttaaagatagaaacaatagaaggagaagcacatgttag

SEQ ID NO: 778 - DNA, 357 bp, Streptococcus pneumoniae
atgttagaatttatcgaataccccaaatgttcaacttgtaaaaaagcaaaacaagaattaaatcaattaggtgtggactataaagccgtccatatcgtggaagaaacacctagccaagaagtcattttgaattggctagaaacctcaggatttgaattgaagcaatttttcaacaccagtggtatcaaataccgtgaattagggctaaaagataaggtaggaagtttgtcaaaccaagaagcggctgagttgctagcaagtgacggtatgttgttaaaacggcccattttagtagaaaatggaactgttaagcaaatcggttatcgaaaatcttatgaagaactgggactgaaatag

SEQ ID NO: 779 - DNA, 378 bp, Streptococcus pneumoniae
atgagttgcaccaaaatcggtgtcccttttaagaaactaacaaagaaggcctgcaagggatataaaatcttgacacgattgatcttcacaatggcaaaaagaagcgccaaaaccaagccaaaaagggcaccgccaattgtcaacataattgttgttggaagttgttggacaattctagggattccatcaaagaccgaacgtaggctaaacagcttgccatccggaatcaattgcatcaagttttggtaccaatctgatgctaaaatcgttgtaacattcataaaaacatcctcttctgataatgattcattctaccatgcttctgccgtcaatgaaattatttgctacggtcagatacagactttgtctacctactag

SEQ ID NO: 780 - DNA, 801 bp, Streptococcus pneumoniae
atgaatgttacaacgattttagcatcagattggtaccaaaacttgatgcaattgattccggatggcaagctgtttagcctacgttcggtctttgatggaatccctagaattgtccaacaacttccaacaacaattatgttgacaattggcggtgccctttttggcttggttttggcgcttctttttgccattgtgaagatcaatcgtgtcaagattttatatcccttgcaggccttctttgttagtttcttaaaagggacaccgattttggtgcaactcatgttgacctactacggaattcctttggctttgaaagccctcaatcagcaatggggaactggtctcaatatcaatgcgattccagctgcagcttttgcgattgtcgcctttgcctttaatgaggcagcttatgctagtgaaaccattcgtgcagccattctctcagttaatcctggtgagattgaggcggcacgcagtctgggtatgacccgagcgcaagtttatcgacgagtgattattcctaatgcagcggtggtagctactccaaccttgattaattccctcatcggtttgaccaagggaacatctctagcttttagtgcgggtgttgtggaagtctttgcccaagctcagattctaggtggagctgattatcgctattttgaacgcttcatctccgttgcccttgtttattgggtagtcaatatcggaattgaaagcctcggtcgtttcatcgagagaaaaatggctatttctgcacctgatacagtgcaaacagatgtgaaaggagaccttcgttaa

SEQ ID NO: 781 - DNA, 744 bp, Streptococcus pneumoniae
atgattaagatttcgaatttaagcaaatccttttcaggacagactgtcttggatcatctgaacttggatattcaaaaaggggaagttgtagccttgattggttcttcaggagctggaaaatcaacctttcttcgcagtctcaattatcttgaaacacctgacagtggctctattcagattgatggtttttcagttgatttttctaaaatcactcaagaagaaatccttgccctacgctgtaagttgtctatggttttccaacagtttaatttatttgaacgccgaacagcacttgataatgtgaaagaaggcttggttgttgtcaagaaattatctgaccaagaagcgactaagattgccaaggaagagttggctaaggttgggctttcggaccgtgaaaaccattatcctcgccatttatcaggtggacagaagcaacgggttgccctagcgcgtgcgcttgctatgaaaccagatgttttgctcttagacgaaccaacttcagcccttgacccagaattggttggtgaagtagaaaagtctattgcagatgctgctaagtcaggtcaaaccatgattttggttagtcatgacatgtcctttgtagcccaagtggctgataagattctcttcttagataaggggaaaatcatcgagtctggaacaccggatgagattatccacacccctaaagaagagcggacaaaagaattcttcgctagttacaaacggacttatatttga

SEQ ID NO: 782 - DNA, 237 bp, Streptococcus pneumoniae
atgagagaaatcatgctactgcaactattttctttatatttcgagagtttgatcttgaccaccatccttgttctgatttttttagggatttggattggtctgagagccatgtcgggagttgataagacagccaaggctcgccaagcccatctctatgatatgattatgattggagtcttggttgtcccagtattatcctttgcggttatgagtttaattcttgttttcaaggcataa

SEQ ID NO: 783 - DNA, 222 bp, Streptococcus pneumoniae
attgcttcgagcagcatacaaggccgcagtcatccctgcaggtccagcaccgataataatagtatcgaacatatagattccttctttcttgttgtaactatctttattctaactctttcttgtcaatcacgcaaggattatgccttgaaaacaagaattaaactcataaccgcaaaggataatactgggacaaccaagactccaatcataatcatatcatag

SEQ ID NO: 784 - DNA, 798 bp, Streptococcus pneumoniae
atgaataatacatctgatatcgaaaattacccaggatacgctaatattagtggacctgaattggctgaaaagatgtttgaaccacttgaaaatcttggtgttgagcacatttatggttatgttgaaaatgtcgaagaccatggtgattttaagaaagtgatgactgatgaccaaacatatgaaacacgtacagttatcgtagcaactggttctaaacaccgtcctttgggagtacctggagaagaagaactgaacagtcgtggtgtttcttactgtgctgtgtgtgatggtgctttcttccgtgaccaagatttattggtagttggtggtggagattcagctgttgaagaagccctcttcttgactcgttttgctaagactgttaccattgttcaccgtcgtgaccaacttcgtgcccaaaaggttttacaagatcgcgcctttgcgaatgaaaaaatcagctttatctgggattctgtagtaagggaaatcaagggtgaaaaccgagtagaatcagtcgtatttgaaaatgtgaaaacaggtcaagtgacagaacaagtcttcggtggtgtctttatctatgttggattggaccctcttagcgattttgttaaagaattgaatatccaagatcaggcaggatggattgtgacagataaccacatgaaaactgcagtcgacggtatctttgcagttggagatgttcgcttgaaagaccttcgccaagtaacaacagcggttggagatggagctatcgctggtcaagaagcctataaattcattacagaacatagttaa

SEQ ID NO: 785 - DNA, 762 bp, Streptococcus pneumoniae
ttgcaagacggggttttgtgttataatagagacatgaaaacaaatgatattgtctatggtgtccacgccgttaccgaagccctccttgcaaatacaggaaacaaactctacctccaagaagatctccgaggtaagaatgttgagaaagtcaaggaactagctacagaaaagaaggtgtccatttcttggacatcaaaaaaatctctctctgagatgactgaaggtgctgttcatcaaggttttgttctacgagtgtctgaatttgcctatagcgagctagattacatccttgcaaaaacacgccaagaagaaaatccacttctattgattctagatggtctaaccgatccccataatctgggttctatcttgcgaacagccgatgcgaccaatgtttcaggtgtcatcattcccaagcaccgtgctgtcggagtaactcctgtcgttgccaaaacagccacaggtgctattgaacacgttccaattgcccgagtgacaaacctcaatcaaaccttatataaactcaaggatgaaggcttctggacctttggaacggatatgaacggtactccttgccacaagtggaatacaaaagggaaaatcgccctcatcattggaaatgaaggaaaaggtatctctagcaacatcaaaaaacaagtcgatgagatgattaccattccgatgaatggacatgttcaaagccttaatgccagtgttgctgcggccattctcatgtacgaagttttccgaaatagactataa

SEQ ID NO: 786 - DNA, 612 bp, Streptococcus pneumoniae
atgtctgcaatagaacgtattacaaaagctgctcacttaattgatatgaacgatattatccgtgaagggaatcctactctacgcgcgattgctgaggaagtcactttccccctatctgaccaggaaatcatcctaggcgaaaagatgatgcaattccttaaacattcccaagatcctgtcatggctgaaaaaatgggactccgcggtggtgttggactggctgctccccagttagatatctcaaaacgcattatcgctgttttggtacctaatattgttgaagaaggcgaaactccacaggaagcctacgatttggaagccattatgtacaatccaaaaatcgtctctcactctgttcaagatgctgctcttggcgaaggagaaggttgcctgtctgttgaccgtaacgtgcctggctatgttgttcgccatgcccgcgttactgttgactactttgacaaagatggagaaaaacaccgtatcaaactcaaaggctacaactccattgttgttcagcatgaaattgaccacattaacggtatcatgttttacgatcgcatcaatgaaaaagacccatttgcagttaaagatggtttactgattcttgaataa

SEQ ID NO: 787 - DNA, 252 bp, Streptococcus pneumoniae
gtgaaagaaatacttatctgtgatataataaaaagaaaaggcttgcataagaaagtagggagaacgaagactacaaagaagacaaaatcgaaatcagggtggtttagcttttcgttttatgaagggcttggtaaactttttaggagttatcgcaagtggagcaataagggatttgtggcgatactcttgctagcagttggtttatcaatgggcttggtcttgttgtttgaaagcttccaaggaatcccttga

SEQ ID NO: 788 - DNA, 483 bp, Streptococcus pneumoniae
gtgctggatttagctcataatcatattttggattcgcaaattgagggagttatttcaacggccgatattattgagaaagctggaatcactccaatcggagtttatacgcacgaaccacgtgatcaggctccgctggtcattaaggaagtgaatgctatcaaggttgcattgttagcctattcctatggtttcaatggaattgagcagtatatttttcaggaagactataatcgttatctttcagatttaaacgaagataagataaaggctgaagttgaacgggcagagaaggaagcagatatcaccattatcatgcctcagatgggtgttgagtatcgattggaaccaactgaagaacaaaaagctctttatcacaagatgatcgattggggagcggatattatctttggagggcatcctcacgttgttgaaccatctgaaacggttgaaaaagatggagataagaaactcattatctattaa

SEQ ID NO: 789 - DNA, 378 bp, Streptococcus pneumoniae
atgagctttagctgttccgatagttgtttttccatccttcttcttgatggtgacatccatgagaacaccacgttcagtccacttagcattctcttcatctcccatagattcaatccgttgattggaaatgaagttccccatttaatagataatgagtttcttatctccatctttttcaaccgtttcagatggttcaacaacgtgaggatgccctccaaagataatatccgctccccaatcgatcatcttgtgataaagagctttttgttcttcagttggttccaatcgatactcaacacccatctgaggcatgataatggtgatatctgcttccttctctgcccgttcaacttcagcctttatcttatcttcgtttaa

SEQ ID NO: 790 - DNA, 828 bp, Streptococcus pneumoniae
atgatgattaaggtaattgcgacagatatggatgggaccttgctggatgctagaggtcagcttgatctcccacgattggaaaagattttagatcagttggatcaaaggggcattcgttttgtcattgcgacgggcaatgaaattcaccgcatgagacaactactgagtcccttggtggatcgagtggttctggttgttgctaatggcgctcgtatttttgaaaacaatgaattgattcaggctcagacatgggatgacgccattgtcaacaaggctttggctcatttcaagggtcgagcgtgtcagaaccagtttgttgtaacggggatgaagggtgattttgtcaaggaaggtacgatttttacagatcttgaaagttttatgactccagaaatgattgaaaaattctaccaacggatgcaatttgtggatgaattaacatctgacctctttggtggtgtgctcaagatgagcatggttgttggtgaggaacgtttgagttcggttttggaagaaatcaatgctctctttgatggccgtgtccgagctgtatccagtggctatggttgcattgatatcctccaagctgggattcataaagcatggggcttggaggaattactcaagcgctgggacttgaaatcccaagaaatcatggcttttggtgatagtgaaaatgatgttgaaatgcttgaaatggctggaattgcctatgcgatggaaaatgctgatgagaaagccaaagctgtggcgactgctctagcaccagccaacagccaaggaggagtttatcaagtcttggaaaactggttagaaaaaggagaatga

SEQ ID NO: 791 - DNA, 636 bp, Streptococcus pneumoniae
gtggtagtacagttattagaaaattggctcctaaaggaacaagaaaaaattcaaaccaaatatcgtcacctaaatcacatttctgttgtagaaccaaacattctttttattggggattccattgtcgagtattatcctctacaggagctatttgggacttcaaagacgattgtcaatcgaggaattcgtggctatcagacaggactgttactagagaaccttgatgctcatctatatggtggagcagtagataaaatttttcttctgattgggacaaatgatatcggaaaggatgttcctgtgaatgaggttctcaataatctcgaagctatcattcaatccgttgctcgcgattatccattgacagagattaaattgctttccattttgcctgtcaatgagggagagaagtaccagcaggcagtctatatccgctcgaatgaaaaaattcagaattggaatcaagcctatcaagagcttgcatctgcctatatgcaggtggaatttgtgccagtatttgattgtttgacagaccaagcaggccaactcaaaaaagaatatacaactgatggactgcacctcagtattgctggttatcaggctttgtcaaaatccttgaaagactatctttactaa

SEQ ID NO: 792 - DNA, 726 bp, Streptococcus pneumoniae
atgaatgtaaatcagattgtacggattattcctactttaaaagctaataatagaaaattaaatgaaacattttatattgaaacccttggaatgaaggccttgttagaagaatcggcctttctgtcactaggtgaccaaacgggtcttgaaaagctggttttagaagaagctcccagtatgcgtactcgtaaggtagagggaagaaaaaaactagctagattgattgtcaaggtggaaaatcccttagaaattgaaggaatcttatctaaaacagattcgattcatcgattatataaaggtcaaaatggctacgcttttgaaattttctcaccagaagatgatttgattttgattcatgcggaagatgacatagcaagtctagtagaagtaggagaaaagcctgaatttcaaacagatttggcatcaatttctttaagtaaatttgagatttctatggaattacatctcccaactgatatcgaaagtttcttggaatcatctgaaattggggcatcccttgattttattccagctcaggggcaggatttgactgtggacaatacggttacctgggacttatctatgctcaagttcttggtcaatgaattagacatagcaagtcttcgccagaagtttgagtctactgaatattttattcctaagtctgaaaaattcttcctttgtaaagatagaaataatgttgaattgtggtttgaagaagtatga

SEQ ID NO: 793 - DNA, 936 bp, Streptococcus pneumoniae
atgaagtggaccaagattattaaaaaaatagaagaacaaatcgaggcaggaatttatcccggagcctcttttgcgtattttaaggacaatcaatggacagagttctatttaggccagagtgacccagagcatggcttgcagactgaggcaggactagtttatgacctagctagtgtcagcaaggttgttggggttggcacagtttgtaccttcttgtgggaaataggtcaattagatattgatagactggtaatagattttttacctgagagtgattatccagacatcactattcgccagctcttgactcatgcaacagaccttgatccttttattcctaatcgtgatcttttaacagcccctgaattaaaggaagcgatgtttcatctcaacagacgaagtcagccagcctttctttattcggatgtccattttttgctgttgggctttattttggaaagaatttttaatcaagatttggatgtgattttaaaggatcaagtctggaaaccttggggaatgacggaaaccaagtttgggccagttgagcttgctgttccaacagttagaggtgtagaggcaggcatagtgcatgatcccaaggctcgtctcctgggtagacatgctgggagtgctggtttattttcgactataaaggatttacaaatctttttagaacactatttagcagatgattttgcaagagacttaaatcaaaatttttctcctttggatgacaaggaacgttctttagcatggaatttggaaggagattggctagaccatacgggctatacaggtacctttatcatgtggaatcgtcagaagcaagaagccactattttcctatcgaatcgtacctatgaaaaggacgagagagctcaatggatattagaccgcaatcaagtgatgaacttgattcgtaaagaagagtaa

SEQ ID NO: 794 - DNA, 897 bp, Streptococcus pneumoniae
atgtcaaatagtttaaaagggactttactaacagttgtggctggtattgcttggggggtgtcaggaacgagtggccaatacctaatggcacacggaatttcggctctggtcttgaccaacttgcgtcttttaatcgctggtggaattctcatgatcttggcttatgctactgcaaaggataaaatactggtctttttaaaggatagaaagagtttgctgtctcttcttatttttgctctgattggtctttttctcaaccaattcgcctatctgtctgctattcaggagaccaatgcgggaacagcgacggtgcttcagtatgtttgtcctgtcggaattttaatttatagctgtatcaaggatagggtggcaccgacactgggagagatagtttccatcatattcgccatcggaggaaccttcctgattgcaacacatgggcagttggaccagttatccatgacacctgctggcctgttctggggtctcttttctgccttgacttatgctctatatatcattttacccatagccttgattaaaaagtgggggagcagcttggtcattggtgtgggaatggttatagcaggtttggtcgcccttccttttacaggggttctacaggccaatatcccgactagtcttgattttctccttgcgtttgcaggtattatccttatcgggactgtctttgcctatacagctttccttaaaggagccagtctgataggaccggtcaagtcaagcttgttggcttcaattgagccaatatcggcggttttctttgccttcttaataatgaatgaacaattttatcccattgattttcttggtatggcaatgatattgtttgctgtaactttgatttctttgaaagatttattcttagaaaaataa

SEQ ID NO: 795 - DNA, 699 bp, Streptococcus pneumoniae
atgctacctgcttatatgaaaatccatgatcagataaaaaaggatattgacgagcaccgttgggctattggtgagaggcttcccagtgaaagagatttagctgagcagtttgcggtcagtcgcatgaccctccgccaagccgtatctctattagtcgaagaaggcgtcttagagcgccgtgtaggaagcggcacctttgtttccagtactcgagtacaagaaaagatgcgagggacaaccagttttactgaaattgtcaaatcccaaggtaaagttccctctagccagctcatttcctacaaaaaaaccattcccaatgagcaagaagttgccaagctaggaatttttccaacggacaatattatccgaatggagcgggtccgctatgccgaccaagttcccctagtttatgaagttgcttctattcctgaaaaattcattaaggactttaaaaaagaagaaatcaccagtcatttcttccaaaccttgcaaaaacatggctatcgtatcggcaaatctcaacagaccatctatgctcgccttgctaaagaaaagattgcccactatttggaagttgaaaaaggacatgctattcttggattgacacaggtttcctacctagaagatggtactgcttttgaatacgtaaaaagtcaatatgtaggcgaacgctttgaattttatcttgaaaataattag

SEQ ID NO: 796 - DNA, 1563 bp, Streptococcus pneumoniae
atgagcaacatttcaactgatttgcaagatgtagaaaaaatcatcgtattggactatggtagccagtacaaccagctgatttcacgccgtatccgtgagattggtgttttttcagaactaaaaagccataaaatttcagctgctgaagttcgtgaagtcaatcctgtaggaattattctatcaggtggtccaaattctgtatatgaagatggttcatttgatattgacccagaaatcttcgaactcggaattccaattttgggaatctgttatggtatgcagttattgacccataaacttggaggaaaagttgttcctgcaggtgatgctggaaatcgtgaatacggtcaatcaaccctaactcacacaccatcagcgctttttgaatcaacacctgatgaacagactgttttgatgagccatggtgatgcggttactgagattcctgctgactttgttcgtacaggtacatcagctgactgcccatacgcagccatcgaaaacccagataaacacatttacggtatccaattccacccagaagttcgtcattctgtatacggaaatgatatccttcgtaactttgcccttaacatttgtaaggctaaaggtgactggtcaatggataatttcattgacatgcagatcaaaaaaattcgtgaaaccgtcggtgataaacgtgtccttcttggtctatcaggtggtgttgactcatctgtcgttggggttcttctccaaaaagcgattggcgatcaattgatctgtatcttcgtagaccacggtcttcttcgtaaaggcgaagctgatcaagttatggacatgctcggtggtaagtttggtttgaatatcgtcaaagcagacgctgctaaacgtttccttgacaaacttgctggcgtttctgatcctgaacaaaaacgtaaaatcatcggtaacgagtttgtctatgtattcgatgacgaagcaagcaagctcaaagatgtgaaattccttgctcaaggtactttatatacagatgttatcgagtctggtacggatacagctcaaactatcaagtcacaccacaacgtgggtggtcttccagaagatatgcagtttgaattgattgaaccactcaatactctttacaaggatgaagttcgtgctcttggtacagagcttggtatgccagaccatatcgtatggcgccaaccattcccaggaccaggacttgctatccgtgtcatgggtgaaatcactgaagagaaacttgaaaccgttcgtgaatcagacgctattcttcgtgaagaaatcgctaaagctggacttgaccgcgatatttggcaatacttcactgttaacacaggcgttcgttcagtcggtgttatgggtgacggtcgtacgtatgactacacgattgcaatccgtgctatcacttctatcgatggtatgactgctgattttgccaaaattccatgggaagtacttcaaaaaatctcagtacgtatcgtaaatgaagtggatcatgttaaccgtatcgtctacgatattacaagtaaaccacctgcaacagttgagtgggagtaa

SEQ ID NO: 797 - DNA, 186 bp, Streptococcus pneumoniae
atgccacaacctattgttcctgtagagattccacaatctcgtctttttgattctaaaaagagaaatgatattctgcttaaaattcgtattggcaagcttgaagtaagtttttttcaatctctcaatctcgaaatggtagaacagcttttggataaggtgttgctctatgacaattcatctatctag

SEQ ID NO: 798 - DNA, 288 bp, Streptococcus pneumoniae
atgacaattcatctatctagcctaggacaggtctatctcgtatgtgggaaaacggatatgaggcaaggcattgattcactggcttatctggttaaaacccactttgaattagatcctttctcaggtcaagtttttctcttttgtggtggacgtaaagaccgctttaaagccctttactgggatggtcaaggattttggctactatataaacgctttgagaacggcagactgacttggctaagtacagaaaaggatgtcaaagctctcgcacctgaacaagtagactag

SEQ ID NO: 799 - DNA, 195 bp, Streptococcus pneumoniae
ttgaaaatcattcaacaacagagtgctacaattgatagtctcaccaatgaacttgcccttctgcgtgaacaagtggcttatctgactcaaaagctctatggaaaatcctctgagaaaagtgtttgcccctctggacaactcaacctttttgaggaagagtctccatctgaggaagatggagatgttcccagttga

SEQ ID NO: 800 - DNA, 390 bp, Streptococcus pneumoniae
atggaaaatcctctgagaaaagtgtttgcccctctggacaactcaacctttttgaggaagagtctccatctgaggaagatggagatgttcccagttgaaacagaggaaattacctacaaacgtaagaaatctaaagggaaacgccaagctcttcttgcccaatttgattcagaagaagttcatcatcaagtagaagagaggatttgccctgattgtcagggagatctaaaagagattggagggagtcttcaaggacaagaattggtctttattcctgcgcaattaaaacgcatagatcatatccaacacgcttacaaatgccaagcatgcagtgataaaaatccgagtgataaaatcgtgaaagctcctattcctaaagcccctttataa

SEQ ID NO: 801 - DNA, 429 bp, Streptococcus pneumoniae
ttggtgctgatctctttggcgcatagctttggctcagtttctattatcgctcacaccatccatcagaagtttaatttgaaggtacccaattatcgccaagaagaagattgggctaggatgggtttaccaatcacacgtaaggaaatctctaattggcatatcaaggcaagtcaatactatttagagtccctttataaccttttacgagaaaagttgttagaacaacctcttcttcatgcggatgaaacctcttatcgggtgctagagagtgatagccatctgacctactattggacctttttgtctgggaaagctgagaatcaagcaatcacgctgtaccatcatgatcagcgtcggagtggtttagtagtacaagaattcctaggagattattctggctatgtgcattgtgatatgttgcggcagtaa

SEQ ID NO: 802 - DNA, 450 bp, Streptococcus pneumoniae
ttggtaaactgcgagccgctagaagcttatcgtcaactggaagaagctgcacttgttggatgttgggcgcatgtgagaaggaagttttttgaagcgacccccaagcaagcagataaatcatctttaggagctaaaggattagcctattgtgatcagttattttccttggaaagagactgggaggctttgccagctgatgaacgactacagaaacgtcaagaagagctccaacccctaatagaagacttctttgcttggtgccgccgtcagtcagttttagcaggttcaaaactaggaagggcaattgaatacagcctcaagtatgaagaaacctttaagaccattttgaaagacggacatctggtcctttccaataatctagctgaatgcgccattaaatcattggttatgggacggagtaaaagagtccagtggactcttttagcctaa

SEQ ID NO: 803 - DNA, 234 bp, Streptococcus pneumoniae
cctaagctcagtttaaaaaagcgagggtggttattttctcaaagttttgaaggagctaaagcaagagctattattatgagtttgttggaaacagctaaacgtcatcaactaaatagtgagaaatatctatcctatcttctagaatgtcttccaaacgaggaaactctcgtaaacaaagaggttttagaggcctatttaccatggactaaagttgtacaagaaaagtgcaaatga

SEQ ID NO: 804 - DNA, 1365 bp, Streptococcus pneumoniae
atggttgaaataaaaaatttaagtcttgattatggtgaagagcatatattagatgatatatcactatccatagccgagggagagtgcgtgctatttacaggaaaaagtggaaatggtaagtcatctttaataaattcaatcaatggactagctgtaaggtatgataacgcaaagacaaagggcgaaataattattgatggtaagaatataaaaaatttggaactttatcaaatctcaatgcttgtttcaactgtttttcaaaatcctaagacatatttttttaatgtcaatacgacattagaattattattttatttggaaaatatcggtcttgcaagagaagagatggacaggcgtttgaaggatatacttgagatattcccgataaaaaatcttttaaacagaaatatatttaatctatccggcggtgaaaaacaaattctttgcattgcagcttcttatatagcaggtacaaagattatagttatggatgagccttcatcgaatttagatattaaaagcataagtgttttggcaaagatgctaaagatattaaaagagaaaggcataagcataattgttgcagagcatagaatttattatttgatggacatagttgaccgtgtatttttaatagataaaggaaagcttaaaaaaacttatactagaagtgaatttttaaagctagataaaaatgaattaaatgctttaagtttaagagataaagaattaagtaaattaaaagttccttatttaaaagaaggtggagagtatcagataaaaaatcttagctacaaatttactgatgatgagtgtttaagcttaaaagatatttcattcaagcttgggaaaatttatggcataataggatccaacggacgaggaaaatcaacgcttttaagatgtttaataggtcttgagaaaaaatcaaaagaagaaatttattttaagggagagaagctatctaaaaaagaaagactcaaaaactcttcacttgttatgcaagatgtaaatcatcaattattcacagatgaagtattcaacgagcttagattaggagtaaagaattttgatgaagaaaaggcgaaaatcattttaaaagatttatgcctggacgaatttattgaaaggcatccgatgagtttatcaggagggcaaaagcaaaggcttgcaatagcatctgttatgtgcaagaattctccatttgtcttttttgacgaaccttcaagtggtatggattattccaatatgataaaaatatctgaactgattaataagtataaaaccatggataaaataatttttattgtttcccatgatatagaatttttaaatgaagtggcagatgaaatttttgaattgtaa

SEQ ID NO: 805 - DNA, 222 bp, Streptococcus pneumoniae
tccataccacttgaaggttcgtcaaaaaagacaaatggagaattcttgcacataacagatgctattgcaagcctttgcttttgccctcctgataaactcatcggatgcctttcaataaattcgtccaggcataaatcttttaaaatgattttcgccttttcttcatcaaaattctttactcctaatctaagctcgttgaatacttcatctgtgaataattga

SEQ ID NO: 806 - DNA, 696 bp, Streptococcus pneumoniae
atgcctactttttcttcaaatgctccctttaatcccaatccgatctctaagatattagtcgtatttatcacaggcttaactgttatgcatagcataaacatccgttttgagctggcaattgtttgtcttattggtattttgctttatttgaatggatacaaaaaaacacttttcaaatggattatattgtgtgggatactttactccttgcctaattttatggtgttatctgaattaaaccctatagttaagatgtttttgagtatacctattgttattagaatgtttattttaccatttatggcagcaagctttatgataaagacctcggatgtaggcgcaataatttcatcgatggataagcttaagatttcaaagaatgtatccatacctattgcggttatgtttagattcttcccatcttttaaggaggagaagaaaaacatcaaaatggctatgagagtaagagggataaattttaaaaacccagtcaaatatcttgaatatgtttctgtgccactactcattatatcatctaatatatcagatgacattgcaaaagcggcagaaacaaaggcaatagaaaatccaattgccaagaccagatacattcgcgtaaagatacagctaattgattttgtttatgttttagcggttgctggacttattgtgggaggcttaatatggttgaaataa

SEQ ID NO: 807 - DNA, 585 bp, Streptococcus pneumoniae
atggataataaaaaattaaaagtaaaagatttagtaagcatcggtgtttttggcgtaatttattttgccttcatgtttggagttggtatgatgggcttgattccaatattgttcttaatatacccgacagtattagccatagttgcaggaactgttgttatgttatttatggctaaggttcaaaagccatgggcactatttatatttggtatgatatcaccacttgtgatgtttgcagctggtcatacctacgtagttgtggttttatcacttatagtaatgataatagcagaattaattagaaagattggtaattataattcatttaaatacaatatgctttcttatgcaatcttcagcacatggatatgtagctctttaatgcaaatgcttttagcaaaagaaaaatatatggagtggtctttgatgactatgggaaaagattatgttgatgtattagaaaagttaataacttatcctcacatggctttagtagccttaggtgctttcttaggaggaattcttggagcatatataggcaaggctctattgaaaaaacactttgaaaaagcaggcatcgtataa

SEQ ID NO: 808 - DNA, 1746 bp, Streptococcus pneumoniae
ttgcgaatgaatggagggtttcaaatgaaagagttttataaaaaaagatttgctcttacagatggaggagcaagaaatttaagtaaagcaacactggcttcatttttcgtttattgtataaacatgcttcctgccatattacttatgatttttgctcaggaagttttggaaaatatgggcaaaagcaatggcttttatatagtattctcagttttgattttgatagcaatgtatattttgctttctatcgaatacgataaattatataacacaacctatcaagaaagtgcagatttaagaataaggacagcggagaatttatcaaaattacctctatcttacttttctaaacatgacatttccgacatttcacaaacaatcatggctgatattgaaggcatagagcatgcaatgagccactcaataccaaaggtgggcggcatggtactgtttttcccattaatatctgtaatgatgctagcgggcaatgtcaagatgggtttagctgtaattattccatctattttaagctttatatttatacctttatctaaaaaatatcaggttaatggacagaatagatattatgatgtcttaagaaaaaactcagaaagctttcaagaaaatatcgaaatgcaaatggagattaaagcatataatttatcgaaggatattaaagatgacttatataaaaaaatggaagatagtgagaaagtacacttaaaggcggaagtaactacaattttaactttgtctatatcttcaatatttagctttatatctcttgctgttgtgatatttgtcggcgtaaatctaattattaataaagagataaattctctctaccttataggatatttactagctgctatgaagataaaagactctttagatgcatctaaagagggcttgatggaaatattttatttatcgcccaaaatagaaagattaaaagaaattcaaaatcaagatttacaagaaggcgatgactatagcttaaaaaaatttgatattgatctaaaagatgttgagtttgcctacaataaagacgaaaaagttttaaatggtgtaagttttaaagctaagcagggagaggtcactgctttggtaggtgcaagtggctgcggtaaaacaactatcttgaaacttatatcaagactttatgattatgacaagggacaaatcttaatcgatggcaaagatataaaggaaatatcaacagaatccctttttgataaggtgtctattgttttccaagatgtggttctctttaatcaaagcgttatggaaaatattagaatcggtaagcaagatgcaagtgacgaagaggttaaaagagcagcaaaacttgcaaattgcacagattttatagaaaaaatggataaaggtttcgatacagttattggtgaaaacggagctgagctatcaggaggagaaagacaaagattatcaatagccagagccttcttaaaagatgcgccgatattgatcttagatgagataacagcaagccttgatgttaacaacgagaaaaagattcaagagtctttaaataatttagttaaagataaaactgttgtaatcatttcacatagaatgaaatccatagaaaatgcagacaagatagtagttcttcaaaacggaagagtagaaagcgaaggtaagcatgaagagcttttacaaaaatcaaaaatttacaaaaatttaatagaaaagacaaaaatggcagaagaatttatttattag

SEQ ID NO: 809 - DNA, 1761 bp, Streptococcus pneumoniae
atgcttatgaagatttacaaaaaactatttgcttatgtccaagataagaaatatcttggggttttggccataattttttctgctatatctgctgcacttacagtatatggatattatttaatctacaaatttctagataagttaataattaattcaaacttatccggtgcagagagtatagcattaaaatctgttattacactaacaagtggagcgatattttattttgtctcaggaatgttttcacatatcttgggattcaggcttgaaacaaatttaagaaaaaggggaatcgatggtctggaaaaagcaagttttaggttctttgacttaaatccatctggtcaaataagaaagattatagatgacaatgctgcacaaactcatcaggtggtagcacacatgattcccgatagttctcaggcaataatcacacccgtacttgtacttgcacttggctttatagtaagtataagagttggcataattttgcttgctcttactataattggtggcttaattttaggggcaatgatgggcgagcaagaatttatgaagatataccaagaatccctatctaaactaagtgctgaaactgttgagtacgtgagaggaatgcaagttgtaaaaatatttaaagcaaatgtagagtcttttaaaagcttttataaggcgataaaagattactcaaagtatgcttatgattattccctatcttgtaaaaggccttatgttttgtatcaatggttattttttggactgattgcaattttaattattcctatagtttattttatgactagcttagctagcgcaaaggtgattttacttgagcttatcatgattttatttttatcaggagttctctttgtttcattcatgagaatgatgtggtactccatgtatatttctcaaggaaattatgcagtagatactttagaggcgctttacgaagatatgcaaaaagacaaattagtgcatggtaatgtcaataattttaaaaactataatatagaatttgagaatgttagctttgcttataatgataaagctgtcattgaaaatttatcctttaatttagaagaaggaaagtcctacgcacttgtcggttcatctggatcaggcaaatcaacagtagcaaaacttatatcaggtttttacaatgttaataaaggaagcataaagataggcgggatagcaataagtgaatattctgacgaagccttaattaaagccatttcctttgtttttcaagattcaaaattattcaagaagagcatttatgataatgtagcgttagctaataaagatgcgacgaaagatgacgttatgagagccttaaaattagcaggatgcgatttaatattagacaaattcccagaaagagaaaatacaatcataggctcaaaaggtgtttatttatccggtggagaaaaacaaagaattgcaattgctagagcaattttaaaggattccaaaattattattatggatgaagcatcagcatctattgacccagataacgagtttgaattgcaaaaagcttttaaaaatcttatgaaggataaaacagttatcatgattgcacacaggctatctacaattaaagaccttgatgaaattattgtcatggatagtggaaaaattatagaaagagggtctgacaaagaattaatgtcaaaagatacaaggtataagagcctgcaagagatgtttaacattgcgaatgaatggagggtttcaaatgaaagagttttataa

SEQ ID NO: 810 - DNA, 477 bp, Streptococcus pneumoniae
atattaaattgtaagatggacgctcctgccgctgattttttctttaaagcaaaggcaaatgaatggataagtatagtaattgacacatacttaaatagaaaaaaatataaaattgaaattgatgatgataaagcacttgaagatgtagcaagattcttagatgatcattttgcaacgaatgtaaatcaaggcacgcttgaaaaaatatctaaaatgagtggtactaaattaaaaaatttatttaaggaaaaatattgtcaaagcattacagagtacactcaaagaaaaagaatgaatgtagctgaaactcttcttttaaacactgaactacctataaaagagatagcagaatctgttggatattcatctgccagcaaattttctatctattataaaagatacaagggaaaacttccaagtgaagtccgtaatttagcttgcaaacatcacaattttaaatgcgattattgtgattaa

SEQ ID NO: 811 - DNA, 207 bp, Streptococcus pneumoniae
tcatctaagaatcttgctacatcttcaagtgctttatcatcatcaatttcaattttatatttttttctatttaagtatgtgtcaattactatacttatccattcatttgcctttgctttaaagaaaaaatcagcggcaggagcgtccatcttacaatttaatatttccattgccactctttctaaggcctttgtaagtattatttga

SEQ ID NO: 812 - DNA, 1191 bp, Streptococcus pneumoniae
atgacagtattaaaaggagataacttagaaatattaaaaactattgaatcctcaagtattgatttaatctatatggaccctcctttctttacacagaaaacccaaaaattatctaataacaaaaatattatgtattcattcgaagatacgtggacttcgattgaggattacaaagaatttttgtctgtaagattagaagaatgcaaaagagtgctaaaaaatagtggcagtattttcgttcattgtgataaaattgcaaatcatcatattagattaattttagataatatctttggagcagatatgtttcaaagcgaaattatatggaactataagcggtggtctaattcaaaaaagggattattgaacaatcatcaaaacatttacttttattcaaagtcaaaagattttaaatttaatacaatttttacagagtattcttctactacaaatatcgaccaaatactagtggaacgaaaacgagatggaaactctaaaactatatataaagttgataataatggtaactatattctagcaaaagagaaaaatggagttcccctttcagatgtttggaatataccatttcttaatccaaaagctaaagaaagagtaggttatcctacacaaaaacctattctgttattagaacaaattataaagattgctactgataaaaatgatatagttttagacccgttctgtggaagtggaactactttagtagcctccaagattttgaatagaaattatatggggattgatttatctgaggaagctatcaatataactcagcaacgtctggaaaatgttataaaaacaagttcaaatttattgaataaaggaatcgaagcatatagaaccaaaactgaggaagaggaaaacattcttaaattattacaggcaaaaattgttcaaagaaataaaggaattgatggttttttacctaaacattttcaaaaaaaaccgatacctataaaaattcaaaaaaataatgaatgtctgaatgagagtatctctttattacagaatgctataaactccaaaaaacttgattttggagtagttataaaaactcattcagataatttattatttgattttgatacgattcctgaaaatataatagtagttgaccattttgaacttacaatcgaaaaatggttaagtaaaagtcaacagttactatag

SEQ ID NO: 813 - DNA, 189 bp, Streptococcus pneumoniae
atgttctactatccaaatagaactcaagctataaaaattcagcaaactttagaaacattgtataacggtattggagggaaatattatggagattctgcctgggaacatttaagagcagtgaccggtattgatttacttagtattctaacagatattgcaaataaaaaaacaggggtaaaatcaaaatga

SEQ ID NO: 814 - DNA, 183 bp, Streptococcus pneumoniae
atggcaaatgataataagagccattatttgatatacagagttttaggtatttcatttgaagaaggagaaaatatcgatttgtatcaaaataaaggtcgttttttatacaaatatgctggttcatttttagaagaagctgcagtactatcctttaacgaaaaatttggtacagaaaatacttaa

SEQ ID NO: 815 - DNA, 213 bp, Streptococcus pneumoniae
atgaatagagacgtagctaataagttgaataacatatttggaaaaatgagaaatagcaatattactagaacttttagaaacaatcaatatttaaaaagaaaaaagctcaaagaatttattaaaccatgttataatagatatagctataattttatttataacaagaggatagaaatgaccgaattagaaagaaaaaatcgaaaaattagctaa

SEQ ID NO: 816 - DNA, 1287 bp, Streptococcus pneumoniae
atgacaaaaacattaaaacgtcctgaggttttatcacctgcagggactttagagaagctaaaggtagctgttcagtatggagcagatgctgtctttatcggtggtcaggcctatggtcttcgtagccgtgccggaaactttactttcgaacagatggaagaaggcgtgcagtttgcggccaagtatggtgccaaggtctatgtagcggctaatatggttatgcacgaaggaaatgaagctggtgctggtgagtggttccgtaaactgcgtgatatcgggattgcagcagttatcgtatctgacccagccttgattatgattgcagctactgaagcaccaggccttgaaatccacctttctacccaagccagtgccactaactatgaaacccttgagttctggaaagagctaggcttgactcgtgtcgttttagcgcgtgaggtttcaatggaagaattagctgaaatccgcaaacgtacagatgttgaaattgaagcctttgtccatggagctatgtgtatttcatactctggacgttgtactctttcaaaccacatgagtatgcgtgatgccaaccgtggtggatgttctcagtcatgccgttggaaatacgacctttacgatatgccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatgaagtctattcactacgtatcaacagtaaccaactgctacaaggcggctgtggatgcctatcttgaaagtcctgaaaagtttgaagctatcaaacaagacttggtggacgagatgtggaaggttgcccaacgtgaattggcaacaggtttctactacggtataccatctgaaaatgagcagttgtttggtgctcgccgtaaaattcctgagtacaagtttgtcgctgaagtggtttcttatgatgatgcggtacaaacagcaactattcgtcaacgaaacgtcattaacgaaggggaccaagttgagttttatggtccaggtttccgtcattttgaaacctatattgaagatttgcatgatgccaaaggcaataaaatcgaccgcgctccaaatccaatggaactattgactattaaagtcccacaacccgttcaatcaggagacatggttcgtgcattaaaagaaggactcatcaatttttataaggaagatggaaccagcgtcacagttcgagcttaa

SEQ ID NO: 817 - DNA, 729 bp, Streptococcus pneumoniae
agtatgcgtgatgccaaccgtggtggatgctctcagtcatgccgttggaagtacgacctttacgatatgccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatggagtctattcactatgtattaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgtcgtaaaattcctgagtacaagtttgtcgctgaagtggtttcttatgatgatgcggcacaaacagcaactattcgtcaacgaaatgtcattaacgaaggggaccaagttgagttttatggtccaggtttccgtcattttgaaacctatattgaagatttgcatgatgccaaaggcaataaaatcgaccgcgctccaaatccaatggaactattgactattaaggtgcctcaacccgttcaatcaggagacatggttcgtgcattaaaagaaggactcatcaatctttataaggaagatggaaccagcgtcacagttcgtgcttaa

SEQ ID NO: 818 - DNA, 723 bp, Streptococcus pneumoniae
ttgatgaaaattcttgttcagaataatcaaccgacttcaggtaatattataagcagtgataatattgggtatttaatcgaagaaccaaaattatttttatctaaaacaggtttagagaatttaaaatatttgtcaaatttatatggtgttgactacaatcaagaaagatttagaagtttgatccaagagttagatttgactcagtctattaataaaaaagtaaagacctattctttgggtacaaaacaaaaattagctttgcttctaactctcgttacgaaacctgatatattgattttagatgaaccgactaatggtttagatattgaatcatcacaaatagttttagcggttctaaaaaaattagctttaaatgaaaacgtgggaattttaatatcgagtcataaattagaagacattgaagaaatttgtgagagggttcttttcttggagagcgggcttttgacatttcaaaaagtaggaaaagatagtcataatttcttgtttgagatagctttttcatcagctacagatagagacattttcattaccaaacaagaatttggggatattgttcaggaagagggactgagaattactatgtctgggaatattcaaagtagtgagctttttaaattttttaacgaaaactctattaaagtagttgattttgaaactaaaaaagagacgcttaaagatatttacttaaatcgttcaaaataa

SEQ ID NO: 819 - DNA, 729 bp, Streptococcus pneumoniae
atgaaattaaataaattgaattttcttaaggaaaatataagaaatttatattcatcaggcgtaatatatctcagtttgcttatctcgtttataccgccgatattgcttacattctttattctaaagactcaagggacatcgcttggtattaagcatatttcaaacttttatgctatgctcggtatgttaatggctgttatacatgctaatcgagttattagtagagatttttcccacaatacggtaagtttgttttataatcaacagaagaatcggatgatttacgtcttgtctaattttctatatgccatctcagtttccattatttatgctttgaatggcattgtgttactagtcatagtaagtaaattgggtattccaggtgatttaggattagattttatagtagctattgtagtcaatacaattttgttagtcctgttttattttctattatcttacattttctatttatacaaattgaaaagtggcttggtatttggtattttagtagctttactactctttatccctaatatattaaatacgatgatgatgaatactagtaatgatttgtttatcaaagcaattgaacttcttcctttttattctttacctgtatttgtggcttcaaatacgatgtctattagtcagtatcttgtgctaatcactacaatcattttattgtactttttcactctcaagaaaagcaagaagtattcattttag

SEQ ID NO: 820 - DNA, 240 bp, Streptococcus pneumoniae
atgaatattaaaattataaggaggacgaaggtggttaaaaatttaaaattaaaattagctcgggtagagcttgatttaactcaaggtcaactagcagatgctgtcggggtgacgcgccagactattggtttgatagaggcggggaaatacaatcccagtctctcgctctgccagtccatttgcagatgtttagggaaaaccctagaccaactattttgggaggaagaagatgaaaaatag

SEQ ID NO: 821 - DNA, 489 bp, Streptococcus pneumoniae
atgaaaaatagattttattattatcaattactagacgaaagagaagaacaactgttcaataaagcgggctctgaaagtttctatatctgcatcgctttgtcgctcctatcttatatcatttcagtattagcaccaagcctttttaattctaatatgctgctaatcgttatcatcatagggacattttactttttcaatcgtgcccgttatctgggagtgacctactatagtcgttttcattttacgattttgggttgttttttcctaaccttggctattacggctcttttgatgttgcagaattatcaattcaacatagaaatttatcagcacaatcctttgaattttaaatacctgtctgcttgggtcattacttatgtcatttaccttccgtgggtctttattggcaatcttggtcttaagagctatggcgaatgggctcagaaaaaatttgaacaagatatggatgaattggagagtggagaatag

SEQ ID NO: 822 - DNA, 1461 bp, Streptococcus pneumoniae
atgtatccagatgatagtttgacattgcacacggacttgtaccagatcaacatgatgcaggtttactttgaccaagggattcacaataagaaggcggtctttgaggtgtatttccgccaacagccttttaagaacggctatgcggtttttgcaggtttggaaagaattgtgaactatcttgaagacttgcgtttttcagatagtgatatagcctatttggagtcgcttggttatcatggggcgttcttggattaccttcgcaatttcaagttggagttgaccgttcgttctgcccaagaaggggatttggtttttgctaatgaaccgattgtgcaggtggaaggacctctagcccaatgtcagttggtcgaaacggctcttttgaacatcgtcaactaccagaccttggtggcgacgaaggcagctcgtattcgttcggttatcgaagatgaacccttgatggagtttgggacacgtcgggctcaagaaatggatgcggccatctggggaacacgcgcagcggtgattggtggcgccaatggaaccagcaacgtgcgtgcgggtaagctctttgacattcctgttttgggaacccatgcccatgccttggtacaggtttatggcaatgactatgaggctttcaaggcttacgctgcgacccacaaaaattgtgtctttcttgtggatacctatgatacccttcgcatcggtgtaccagctgccattcaggtggcgcgtgagctgggtgatcagattaactttatgggtgtgcggattgactctggggatattgcctacatttctaagaaagtccgtcagcaactggacgaggctggatttacagaggctaagatttatgcttctaatgatttggacgaaaatactatcctcaatctcaagatgcaaaaggccaagattgatgtctggggtgtgggtaccaagctgattacagcctatgaccagccggctcttggggcggtttacaagattgttgcaatcgaagatgaaactggtcagatgcgcaatacgattaagctgtctaataatgcggaaaaagtgtcgacgccaggtaagaagcaggtgtggcgcattaccagtcgtgaaaaaggtaagtcagaaggtgattacatcacttatgatggtgtggatattagcgacatgacagaaatcaagatgttccatccgacctatacatacatcaagaagacggttcgtaattttgatgccgttcctctcttggtggatatcttcaaagaaggaatattagtttacaacttgcctagtttgactgacattcaggattatgcccgtaaagaatttgacaagttgtgggatgagtataagcgtgtgctcaatccgcagcactatccagtggatttggcgcgtgatgtatggcaagataagatggacttgattgataagatgcgcaaggaagcccttggtgaaggagaagaagaatga

SEQ ID NO: 823 - DNA, 825 bp, Streptococcus pneumoniae
atgagtttgcaagaaacgattatccaagagctgggtgtcaaaccagtgattgatgcccaggaagaaatccgtcgttctattgatttcttaaaaagatatctgaaaaaacatcccttcctaaaaacctttgtactagggatttctgggggacaagactcaaccttggcagggcgtttggcgcaattagctatggaagaactgcgagctgaaacgggagacgatagctacaaatttatcgctgtccgcctgccatacggagtgcaagctgatgaagcagatgctcaaaaagccctagccttcatccagccagatgtcagcttggttgtgaatatcaaggaatcagctgatgccatgacagctgcagttgaagcgacaggtagtcctgtttcagacttcaacaaggggaatatcaaggcacgttgccgtatgattgctcagtatgcccttgctggttcccatagcggagcggtcattggaacagaccacgccgcggaaaatatcacaggtttctttaccaagtttggtgacggcggtgcggatattctccctctttaccgcctcaataaacgccaaggaaaacagctcttgcagaaacttggcgcagagccagccctttatgaaaaaatcccaacggcagacctagaagaagataaaccaggcctagctgacgaagtcgcacttggagtcacctacgcagagattgacgactacctagaaggcaaaacaatcagcccagaaactcaagcgaccattgaaaactggtggcacaaaggccaacacaaacgccacttacccatcaccgtatttgatgacttttgggagtaa

SEQ ID NO: 824 - DNA, 198 bp, Streptococcus pneumoniae
aaggcaaaacaatcagcccagaaactcaagcgaccattgaaaactggtggcacaaaggccaacacaaacgccacttacccatcaccgtatttgatgacttttgggagtaaaaaggtccgggggacctttttagcttcttgccctgaaattaaaaagcaagaaaaacctccactggaggttttcagcctctcatcttga

SEQ ID NO: 825 - DNA, 552 bp, Streptococcus pneumoniae
atgaaatctattggtacgcaaatattacagacagaacgtttgattttaagaagatttgtggagagtgatgcagaagccatgtttcaaaattgggcttcatccgctgagaatctgacctatgttacctggaatccccatcctgatgtcgaaatcactcgaaactcgattcgcaattgggttgcttcctatactaatctcaactattacaaatgggccatttgtctaaaagaaaacccagagcaagtgataggagatatcagcatcgttaagatagacgaggctgatttaagctgtgaaatcggctatgtgctaggcaaggcttactggggacatggtatgatgacagaggccttgaaagctgtcttggacttttgttttactcaagcaggttttcaaaaggtcagagcacgttatgccagtctcaacccagcttcaggtcgtgtcatggaaaaggctggaatgtcctatctacaaaccattgttaatggtgtagagagaaaaggctatcttgcggatcttatttattatggtataagtagggaagaatgttga

SEQ ID NO: 826 - DNA, 750 bp, Streptococcus pneumoniae
actcggaaagatttttggttctgcggtaatcgggctaactttatttttaggaggaatctgaatacaagttttgttcatgctgctgatgggattcaatatgtcagagatgatactagagataaagaagagggaatagagtatgatgacgctgacaatggggatattattgtaaaagtagcgactaaacctaaggtagtaaccaagaaaatttcaagtacgcgaattcgttatgaaaaagatgaaacaaaagaccgtagtgaaaatcctgttacaattgatggagaggatggctatgtaactacgacaaggacctacgatgttaatccagagactggtcatgttaccgaacaggttactgttgatagaaaagaagccacggatacagttatcaaagttccagctaaaagcaaggttgaagaagtttttgttccatttgctactaaatatgaagcagacaatgacctttctgcaggacaggagcaagagattactctaggaaagaatgggaaaacagttacaacgataacttatgatgtagatggaaagagtggacaagtaactgagagtactttaagtcaaaaagaagactctcaaacaagagttgttaaaaaaggaaccaagccccaagttcttgtccaagaaattccaatcgaaacagaatatctcgatggcccaactcttgataaaagtcaagaagtagaagaagtaggagaaattggtaaattactcttactacaatctatactgtag

SEQ ID NO: 827 - DNA, 390 bp, Streptococcus pneumoniae
atggtaaaaagacgtataaggagagggacgagagaacctgaaaaagttgttgttcctgagcaatcatctattccttcgtatcctgtatctgttacatctaaccaaggaacagatgtagcagtagaaccagctaaagcagttgctccaacaacaggctggaaacaagaaaatggtatgtggtatttttataatactgatggttccatggcaacaggttgggtacaagttaatggttcatggtactatctcaacagcaacggttctatgaaagtcaatcaatggttccaagttggtggtaaatggtattatgtaaatgcatcgggtgagttagcggtcaatacaagtatagatggctatagagttaatgataatggtgaatgggtgcgttaa

SEQ ID NO: 828 - DNA, 1041 bp, Streptococcus pneumoniae
atgaacaaatatatgaatacagctgattttgatttccacttgccagaggaattgattgcccaaacgccccttgaaaaacgtgatgcctccaaactcctcatcgtcaaccgtgagacaggagaaatgcaagataaacatttccactctattattgatatgctggaacctggtgatgcccttgtcatgaacgacacccgagttctccctgcccgcctctatggtcaaaaagtggagacaggaggtcatgtggaacttctcctccttaagaacactagtggagacgagtgggaagttctggctaaacctgccaaacgcctcaaggtcggtactcgtatcagctttggtgatggccgcctcagcgctgtcgttacagaagaattgacccacgggggacgcattgtccgctttgaataccaaggaattttcctagaagtcttggaaagtctgggagaaatgcctctgccaccttatatccacgaaaaattagatgaccgtgaacgttatcaaaccgtctacgccaaggaaagcggctctgctgcagcaccgactgctggtcttcacttcaccaaagaactgctggcagaaatccaagctaagggtgttcatctagtctatctgactctccatgtcggactcggaacctttagacctgtttctgtggataatctggacgaacacgaaatgcactcagagttctatcaactttctgaggaagctgctgccacccttcgctctgtcaaagaaaatggtggtcgtgtcatcgctgtcggaaccacttctatccgtaccttggaaactattggttccaagtttgatgggcaaatccaagcagattctggttggaccaatatctttatcaaacctgggtatgagtggaaggtcgtggatgccttctcaaccaacttccatctgccaaaatcaactctggtcatgttggtttctgcctttgcaggccgtgaattagtcttagatgcctaccaccatgccatccaagaacactaccgcttcttcagttttggtgacgccatgtttatttattga

SEQ ID NO: 829 - DNA, 708 bp, Streptococcus pneumoniae
atgaaagttattaaagttgaaaaccaagttcaaggtggaaaagttgcttttgagattttgaaggaaaaattggctaatggagctcaaactctaggacttgcgacaggaagtagcccacttgaattttacaaggaaattgttgagagtgaccttgatttttcaaatctaaccagtgtcaaccttgatgagtatgtgggccttgatggggacaatccacagtcttatcgttacttcatgcaagaaaacttgttcaaccaaaaaccatttaaagaaagtttcttgcctcgtggtgttaaggacaatgctgaagctgaagttgaacgctacaaccaaattttggctgaccatccagttgacctccaaatcttgggaatcggtcgcaatgggcatatcggctttaatgagcctggtactccatttgacagtcaaacgcatctagtagaacttgaccagtctactatcgaagccaatgctcgcttctttgccaagattgaagacgtcccaacccaagctatttcaatggggattaaaaacattttggatgccaagtctattattctttttgcttatggtgagtcgaaagcagaagccattgccggaacagtatctggcccagtgactgagaacctacctgcaagtagcctccaaaatcaccctgatgtaaccatcatcgcagatgctgaagcgcttagcttactcgaaaaataa

SEQ ID NO: 830 - DNA, 201 bp, Streptococcus pneumoniae
ttgaacttgaagggagtgaaaaaaatgtctaaaacagtagtacgtaagaatgaatctcttgacgacgcacttcgccgtttcaaacgtgcggttactaaagctggtactcttcaagaaacacgcaaacgtgaattctatgaaaaaccttctgtaaaacgtaaacgtaaatcagaagtagctcgtaaacgtaaaaaattctaa

SEQ ID NO: 831 - DNA, 939 bp, Streptococcus pneumoniae
atgatgtcggttttagtaaaagaagtgattgaaaagcttagactagatattgtctatggtgaaccagaattgcttgaaaaggaaatcaatacagcggatattacgcgacctggtcttgaaatgacaggctattttgactactatacaccagagcggattcaacttttggggatgaaggagtggtcttatctgatcagcatgccttccaacagccgttatgaagttttgaaaaaaatgtttctacctgagacaccagcagtcattgttgcccgtggtttggtggttccagaggagatgttaaaggctgctagagaatgtaagattgctattttaaccagccgtgcagctaccagtcgtttatctggagagttatctagctatctggattctcgtttggcagaacgtaccagtgtgcacggtgtcttgatggatatttatgggatgggcgtcttgattcagggagatagtggaattggtaagagcgagacaggtcttgagcttgtcaaacgtggtcaccgtttggtagccgatgaccgtgtcgatatctttgccaaggatgagattactctctggggtgaaccagctgaaattttgaaacacttgattgaaattcgtggggttggtattatcgatgttatgagtctctacggtgcgagtgctgtcaaggattcttcacaggttcagcttgctgtctatttggaaaattacgatacgcataagacctttgatcgtcttggaaacaatgcagaggaacttgaagtttctggcgtagccattcctcgtattcgtattccagttaaaacaggtcgtaatatctctgttgtgattgaggcagctgccatgaattatcgtgccaaggaaatgggctttgatgctaccggttggttcgacgaccgactgccaagtctcatagctcgaaatgaggtgcaaaatgcttga

SEQ ID NO: 832 - DNA, 576 bp, Streptococcus pneumoniae
tactatagtcagaatttaggagagatttttgccatttggaatggtggtttggccatttacggtggtttgataactggggctcttgtgctctatatctttgctgaccgtaaactcatcaatacttgggattttctagatattgcggcgcctagcgttatgattgctcaaagtttggggcgttggggtaatttctttaaccaagaagcttatggtgcaacagtggataatctggattatctacctggctttatccgtgaccagatgtatattgaggggagctaccatcaaccgactttcctttatgagtctctatggaatctgcttggctttgccttgattctgatttttagacggaaatggaagagtctcagacgaggtcatatcacggccttttacttgatttggtatggtttcggtcgtatggtcatcgaaggtatgcgaacagatagtctcatgttcttcggccttcgagtgtcccaatggctgtcagttgtctttatcggtctcggtataatgatcgttatttatcaaaatcgaaagaaggccccttactatattacagaggaggaaaactaa

SEQ ID NO: 833 - DNA, 384 bp, Streptococcus pneumoniae
atgttagaagttgcatatattcttgttgccctagctgtgattgtctttttggtctatctgatcattactgtacaaaagcttggtcgtgtcatcgatgaaacagaaaagacgattaaaaccttgacttcagatgtggatgtgaccttgcatcacaccaatgagttgttggctaaggtcaatgtcttggcagatgatatcaatgtcaaggtggctacgattgatccactcttcagtgctgttgcagatttatctctatctgtttcagacctcaatgaccatgcgcgtgtcttgagcaagaaagcttcatcagctggttcaaaaacactcaagactggtgcaagtctgtcagctcttcgtcttgcaagtaaatttttcaaaaaataa

SEQ ID NO: 834 - DNA, 330 bp, Streptococcus pneumoniae
ttgcccttatcacttgttaaaaacaaggcaagagctgcacctgaaacggttcctaaaaggattgaggataatttacccataaggattctccttttttattttttgaaaaatttacttgcaagacgaagagctgacagacttgcaccagtcttgagtgtttttgaaccagctgatgaagctttcttgctcaagacacgcgcatggtcattgaggtctgaaacagatagagataaatctgcaacagcactgaagagtggatcaatcgtagccaccttgacattgatatcatctgccaagacattgaccttagccaacaactcattggtgtga

SEQ ID NO: 835 - DNA, 390 bp, Streptococcus pneumoniae
atgggtaaattatcctcaatccttttaggaaccgtttcaggtgcagctcttgccttgtttttaacaagtgataagggcaaacaagtttgcagtcaggctcaagattttctagatgatttgagagaagatccggagtatgccaaggagcaagtctgtgaaaaactgacagaagttaaggagcaggctacagattttgttctgaaaacaaaagaacaggttgagtcaggtgaaatcactgtggacagtatacttgctcaagctaaatcctatgcttttcaagcgacagaagcatcaaaaaatcaattaaataatctcaaggaacaatggcaagaaaaagccgaagctcttgatgactcagaagagattgtgattgatataacagaagaataa

SEQ ID NO: 836 - DNA, 1131 bp, Streptococcus pneumoniae
atgcagaaaaaaccaacgtcagcctatgtgcacatcccattttgtacccagatttgttattattgtgatttttcaaaggtcttcatcaaaaatcagccagtcgacagctatttagagcatctgctggaagagtttcgttcttatgatattgaaaagttgtcaaccctttatatcggtggtggaacaccgacagccctgtcggctccgcaactggaggtgttactgaatggcttgactaaaaacttggatttgtctgtcttggaagagttgaccattgaagccaatccaggcgatttggatgcggataagatagctgttttgaaaaattcggctgtcaatcgtgtttcgctaggtgtccagacctttgatgataagatgttgaaaaagattgggcgcagtcatttggagaaggatatttatgaaaatatcgatcgcctgaaactggctggttttgacaacatctccattgatttgatttatgctctgcctggtcagaccatggagcaagtaaaggaaaatgtggctaaagccattggattggatattccccacatgagtttgtatagtttgattttagaaaaccatacggtctttatgaaccggatgcgacgtgggaaattgcctctgcctaaggaggaactagaagcggagatgtttgagtacatcattgcagagctggagcgagcgggttttgagcattatgagatttctaatttctccaaacccggctttgaaagtcgtcataatctcatgtactgggacaatgctgaatactatggtattggtgcaggggcatctggttatgtcaatggagtacgctataaaaatcatggtcccattcgtcattatctcagtgcggttgaggaaggcaatgcttgtattacagaagatcacctgagtcaaaaggagcaaatggaagaagaaatgttcttgggactccgcaagaaatccggggtttccatggcgcgatttgaggaaaaatttggacagtcttttgctggactttatggagaaattgtcagagatttggttcaacaaggcctcatgcagattgagggtgaccacgttcgcatgacaaagagaggtctctttttgggagatactgtagcagaacgatttattttggagtag

SEQ ID NO: 837 - DNA, 498 bp, Streptococcus pneumoniae
atgatcctactccaaaataaatcgttctgctacagtatctcccaaaaagagacctctctttgtcatgcgaacgtggtcaccctcaatctgcatgaggccttgttgaaccaaatctctgacaatttctccataaagtccagcaaaagactgtccaaatttttcctcaaatcgcgccatggaaaccccggatttcttgcggagtcccaagaacatttcttcttccatttgctccttttgactcaggtgatcttctgtaatacaagcattgccttcctcaaccgcactgagataatgacgaatgggaccatgatttttatagcgtactccattgacataaccagatgcccctgcaccaataccatagtattcagcattgtcccagtacatgagattatgacgactttcaaagccgggtttggagaaattagaaatctcataatgctcaaaacccgctcgctccagctctgcaatgatgtactcaaacatctccgcttctag

SEQ ID NO: 838 - DNA, 738 bp, Streptococcus pneumoniae
atgggcttaacttatcaaatgaaaatgaaaattccttttgatatggctgatatgaacggtcatatcaaacttccagatgtgattttgctgtcactgcaagtttcagggatgcagtcgattgaactgggagttagtgataaggccattttggaagaatataatctggtctggattatcgtagaatatgatattgaggtgtttcgtttgcctcgttttgcggaagaaattaccatcgaaacggaagccttgagctacaatcgacttttttgctaccgtcgctttactatttataatgaagcggagcaggagctcatccacatgatggcgacctttgttctcatggaccgcgacagtcgaaaagtccatgttgttgaacctgagattgtggctccttaccagtctgattttgataaaaaacttatccgtggaccgaagtatgagtccttggaagaaccgatcagcaaggattaccatgttcgtttttacgacttggatatgaatggtcatgtcaataacagtaaatacttggactggatttttgaggtcatgggagcggattttttgacccactatattcccaagaaaatcaacctcaagtatgtcaaggaagttcgaccaggtggggtgattacatcggctgttgaacggactggactggaaagcaagcatgaaattacaagtgatggggttatcaatgcccaagcaatcattacttggcaagaaataaaaaaggcttag

SEQ ID NO: 839 - DNA, 609 bp, Streptococcus pneumoniae
  unsure (31): n at each above location is unknown.
ttggctcagaattttaatatcgatacgcccntatcgactgtctacacagcgactttggcaaccatcgactatatgaatgatttggggcttgaaaagaccgtctatgtcgtcggagaagcaggactcaaggaagccatcaaggcggctggttatgtggaagacaaggaaaaacctgcctacgtggtagttggtctggattggcaagtcgactatgaaaaatttgccacagcaactcttgctattcaaaagggtgcccattttatcggaaccaatcctgacctcaacatcccgacggaacgcggtcttttgccaggtgctggctcactgattacgctgcttgaagtagcgacacgagtgaagccggtttatatcggaaaaccaaatgccatcattatggacaaggcggttgagcacttaggtttggaacgtgaagagttaatcatggttggggacaattatttgactgatattcgggctgggattgacaatggcattccaacgctcttggtgacgacaggttttactaaggcagaagaagtagctggcctgccaatcgcaccgacacatgtggtttctagcattgcggagtgggattttgatgaaaactaa

SEQ ID NO: 840 - DNA, 651 bp, Streptococcus pneumoniae
atgtggtttctagcattgcggagtgggattttgatgaaaactaaattgatcttttggggctctatgctctttctcctctccctctccatccttctgaccatttatctggcttggattttctatcctatggagattcagtggctaaacttaacgaatcgagtctatctaaaaccagaaaccattcaatacaattttcatatcttgatgaattatctgaccaatccttttagtcaggtcttacagatgcctgattttcgttcgtcagcagctggtctgcaccatttcgcagtggtcaagaatctctttcatttggttcagctagtagctctagtgacactgccaagtttctatgtctttgtcaataggattgtgaaaaaggactttttgtctctttatcgaaaaagtctcctggctctagtagttttacctgtaatgattggacttgggggagttttgattggttttgaccaattctttactcttttccatcaaattctctttgtgggagatgatacctggctttttgatccagccaaggatcctgttattatgattttgccagagaccttctttcttcatgccttcctcctcttttttgccctctatgaaaacttctttggctatctgtgtctgaaaagtcgtaggaagtga

SEQ ID NO: 841 - DNA, 324 bp, Streptococcus pneumoniae
ttgacacaattggatttggttaattcactcttaacgatggttttaaacgatatatatatatatatttatatatgtaaattaaaaacatctttcctttcacttcctacgacttttcagacacagatagccaaagaagttttcatagagggcaaaaaagaggaggaaggcatgaagaaagaaggtctctggcaaaatcataataacaggatccttggctggatcaaaaagccaggtatcatctcccacaaagagaatttgatggaaaagagtaaagaattggtcaaaaccaatcaaaactcccccaagtccaatcattacaggtaa

SEQ ID NO: 842 - DNA, 402 bp, Streptococcus pneumoniae
atgattacactatttctatcaccgagctgtacatcatgtcgtaaggctaaggcctggttagaaaaacataaggttccctttgtggaacacaatattatgaccagtcctttaacaagaaaagaattgcaacacatcctttccttgaccgaaaatggtactgatgacatcatttcaactcgttcaaaaatttttcaaaaattgaatattgatgtagagagtatttcggtatcggaattgcttcatttgattgagcagtatcctagtcttttgcgtcgtccaattattattgatgccaagcgtatgcaaatcggttttaatgaagatgagattcgtgcttttctccctcgtagttatcgtaagcaagaactaaaagaagcaagaatgagagctggtattagttaa

SEQ ID NO: 843 - DNA, 279 bp, Streptococcus pneumoniae
atgaacaaacagtatagttacccactagatttgtcgtggagcactgaagaacttgtttcagtgctttctttttttaatgatgttgaagctgcctatgaaggcaaagtagaggctaaaaagttactggactcctataagggattcaaagcggtcgtgccaagcaagagcgaagagaaacgtttgggacgagaatttgaaacggttagtggctattcactttaccgagcagttcaggctgccaaagaaaaaggggaaggaaagatttctcttggaaagtaa

SEQ ID NO: 844 - DNA, 849 bp, Streptococcus pneumoniae
ttgaaacggttagtggctattcactttaccgagcagttcaggctgccaaagaaaaaggggaaggaaagatttctcttggaaagtaaatttgaatttgctaaagagcttgttaagaaagcaggtcagtacattcttgaccatatgcaggaagacttgcgtgttgaaaccaagtcctctccaacagatttggtgaccagactggacaaagaagttcaggaactcttggttggtgagattttgtcccgttatcctgaggataagatttgtgctgaagaaggttgtctgcgagcctcggttcaagagggcaaggtttgggtcattgatcccattgatggtaccaataattttgtagcccagcaggaagattttgctgttatgatggcttattttgaaaatggtcagggacagtttggtctgatttatgatgtggtcaaaggggattgttaccacggtggtggggaatttccagtttgtctaaatgataggtccctagctccttttaaaactaaaccacttggagattttctcattgcagggaatagtggtatgctggaaaccaatgaatgggggctggctgatttgagccgatcggttcttggtgttcgtgtctatggaagtgcggccattagttttgccaagattttgtcagggcgtttgttgacctatctcacttatctgcaaccatgggattatgccgcagctagtattttaggggaaagtctgggctatcgggttgtgaccctttttggtgaagctcctgattttcaaaccagacagccggtcatgatggtgcctcttgagatgcaggaggaaattcagtcctatatttacgaaaggaaaagaacttaa

SEQ ID NO: 845 - DNA, 339 bp, Streptococcus pneumoniae
  unsure (118),(191),(201),(223): n at each above location is unknown.
atgcaatttccagaaggatttgttgaaaaatataaagagatactaggagatgaggcaagagattttcttgcctcttttgaggaagaagcggtttcggcctttcgggtcaatcccttanaagaagaacaactttccttttctgatgccattactcaaaccccttggggccactatgggaaagtttcaggganatcgcctgancatgctacaggtttagtttatncgcaagaaactgctgctcaaatggtggctcaagtagcccaacccagtcctggtatgaaggtcttggactggctgctgcaccggggggcaaatcaactcaactggcagcctatctag

SEQ ID NO: 846 - DNA, 915 bp, Streptococcus pneumoniae
ttggttgaaaacatggagcgttttggagcgacaaatgtcgtggtgaccaatgaatctgccgaccgcttggtcaaggtctttaaaggctattttgacttaatcgttcttgatgccccttgctctggtgaaggaatgtttcgtaagcaacctgatgctatggactattggagcttagattatccgagtcaatgtgctagcttgcaaagagaaattctctgggaggatgcagtgaccatgttagctgaaggtggtcatctggtttattcgacctgtacctgggcacccgaggaaaacgaagagattgtcaattggttgctggaagagtatgattttgacttgttgccagtagagcatatcaatggaatggtagctggtattgacctgccagaaacggctcggatgtatcctcatcagtttaagggagagggtcagtttgttgcccatctacagtttaagggtaacaatccagctcctaaatttaaggcaagtaagagtaacctcagccgtgaacaagttgccttgtggcaggaatttgcccaaaaccatttgaaggtcaatctaccgggtatcttgcagacttttggagaccagctttatctcttgccagaacttttgccagatttagggaagctcaagattgctcgcaatggactgcatctgggcacttttaagaagaaacgctttgagcccagtttcgctcttggtttagccttgaaaccgagtcaggtcgaacagtcggttgaaattggccaagaagcgtttgtcaagtatgcggctggagaaatcgttcagctggcagaaagtctgccaaatggttggtaccaagttttggttaaaggcaatggcttgggctttgcaaaggttactggaaatgttttgaaaaattattttccaaaaggcctcagattcaaatga

SEQ ID NO: 847 - DNA, 228 bp, Streptococcus pneumoniae
gctatattactctttcctaacctccttttttcatatgtggataaaatctcttgtctatcccttcccccattgtcacccattatagtcatttcgtgtctctttttcccctttttaatgcaagggaaattactctccttagatgataatccaaaagctagaaaggtatctcaaacctctctactctcccagactagtttacaactaaaaggaaaagattctattttatga

SEQ ID NO: 848 - DNA, 168 bp, Streptococcus pneumoniae
ttgcgcagaaatttggtaagaattcatgcgtcaactcataaagaactacttaaaaaattcacagtattcataattattttcgaggagaaaaacagtgaaaaaaagaaaaaagcttgctctgtctcttatcgctttttggctgacggcttgtttagtaggctgtgctag

SEQ ID NO: 849 - DNA, 234 bp, Streptococcus pneumoniae
ttgaccgtttttccaacatggatcgtgccaaattcatctgccgctacttcaaccaagggttgcaaggcagttgagccaacagccgttatggattctccacgatcaatccagctagcacagcctactaaacaagccgtcagccaaaaagcgataagagacagagcaagcttttttctttttttcactgtttttctcctcgaaaataattatgaatactgtgaattttttaagtag

SEQ ID NO: 850 - DNA, 879 bp, Streptococcus pneumoniae
gtgaaaaaaagaaaaaagcttgctctgtctcttatcgctttttggctgacggcttgtttagtaggctgtgctagctggattgatcgtggagaatccataacggctgttggctcaactgccttgcaacccttggttgaagtagcggcagatgaatttggcacgatccatgttggaaaaacggtcaatgtccaagggggaggttctggtacaggcttgtcccaggttcagtctggggcagttgatataggaaactcagatgtatttgctgaggaaaaagacggaattgatgcttctgctcttgttgaccacaaggtcgcggtacgtggcttggctctgattgtcaataaggaggttgatgttgataacctaacgacagagcaacttcgtcaaatcttcataggtgaggtaaccaattggaaagaggttggtggtaaggacttacccatctctgttatcaatcgggcagccggctctggttctcgtgctacctttgatactgtcattatggaaggtcagtctgccatgcaaagtcaggagcaggattcaaatggagcggtaaaatcaatcgtatcaaaaagtccaggagctatctcttatttatctcttacctatatagatgattcggtcaaaagcatgaagttgaatggctatgacttaagtccagaaaatataagtagcaataattggcccttgtggtcttatgagcatatgtatacattggggcagcccaatgagttggctgcagaatttctcaattttgttctctcggatgagacccaagaagggattgtcaaaggattgaagtatattccgattaaggaaatgaaggttgaaaaagatgctgccggaactgtgacagtgttggaagggagacaataa

SEQ ID NO: 851 - DNA, 918 bp, Streptococcus pneumoniae
atgaatcaagaagaattagctaagaaaatgttgcttccatcaaagaattctcgtctggagaaattaggaaaaggtttgacctttgcctgtctttctttgatagtcatccttgtggccatgattttggttttcgtagcgcaaaaaggcttgtcgaccttctttgtcaatggtgtgaatatctttgactttcttttgggaggaacttggaatccttctagtaaagaatttggtgcccttcctatgattttgggttcctttatcgttaccattctctcagcccttatcgcaacaccctttgctattggtgcagcagtttttatgaccgaagtatcaccaaaaggggcgaagattttgcaaccagctattgaactcctggttgggattccttcagtagtgtatggatttattggcttgcaagtcgtcgttccctttgttcgcagtgtctttggtgggactggttttgggattttgtcagggatttccgtcctctttgtcatgattttgccgaccgtaacctttatgacaacggatagcttgcgtgcggttcctcgttattatcgtgaagccagtttcgctatgggagccactcgctggcagactatctggcgtgtgatcttgaaggcggcccgttctggtattttcactgcagtggtctttgggatggcgcgtgcctttggtgaggctttagctatccagatggttgtcggaaactcagctgttatcccaacttccttgaccacaccagctgcaactttaacttctatattaactatgggaattgggaacactgtcatgggaactgtaaataataatgttctctggtcactggccttggtactgctcttgatgagtttagtttttaacagtgtgattaaattgattacgaaagaaagaggaaagaaaaattatgcgcgctaa

SEQ ID NO: 852 - DNA, 885 bp, Streptococcus pneumoniae
atgcgcgctaagaaattagataaacttgcaacagctgtcctctatacgattgctagcatcattgtgacaatcttggcttccttgattctctatatcttggttcggggcttgccccatatctcttggtctttcttgactggaaggtcttctgcttttcaagcaggtggtgggattggcattcagctttacaattcctttttcctattggtcattaccttgattatttctgtacctctttctatgggagctgggatttacttggctgaatatgctaaaaaaggtcctgttaccaactttgtgcggacttgtattgaaatcttgtcctctttaccatcagtggtggtgggtctctttggttacttgatctttgtagtccagtttgagtatggattttcaatcatttcaggtgccttggccttgacagtctttaacttgcctcagatgacgcgtaatgtagaggatagtttgaaacacgttcaccatacccaacgtgaggctggtctggctcttgggatttctcgctgggagacagtggttcatgttgttattccagaagcgcttccaggtattgtaacgggtgtcgtcttggcatctggtcgtatctttggcgaagctgcagctctgatctatacagcagggcaatcggcgccagctcttgactggtctaactggaatatcctcagtgtgactagccccatctctatcttccgtcaagcagaaaccttggctgtccatatctggaaagtcaatagtgaaggcactattccagatggaaccattgtatcagcaggttctgccgctgtgctcctgatctttatcctgatttttaactttggagctcgtaagttcggaagctatctacacaagaaattaaccgctgcctaa

SEQ ID NO: 853 - DNA, 804 bp, Streptococcus pneumoniae
atgtcaacatataactgggatgagaagcatatccttacctttcctgaagaaaaagtagccctttctactaaggatgtccatgtttactatggtaaaaatgaatccattaaggggattgatatgcaatttgaaagaaataaaattacagctttgattggtccgtcgggatcggggaaatctacctacttacgcagtctcaatcgcatgaatgataccattgatattgctaaagtaactgggcagattctctatcgtggaattgatgtcaaccgtccagaaatcaacgtttatgaaatgcgtaaacacattggaatggtttttcaacgccccaatccatttgctaagtcaatttaccgtaatattacctttgcgcatgaacgtgctggagttaaggataagcaagtcctagatgaaatcgtagaaacctcccttcgtcaggctgccctctgggatcaggttaaagacgatctccacaagtcagccttgaccttatcaggtggtcagcaacaacgtctctgtatcgctcgtgccatctctgttaagccagatatcctcttaatggatgagccagcctcagccttggatccgattgcgaccatgcaactagaagagaccatgtttgagctcaagaaaaactttaccatcatcattgtaacgcataatatgcagcaggctgctcgtgcaagtgactatacaggcttcttttacttgggtgatttgattgagtatgacaagactgcaactattttccaaaatgccaagctacagtccaccaatgactatgtatctggtcactttggttag

SEQ ID NO: 854 - DNA, 759 bp, Streptococcus pneumoniae
atgacagatgcgattttacaggtatcagacctgtccgtttattataataaaaagaaggctttgaatagtgtttccctatctttccaacctaaggaaattacagccttgattggtccatctggatcagggaagtcaaccctcctcaagtctctcaaccgcatgggagatctcaatccagaggtgaccacaactggatccgtggtgtacaatggccacaacatctacagtccgcgtacagatacggttgaattacgtaaggaaatcggaatggttttccaacaacctaatcctttccctatgactatctatgagaatgttgtctacgggcttcgtatcaatggaattaaggataagcaggttctggatgaagccgtagaaaaagccttgcaaggtgcctctatctgggatgaggtcaaggatcgtctatatgattcagctattggattgtcaggtggtcaacagcagcgtgtctgcgtggcccgtgtcttggcaactagtcctaaaatcatcctcttggatgagccaacttcggctttggatccgatttcagctggtaaaattgaggaaaccttgtatggtctaaaagacaagtacaccatgcttctggtaacccgttccatgcagcaagcttcacgtatctctgataagacaggatttttcctagatggagatttgattgaatttaatgataccaagcagatgttccttgatccccaacacaaggaaacggaagactatattacaggaaaatttggataa

SEQ ID NO: 855 - DNA, 654 bp, Streptococcus pneumoniae
atgttacgatctcaatttgaagaagatttagagaaattacataaccagttctacgctatgggacaagaagtgctctcacaaatcaatcgtacggtacgtgcttttgtcacgcatgaccgtgacctggcaaaagaggtcatcgaagatgatgcagaagtaaatgaatacgaagtgaaactggaaaagaaatcatttgaaatgatcgcactccaacaaccagtctctcaagatttgcgtacagtcttgactgtccttaaggctgtatcagatgtggagcgtatgggggatcacgctgtagccattgcccaggcaaccatccgtatgaagggggaagaacgcatcccagctgtagaggaagaaattaaaaaaatgggacgtgaagttaaaagcgttgttgaagcagcacttgatctttatcttaatggttctgttgacgacgcataccgggtggcctccatggatgagcaaattaaccactattttgaaactatccgtgaccttgcgactgaagagattaagaaaaatccagaagccattgttacgggtcgtgattatttccaagttatttcctacttggagcgtatcggtgactatgctaaaaatatctgtgaatgggttgtctactttgaaacaggtaagattgtcgaactataa

SEQ ID NO: 856 - DNA, 816 bp, Streptococcus pneumoniae
atgaaatcaaaaaaatggatatttgttttatgtaattttcttgcaagtttcttcttagtagcttgccagtcaggttctaatggttctcagtcagctgttgaggccattaagcaaaaggggaaattagttgtggcaaccagtcctgactatgcaccctttgaatttcaatcattggttgatggaaagaaccaggtagtcggtgcagacatcgacatggctcaggctatcgctgatgaacttggggttaagttggaaatctcaagcatgagttttgacaatgttttgaccagtcttcaaactggtaaggctgacctagcagttgcaggaattagtgctactgacgagagaaaagaagtctttgatttttcaatcccatactatgaaaacaagattagtttcttggttcgtaaggctgatgtggaaaaatacaaggatttaactagcctagaaagtgctaatattgcagcccaaaaagggactgttccagaatcaatggtcaaggaacaattgccaaaagctcaattaacttccctaactaatatgggtgaagcagtcaatgaattgcaggctggaaaagtagatgctgttcatatggatgagcctgttgcacttagttatgctgctaaaaacgctggcttagctgtcgcaactgtcagcttgaagatgaaggacggcgacgccaatgccgttgctcttagaaaaaatagtgatgatttgaaagaagtggtagacaaggtcatccaaaaacttaaggatgaaggaatttaccaaagctatcttgaaaaagcagcaagtctaactgaagttgaagaataa

SEQ ID NO: 857 - DNA, 1272 bp, Streptococcus pneumoniae
atgaagaaacaaagcaagtacaaagaggtcgtttcctatctgaaaaatggtatcgagtctggacgatttccgacgggtagtcgcctgccttctatccgtcaactgagccttgactttcactgcagcaaggacaccattcaacgagccctgctggaattacggcacgaacaatacctctatgccaagcctcagagtggctactatgtattagaacaagggcaacatcaagacctagaaatcgaggttaccgacgaacatgccagtgcctatgacgatttccgactctgtgtcaatgaaaccttgattggccgagaaaactacctcttcaactactatgacaatcaagaaggattagaagacctaagacagtccattcacaaactcctctttgagcaagctctctactgcaaggctaaccaactagtactgacttctggaacccaacaagccttatttatcctctctcaaatatcctttcctagacaagccaaggaaatcttggtggaacagccaacctaccatcggatgaatcgcctcttgattgcacaggggctggactatcaaacgattgaacgaggcattgatgggattgacttggaggagctggaaggccacttcaaaacaggaaaaattaaatttttctacaccattccccgatttcactatcctctgggacattcctattctgagcaagacaaacgatctattcttaacttagctgccaagtatgatgtctatatcgtagaggacgattatctgggtgatttggactccaagaagggccaaaccttccactatcttgatacagaggagcatgtcatttatatcaagtccttctcgaccagcctttttcctgcccttcgtattacagcactcattcttccaaatgctatcaaagaagcatttgtggcctacaaaaatatcctagactacgacagcaacctcattatgcaaaaggccctgtcactctatattgacagtcaattgtttgaaaaaaatcgtttggctcgcttgaccaatcatgaatcttaccaaaaacaaatcgaggaaaggataactaaaacaccttgtccccttcctcattatcccctacacgatggtttattgctagacctgagacagtatcctaaaatcgccagtctcaaacacagtcaactgggcttggacttctttgaagaggcctatttaagcacctgtccttatcaatttgccaaggtgtccctagacaatctggaaaatgttttaaactatttaaaagcagaattggaatga

SEQ ID NO: 858 - DNA, 171 bp, Streptococcus pneumoniae
ttgcccctagatgtgaacgagagaaacgttctagacattgccaagaaggaaaaaaaagggtacaatgtaacaaaatcaagggaggtctggaatgaagaaacaaagcaagtacaaagaggtcgtttcctatctgaaaaatggtatcgagtctggacgatttccgacgggtag

SEQ ID NO: 859 - DNA, 513 bp, Streptococcus pneumoniae
atggataagaacgtgcaggaaccagtgaaattatttcaatacaatactcttggagccttgatggctggcctttatggtggtactatgacagtaggagaattgctagaacatggtgaccttggtttgggaaccttggattccattgatggggaattgattgtcttggatggcaaggcttatcaggccaaagggtcaggagaccagccagaaattgtggaagtgtcaccagatgcccttattccttacgctgcagtggtaccgcatcaggcagaggtcattttccgccagcgctttgagatgacagacaaggaattgaaagaacgaattgagtcttattatgatggggaaaatcttttccgctctatcaagattcggggggaatttttacatatgcatgtgcgtatgattcctaagtcaacacccgataccaagtttgctgatgtcgcaacccatcaaccggaatatagtcgtgacaatgttgcggggactattgttggtttcctggacgcctga

SEQ ID NO: 860 - DNA, 201 bp, Streptococcus pneumoniae
gtggcaggctaccatctgcacttcatatcaaatgattttaccttcgggggacatgtcatgattttgttcatcaaggaaggcattatcgagttgggagcagttgaccagtgggaccaacgttttccagtccaagaccgtcaatacttgtttgttaagttcaatgttgccgagatgaaaaaagatattgaaaaggcagaatag

SEQ ID NO: 861 - DNA, 729 bp, Streptococcus pneumoniae
atgttgctgttgctagcttttctgataggaagcatttggtttgccaaaaagaaataccagattaatctagctgtcttgggcttgggtgcagtcgctttctttgtctcttcgcagattttggaaaaactggtgcatatcttgattttgcatcctcaaaaagacggtagtattgccctcttgcaagatcatccgcttatctatattatctatggcctagccatggcagcattttttgaggaaacggctcgtcttgttttcttcaaatggttggagaaaaagagaagtttggaaaaggcagatgccttggcctatggcctagggcatggtggcttggagttgatttttctaggccttactagtttactcaatctttacatcgttctttcgacagttcaaactcagaatccacaggttatgcaattactgtctgaaaatatgttaaaaaccattcagtcactttcggtctggcagatttatttgcttggttttgagcgaatcttggcgcttggtttccaattacttttgacagtttgggtttaccaagctgttcgccagaagaaatggatttatctcctagctgcctatggcttgcatgccttctttgatctggcaccatctctttcccaagtaggctggttgacaaatccagtcttggttgaagtgattctagcactggagctcgttctggtcgcctatggaaccaaggaaatcttttgtaaaaaatcataa

SEQ ID NO: 862 - DNA, 906 bp, Streptococcus pneumoniae
atgtctgtaagagaaaaaatgcttgaaatcttagaaggaattgatatccgttttaaggaacccttgcatagctatagttatacaaaagtaggtggagaggctgattatttggtctttccacgaaatcgttttgagttggcgcgccttgtgaaatttgccaaccaagaaaatatcccttggatggttcttggcaatgcaagcaatatcatcgttcgtgatggtgggattcgtggatttgtcatcttgtgtgacaagctcaataacgtttctgttgatggctataccattgaagcagaagctggggctaacttgattgaaacaactcgcattgccctccgtcatagtttaactggctttgagtttgcttgtggtattccaggaagcgttggcggtgctgtctttatgaatgcgggtgcctatggtggcgagattgctcacatcttgcagtcttgtaaggtcttgaccaaggatggagaaatcgaaaccctgtctgctaaagacttggcttttggttaccgccattcagctattcaggagtctggtgcagttgtcttgtcagttaaatttgccctagctccaggaacccatcaggttatcaagcaggaaatggaccgcttgacgcacctacgtgaactcaagcaacctttggaatacccatcttgtggttcggtctttaagcgtccagtcgggcattttgcaggtcagttaatttcagaagctggcttgaaaggctatcgtatcggtggcgtagaagtgtcagaaaagcatgcaggatttatgatcaatgtcgcagatggaacggccaaagactacgaggacttgatccaatcggttatcgaaaaagtcaaggaacactcaggtattacgcttgaaagagaagtccggatcttgggtgaaagcaagtag

SEQ ID NO: 863 - DNA, 1137 bp, Streptococcus pneumoniae
ttgaaaaaaccaattatcgaattcaaaaacgtctctaaagtttttgaagacagcaacaccaaggttctcaaagacatcaactttgagttggaagaagggaaattctacacccttctaggtgcatctggttcggggaaatcaactatcctaaacattattgcaggtttactggatgcgacgacaggagatatcatgctagacggtgttcgtatcaatgatattccaaccaacaagcgcgacgtacataccgtcttccaatcctatgccttgttcccacatatgaatgtgtttgaaaatgttgcctttccacttcgcttgcgtaaaattgataagaaagaaatcgagcagcgtgtagcggaagttctcaagatggttcagttggaaggttatgaaaaacgttccatccgcaaactttctggaggacaacgtcagcgtgtggccatcgcccgtgctatcatcaaccaaccccgtgtggtcttgttggacgagcctttatcagcgctggacttgaaattgagaacagacatgcagtacgaattgcgtgaattacaacaacgattgggcattacctttgtctttgtcactcacgatcaggaagaagctcttgccatgagtgactggattttcgttatgaatgatggcgagattgtccagtctggaacccctgtggacatctacgatgagccaatcaaccactttgttgccacctttatcggggagtcaaacatcttgccaggtagcatgattgaggactacttggtcgaatttaacggcaaacgctttgaagcggttgatggtgggatgaagccaaatgaacctgttgaggtcgttattcgtccagaggacttgcgcattacccttcctgaagaaggcaagctccaagttaaggtcgatacccagctcttccgtggggtgcattatgaaattatcgcctatgacgaacttggaaatgaatggatgatccactcaacccgtaaggccatcgtgggtgaggaaatcggtctggactttgaaccagaagacatccacatcatgcgtctcaatgaaaccgaagaagagttcgatgctcgtattgaggagtacgtagaaatcgaagagcaagaagcaggtttgatcaatgcacactcgaggagttaa

SEQ ID NO: 864 - DNA, 327 bp, Streptococcus pneumoniae
atgaagaaaacaagctctaaactctttgtagtgccctacatgctttggattgccctctttgtattggcacccttggtcttgattttcggacaatcctttttcaacattgaaggccagtttagtttagaaaattataaatcttactttgcgtcacaacacttgacctacctcataaatgagtttcaactcagtgctttatgcagggattgtgacctttgtgacctgtcttatcagctatccaacagccctctttttgacccgtctcaagcaccgtcaactctggctcatgctgattatccttcctacctggatcaatttgctccttaa

SEQ ID NO: 865 - DNA, 633 bp, Streptococcus pneumoniae
atgagtttcaactcagtgctttatgcagggattgtgacctttgtgacctgtcttatcagctatccaacagccctctttttgacccgtctcaagcaccgtcaactctggctcatgctgattatccttcctacctggatcaatttgctccttaaagcctatgcttttatcgggatttttggtcaaaatggctctattaaccaattcttggaatttatcggaattggttcacaacagttgctttttaccgatttttcctttatctttgtcgcaagctacatcgagctcccctttatgattttgccgattttcaatgtcttagacgacatggataataatctcatcaatgctagttatgaccttggtgcaactaagtgggagaccttccgtcatgtcatcttccctctatctatgaacggtgtgcgaagtggggttcagtcggtctttatcccaagtttgagtctcttcatgctgacccgtttgattggtgggaaccgcgttatcaccttggggacggctattgagcagaattttctaaccaatgacaactatggtatgggttcaactatcggtgtgattctcatcctgaccatgttcatcaccatgtgggtgactaaggaaaggagagaacgatga

SEQ ID NO: 866 - DNA, 774 bp, Streptococcus pneumoniae
atgaaaaaatttgccaacctttatctgggactggtctttctggtcctctacctgcctatcttttacttgattggctatgcctttaatgctggtgatgatatgaatagctttacaggttttagctggactcactttgaaaccatgtttggagatgggagactcatgctgattttggctcagacatttttcttggccttcctatcagccttgatagcgaccattatcgggacttttggtgccatttacatctaccagtctcgtaagaaataccaagaagcctttctatcactcaataatatcctcatggttgcgcctgacgttatgattggtgctagcttcttgattctctttacccaactcaagttttcacttggctttttgaccgttctatctagtcacgtggccttctccattcctatcgtggtcttgatggtcttgcctcgactcaaggaaatgaatggcgacatgattcatgcggcctatgacttgggagctagtcaatttcagatgttcaaggaaatcatgcttccttacctgactccgtctatcattactggttatttcatggccttcacctattcgttagatgactttgccgtgaccttctttgtaacaggaaatggcttttcaaccctatcagtcgagatttactctcgtgctcgcaaggggatttccttagaaatcaatgccctgtctgctctagtctttctctttagtattatcctagttgtaggttattactttatctctcgtgagaaggaggagcaagcatga

SEQ ID NO: 867 - DNA, 678 bp, Streptococcus pneumoniae
atgaaaaaaatctattcatttttagcaggaattgcagcgattatccttgtcttgtggggaattgcgactcatttagatagtaaaatcaatagtcgagatagtcaaaaattggttatctataactggggagactatatcgatcctgaactcttgactcagtttacagaagaaacaggaattcaagttcagtacgagacttttgactccaacgaagccatgtacactaagataaagcagggtggaacgacctacgatattgccattccaagtgaatacatgattaacaagatgaaggacgaagacctcttggttccgcttgattattcaaaaattgaaggaatcgaaaatatcggaccagagtttctcaaccagtcctttgacccaggtaataaattctccatcccttacttctggggaaccttaggaattgtctacaacgaaaccatggtagatgaagcgcctgagcattgggatgacctttggaagccggagtataagaattctatcatgctctttgatggggcgcgtgaggtgctgggactaggactcaattccctcggctacagctcaacctccaaggatctgcagcagttggaagagacagtggataagctctacacactgactccaaatatcaaggctatcgttgcggacgagatgaagggctatatgatttag

SEQ ID NO: 868 - DNA, 375 bp, Streptococcus pneumoniae
gtgaccttctctggtgaagccagccaaatgttagaaaaaaatgaaaatctacgttatgtggtaccgacagaggccagcaatctttggtgtgacaatatggtcattcccaaaacagttaaaaaccaaaactcagcctatgcctttatcaactttatgttgaaacctgaaaatgctctccaaaatgcggagtatgtcggctactcaacaccaaacctaccagcgaaggaattgctcccagaggaaacaaaggaagataaggccttctatcccgatgttgaaaccatgaaacacctagaagtttatgagaaatttgaccataaatggacagggaaatatagcgacctcttcctacagtttaaaatgtatcggaagtag

SEQ ID NO: 869 - DNA, 240 bp, Streptococcus pneumoniae
atgaaaatgtctacttttttcaaaaaaagtttctggccaacctttatgattgttaaccaaactgttatactattccatctaaaggatggcttggatcgacaatacctaacaactgagtccatatattgggtgataggcacctttatatttggaaatattctagtagctgtgtttagtaatatgaaaatttgggataaaaagaaaaacggcagtaagaaaaaatatatcctgaaaaagtaa

SEQ ID NO: 870 - DNA, 219 bp, Streptococcus pneumoniae
cttcctagcttagatggctcgcagcaccgccatttctctggactaagacaagtgaaaattaattctcaactttcttattataacgtttttttaagcttgcgtcaactggaaatgatctccgttgaattagaccaattccctacatctctgattactttttcaggatatattttttcttactgccgtttttctttttatcccaaattttcatattactaa

SEQ ID NO: 871 - DNA, 489 bp, Streptococcus pneumoniae
ttgatgaaaatatttcttgtcaaacaaaagtttcgtcttggaggcgaacgcttcgctatcaaggatgacaggggagaaattgcctatcaggtggagggatcattttttaagattcccaaaacttttaccatctatgatgcggctggtgaacaagtcagtcagatcagtaaagaaatcttgaccttgcttcctcgttttgagattcagcttcgggatggctcgagttttgtcattcgtaagaagttgaccttttggcgagataagtatgagtttgataatctaggtcttcgtatcgagggcaatatctgggatttgaatttcaaattgctggatgatcgcgatcagttgattgcggaaattaagaaggaactcttccatctgacctctacctataccgtaacggttcttgaagacgcttatgcagacctagtcatttccctctgtgtcgcgattgactatgtggaaatgctggaaagccaatcacattaa

SEQ ID NO: 872 - DNA, 267 bp, Streptococcus pneumoniae
atgaaacaactatctagtgcacaagtacgccaaatgtggcttgatttctgggcgaccaaaggtcactcagtaaaaccatcagtaagtttggttcctgtaaatgacccaactcttttgtggatcaactctggggtagcaacccttaagaaatactttgacgggaccattatccctgaaaatccacgtattaccaatgcccaaaaggctatccgtactaacgacatcgaaaacgtagggcaagactgcgcgtcaccataccatgtttga

SEQ ID NO: 873 - DNA, 2361 bp, Streptococcus pneumoniae
atgtttgaaatgttggggaacttctctatcggggattacttccgtgacgaagctatcacttgggcttatgagcttttgacaagccctgaatggtttgatttccctgctgaaaaactttacatgacctactatccagacgataaagattcttacaaccgctggattgaagtgggagtggatccaagtcacttgattccaattgaggacaacttctgggaaatcggtgcgggaccttctggaccagatacagaaatcttctttgaccgtggggaagcctttgacccagaaaatatcggtcttcgcctgcttgcagaagatattgaaaacgaccgttatattgaaatctggaacatcgttttgtcacaatttaacgcagaccctgctgttcctcgtagcgaatacaaggaattgccacataagaacattgatacgggcgctggtttggagcgtttggtggccgttatccaaggggctaagaccaactttgaaacggacctcttcatgccgattatccgtgaagtcgagaaattgtctggtaaggtttatgaccaagatggcgacaacatgagcttcaaggttatcgcagaccacattcgttctctttcatttgctatcggtgatggtgcccttccaggaaatgaaggtcgtggttatgttcttcgtcgtcttctccgtcgtgcttctatgcatggtcaaaaattgggtatcaacgagcctttcctttacaaactcgttccaactgttggaaaaatcatggaaagctactacccagaagtgcttgagaaacgtgactttattgagaaaatcgttaagagcgaagaagaatcatttgcccgtacccttcactcaggtcaacactttgcccaaggaattgtggcagacttgaaagaaaaaggtcaatctgtcattgctggtcaagatgtctttaaactctatgatacatacggattcccagttgaattgactgaagaaattgctgaagaagctggtatgactgtagaccgtgaaggttttgaagcagccatgaaagaacagcaagaacgcgcgcgtgcgtcagctgtcaagggtggctcaatgggtatgcaaaatgaaactcttcaaaacatcactgtagaaagtgtcttcaactacaatgctagccaattgtcttctaaattggtagctatcgttgctgacaatgcagaagtaggagctgtttcagaaggaactgcctctcttatctttgcggaaacgtcattttatgctgaaatgggtggacaggtagctgactacggacaaatcttggatgagtcaggtaaggttgtggctactgtgaccaatgttcagaaagccccaaatggtcaagcccttcatacagttgaagtccttgcaccgcttgccttgaaccaagaatataccttggcaattgatagcaatcgccgtcaccgtgtcatgaaaaaccacactgcgactcatttgcttcacgctgcccttcacaatatccttggaaaccacgcaacacaggcaggatctcttaacgaagttgaattccttcgctttgactttacccacttccaagcagtaactgctgaggaacttcgtgcgattgaacagcaagttaacgagaaaatttgggaagcacttgaagtgaagacagttgaaacggatattgacactgctaaagaaatgggagcgatggccctctttggtgagaaatacggcaaggaagttcgtgtcgtgactatcggtgactactctattgaactttgtggtggtactcatgttggcaacacttctgagattggtctcttcaaaattgtcaaagaagaaggaatcggttcaggaactcgccgtatcttggcagtgactggtaaggaagcctttgaagcctatcgtgaacaagaggatgctcttaaagctgtcgcagcaaccttgaaagcacctcaagtcaaggaagtacctcacaaggtagaaggacttcaagaacaacttcgtcaacttcaaaaagaaaatgctgagttgaaagaaaaagccgcagctgcagccgcaggtgatatcttcaaagatgttaaggaagtcaacggtcatcgttacattgctagtcaagtgtctgtatccgatgccggtgcccttcgtacttttgcagataactggaaacaaaaagactactctgatcttcttgtcctagttgccgctatcggtgacaaagtcaatgtccttgtagcaagcaagacaaaagaccttcatgcaggaaaccttgtcaaagaattagcaccaatcatcgatggacgtggtggtggtaaaccagacatggccatggcaggaggaagcaaccaagctaagatccaagaattgttggatgcagtagcaggtaaattgtaa

SEQ ID NO: 874 - DNA, 1455 bp, Streptococcus pneumoniae
atgcaaaatcaaacactcatgcaatactttgaatggtatctgccccacgacggtcaacactggacgcgtctggctgaaaatgctccacacctagctcatctggggatcagtcacgtctggatgccaccagccttcaaggcaaccaacgaaaaagatgtcggctatggggtctatgacttatttgacttaggagagttcaaccaaaaagggactgtccgcaccaagtatggtttcaaagaagactatcttcaagccattcaagcccttaaagcgcagggaattcaacctatggccgatgtagttctcaaccacaaggctgctgctgatcacagggaagcctttcaggttattgaagtggatcctgtagaccgtacagttgaacttggagaacccttcaccatcaatggctggactagttttaccttcgatggtcgccaagatacctacaatgacttccactggcactggtaccacttcacaggtacagactatgatgccaaacgccgtaaatccgggatttacctaatccaaggagacaacaagggctgggctaacgaggaattggtcgataacgaaaacggaaactacgactacctcatgtatgccgacctagactttaaacatcctgaagtcatccaaaacatctatgactgggctgattggttcatggaaacgactggtgtagctggtttccgtttggatgccgttaagcatattgactctttctttatgcgcaacttcatccgcgatatgaaggaaaaatacggtgacgatttctatgtttttggtgaattttggaacccagacaaggaagccaatctggactatctcgaaaaaacggaagaacactttgaccttgtcgatgttcgtctccaccagaatctctttgaagccagtcaagctggcgcaaactatgaccttcgtggcattttcacagatagcctggttgaactcaagcctgacaaggctgtgacttttgtcgacaaccacgatacccaacgaggacaagcccttgagtctaccgttgaagaatggttcaagccagcagcctatgccctcattttgttacgccaagacggccttccatgtgtcttttacggagactactatgggatttcaggccagtatgctcaagaagatttcaaagaaatccttgaccgcctcctagccatccgaaaagacttggcctatggagaacaaaatgactactttgaccatgctaactgtatcggttgggtacgttcaggtgctgaaaatcaatccccaatcgcagtccttatctcaaatgaccaagaaaacagcaagtcaatgtttgtcggtcaagaatggactaatcaaacctttgtagatttacttggtaaccaccaaggtcaagttacaattgatgaggaaggttatggacaattccctgtctcagctagatccgtaagtgtctgggcagtcaataccatctaa

SEQ ID NO: 875 - DNA, 192 bp, Streptococcus pneumoniae
atgaccaatcaagcccataatctctccattttcaatctgcaaattgagattactcaaggcctctttatcaccatacaacttactaacattttgaaattcaatcatgggacaactcctatctttatctgtattatatatcgctatactagcactttgatacaaaaaaatcaatactttattttaagtagttaa

SEQ ID NO: 876 - DNA, 750 bp, Streptococcus pneumoniae
  unsure (644): n at each above location is unknown.
atgattgaatttcaaaatgttagtaagttgtatggtgataaagaggccttgagtaatctcaatttgcagattgaaaatggagagattatgggcttgattggtcataatggggctggaaaatcgaccactataaaatccctagtcagtatcatttcacccagcagtggtcgtattttggtagacggtcaggagttatcggaaaatcgcttggctattaaacgaaagattggctacgtagcagactcgcctgacttatttttacgcttaacggccaatgaattttgggaattgatcgcctcatcctatgatctgagtagatctgacttggaggctagtctagctaggctattgaacgtttttgattttgctgaaaatcgctatcaggttattgaaactctttctcacggaatgcgtcagaaagtctttgtcatcggagcactcttgtctgatcccgatatttgggtcttggatgaacccttgactggtttggatccccaggctgcctttgatttgaaacagatgatgaatgaacatgcactaaaagggaagacagtcttgttttcaactcatgtcctagaggtggcagagcaagtctgtgatcggattgccattttgacaaagggggatttcatttattgtggtantgtaaaggacttgagaaaagattacccagaccagtctttggaaagtatctaccttagtcttgctggtagaaaagaggaggttgcggatgcgtctcaaggtcattaa

SEQ ID NO: 877 - DNA, 1635 bp, Streptococcus pneumoniae
atgcgtctcaaggtcattaataaattagttgatatcaatatcctttattcatctcaagaagctaatctggctaatctacgaaagaagcaggctaagaatcctgggaaaaaagtaaatgtttccgctagagtcctaagttcttacattttttccagtctcttgatgctcatctgttttagtaatatagcctttcgttttccttttgaggaaatgccaagtttttttagtacgatggttgctattttactggtgctggccttttcaacttctttcactgcattttacaatgtcttttatgagagtaaggacctggcctcctataggccctatgcctttaaagaatcagagattataatggccaaaggtctgtctgtcctcttgccagctctaactggaattgtaccaatcctagcttattttctggtcctctacattaggctagcaccttctctgtggttgggtttgcctttgatgctactgtccttgaccttattatttgtctctgttactttagtgacggtagtggcagtacatttcttggctcagactagggtcttcagaaagtatcagtctattttttcgaatgtgatgattgggataggagttctcatacctttaatatttatcttctttcttcagtcgacttttggaagtattgttgacaaagttagagacattccatttctcctttatcctcttcatatcttttacaaaatagcagtggagcctttttcgacagaagccttagtgggtctgctcgcttggataggactaactctcttcctgctttatctgaccaaaaagaaggtccttcctcgtttttatgacgtgatcctgcttaacagtgaggagaaggtcaaaaaagaacgtcgcagcaaggagaggatttcaactactaaaaagggctttttccgtatggttttacgctaccacctcaccctcttgggacaggggactggcgtgattacagtgctttttacaagtgctttccttccttatctcatgatgatcagtctgatttccaaaatccgagattctcagatagttccagacattcatcctccatactggttacccttgttttttgtaggagtgtttatagcagttgtcaataacaatatcaccagcctgcattcaattgccttgtccttggagagggaaaatgttgattttcttaagagtttaccctttgactttgctcgttatgtgaaagtgaaattttggattatctttgctgttcagtcctttttaccagttctgactttgcttggtctttctctatatctaggcttgcccatcatttcgatgatttaccttcttgtagtctggatcattgccagtgtcatcctttcttgccaccattactttaaggacgttaaaaatctgtcaacaaattggagtagcattacggacctggtgaatcgttcaaatggcatagtcgccatagttttattgtttatttatagtgcaatcctgatggcccttgtaattgggagcatattcttggttcagtctctctccactatccttgccatcagcttgggagtaggagctcttatcctcctgcttgctcttgctatttttggctatcattattacctgtcacgcatattggcagaaatagaaaaaagatga

SEQ ID NO: 878 - DNA, 1164 bp, Streptococcus pneumoniae
atgaatagaataagagtcagcaaaagggttgaaaagaagcttgctaaagggctagttttactagaagccagtgatcttgagaatgtcaatcttaaggatcaggaagtagaggtgcagggtcaggaaggaaactttcttgggactgcctacctttctcagcaaaacaagggcttgggctggtttgtcagcaaagacaaggtggccttcaatcaagctttctttgaaacgttgtttagaaaagccaaagaaaagagaaacgcctactatcaagatgatttgacaactgcctttcgtctctttaatcaagagggagatggctttgggggtctgacagtggatctttatggcgactacgccgtcttttcttggtataactcttatgtttatcagattcgtcagactatatcagaagcctttagacaggttttccctgaggttttaggggcttatgagaaaatccgctttaagggtttggactatgaatctgcccatgtttatggtcaagaagcacctgactttttcactgttttagaaaatggtgtcctgtatcaagtctttatgaatgatggcttgatgacaggaattttcctagaccagcatgaggttcgcggtagtttagttgacggcttggctatgggtaaatccttgctcaatatgttttcctacacagcggctttttcagtagctgcggccatgggaggagctagccagacaacttctgttgatctagccaaacgttcacgagaattgtctcaagcgcattttcaggcaaatgggctcagcacagacgagcatcattttatagtcatggatgtctttgagtatttcaaatatgccaaacgcaaagacttgacctacgatgtgattgtcctagatccgcctagctttgctcggaataaaaaacaaactttctctgtggccaaggattatcacaagttgatttcccagagtcttgagattttaaatccgggagggattatcattgccagtactaatgctgccaatgtttcccgtcagaaatttacagaacaaattgataaaggctttgcaggaagaagttaccagattttaaacaaatatggtcttccagcagattttgcctataataaaaaagatgaaagtagtaattacctcaaggtgattagtatgaaggttagtaaatga

SEQ ID NO: 879 - DNA, 678 bp, Streptococcus pneumoniae
atgaaattaatcgtttcagtaatgccaagaagtttagaggaggctcaggctctggatgccacgaggtacctggatgccgacatcattgaatggcgtgccgactatctgcctaaagaagcgattttgcaggtagctccagccatttttgaaaaattcgcaggccgtgagttggttttcacgctacgaactcgctccgaaggtggagaaatcgacctttctccagaagagtatatccatctaatcaaggaagttgcgcaattctatcaaccagactatattgattttgagtactatagctacaaggatgtttttgaggaaatgctggacttcccaaatcttgttttgagttaccataatttccaagaaacacctgagaacatgatggaaatcttgtcagagttgacgatcctaaatccaaaacttgttaaggttgcggtgatggctcacacggagcaggatgtcttagacttgatgaactatacacgaggctttaaaaccctcaatcctgaacaggaatatgtgaccatttctatgggtaaggtgggcaaggtctctcgtatcactgcggatgtgactggttcgagttggtcttttgccagtctggatgaggttagtgcccctgggcagatttctctagctagcatgaaaaaaatcagggagattttggatgaagcttga

SEQ ID NO: 880 - DNA, 855 bp, Streptococcus pneumoniae
atgaagcttgatggctatacacgtttagctgcagttgttgccaatcctattaagcattctatttctcccttcatccacaatagagcctttgaggcgacagctaccaacggtgcttatgtggcttgggagattgaagcgagtgacttggtagaaacagtggccaatattcgtcgctaccagatgtttggcatcaatctgtccatgccctataaggagcaggtgattccttatttggataagctgagcgatgaagcgcgcttgattggtgcggttaatacggttgtcaatgagaatggcaatttaattggatataatacagatggcaagggattttttaagtgcttgccttcttttacaatttcaggtaaaaagatgaccctgctgggtgcaggtggtgcggctaaatcaatcttggcacaggctattttggatggcgtcagtcagatttcggtctttgttcgttccgtttctatggaaaaaacaagaccttacctagacaagttacaggagcagacaggctttaaagtggatttgtgtgctttagaatatgtttctgaactgcaagcaaggattgccgagtcggatttgctagttaatgccaccagtgtgggcatggatggccaatcctctcctgttcctgaaaacatagtcttaccagaaactcttttagttgcagatatcatataccaaccctttgaaacaccgtttttgaaatgggctagaagtcagggcaatccagcagtcaatggtctgggaatgttactctatcaagctgcagaagcttttcaactgtggacaggcaaggaaatgccgacagaagagatttggcagtctttaacagaaaaataccaataa

SEQ ID NO: 881 - DNA, 1068 bp, Streptococcus pneumoniae
atgaaaatcagaatcgatattcctcatcatccttatgatattcagattgaaaaaggttgtatggcccaggctggtcagtggttgcgagaactctggcaaccgcaaaaggtagtcattgtgacagataaccatgtagcctctctctatgcagagaaggtcaagctcagcctagaagatgctggttttcaggtagctgtttttgatttcttagaaggtgaagaaagaaagaatttaactactgttcagaaagtctatgaatttctagtcaagcaaggtctgactcgtagcgatggaatcgttgctcttggtggtggcgttgttggggacctggctggctttgtagcctctacctatatgcggggtattcactttgttcagattccgactagtttgacagctcaggttgattcttctatcggtggaaagacaggcgttaacacaccatttgctaaaaatatggtggggacctttgcccaaccagatggggttctgattgatccacttgttcttgaaaccctcggaaaaagagagttgattgaagggatgggtgaagttatcaagtatggcttgattgaggatccagaactgtgggctctcttgacgggactgaatggttctgttgagagtattttggaacatgcagagaccttgattgaacattcttgtcaggtgaagcgcaagatggtggttgaagatgagttggacaatggtattcgtctttacctcaattttggccacactattggccatgccatcgaagcgactgccggttatggcaaggtcatgcatggagaggctgttgccatgggaatggtacagatttccaaggttgctgaggaaaaaggcctcatgccagctggcattacccaatctatcacagagatgtgtcagaaattcggcttgcctgttgactatgaaaattgggaagttgacaagctttatcaggctcttactcatgacaagaaaacgcgtggtaacaccttgaaattggtcttggtgtcagagcttggttcagcgatcattcacccagtttctctggaagagatgaaagactacttggtaaaataa

SEQ ID NO: 882 - DNA, 1167 bp, Streptococcus pneumoniae
atgagatatttaactgcaggagaatcacacggcccccgtctaacagctattattgagggaattccagctggacttccattgacagctgaggatatcaatgaggaccttagacgccgtcagggtggctacggtcgtggtggtcgtatgaagattgagagtgaccaggttgtctttacttcgggcgttcgccacgggaagacgacaggggcgcctattactatggatgtcatcaataaggaccaccagaaatggctggacatcatgtctgcggaggacattgaagaccgccttaaaagcaagcggaaaattactcatcctcgcccaggtcatgccgatttggttggggggattaagtaccgttttgatgatttgcgaaattctttggagcgttcatcagctcgtgaaaccaccatgcgggtggcagttggtgcagtagccaaacgcctcttggctgagctggatatggagattgccaaccatgtcgtggtctttggtggtaaggaaatagatgttcctgaaaatctgacagtcgctgaaattaagcaaagagctgcccagtctgaagtttctattgtcaaccaagaacgagaacaggaaatcaaggactatattgaccaaatcaaacgtgatggtgataccatcggtggggttgtggagacagtcgtcggaggcgttccagttggtcttggttcctatgtccaatgggatagaaaattggatgcaagattggctcaagctgttgtctctatcaatgcctttaaaggggtggaatttggtcttggctttgaggctggttatcgtaaaggcagccaagttatggatgaaattctctggtctaaagaagacggttatactcgccgtaccaataatctaggtggttttgaaggtggtatgactaatgggcaacccatcgttgttcgtggggtcatgaaacccattcctactctttataaacctcttatgagtgtggatatcgaaacccacgaaccttacaaggcaaccgtggagagaagtgatccgactgctcttccagctgcaggaatggtcatggaagcagttgtagcaacggttctggcgcaagaaatcctcgaaaaattctcatcagataatcttgaggaactaaaagaagcggtagccaaacaccgagactatacaaagaactattaa

SEQ ID NO: 883 - DNA, 1104 bp, Streptococcus pneumoniae
atggcaaaaacaatctatatcgcaggtcttgggttgattggagcctctatggcacttggtatcaaacgcgatcatccagattatgaaattttaggttataatcgtagtcaagcttcgagagatatcgccttgaaagaaggcatgattgaccgtgcaacggatgattttgctagttttgctcctttggcagatgtcattatactcagcttgccaatcaaacaaactattgctttcattaaggagttggccaatttggatttgcgagaaggcgttattatttcagatgctggttcgaccaagtcaaccattgtggatgcggcggagcagtatttggctggcaagtctgttcgctttgtcggggcccatcccatggctggtagtcacaagacaggggctgcttcggcagatgtcaatctttttgaaaatgcctattatatctttacaccttcaagcctgacaagtcaggacacgcttaaggaaatgaaggatctgctttcaggtcttcatgctcgttttatcgagattgatgccaaggagcatgatcgtgtcacttctcagattagccattttcctcatattttggcttctagtctcatggagcagactgcggtctatgctcaagagcatgagatggcaaggcgctttgcggcaggtggttttcgagatatgacccgaattgcggaaagcgagccaggaatgtggacctccattctcttgtccaatagcgagaccattctggatagaattgaggatttcaaggaacgtttggaagcgattggtcaggccattagtaagggagatgaagagcaaatttggaacttttttaaccaagcgcgtgaacaacgccagaccatggaaatccataagcgtggtggtgtggatagctcttacgacctctatgttgacgttcctgatgaagaagatgtcatcctgcggattttggaactgctacgtggaacttccttggttaacatccacatcaacgaggaaaatcgtgaggatattcacggaatcctacaaatttcatttaaaaatgctcaagacttggaaagagctgagcatctcataacagaaaataccgactatacagtcgtcatcaaataa

SEQ ID NO: 884 - DNA, 339 bp, Streptococcus pneumoniae
atgtcaaatatttacgatagtgcaaacgaactcagtcgcggtctacgcggattaccagaatacaaggctgttaaagcagctaaagatgcgattgcagcagatgctgaggcaagcaaaatctttacagaatatcttgcctttcaagaggaaattcaaaaactagcacagacaggtcaaatgccagatgcgtccttccaagctaagatggaaggctttggtaaacagattcaaggaaatagcctcttgtcagaattctttaccaagcaacaacaattggccatttacctttctgacattgaaaaaattgtttttgaaccagtttcagaattgctgaaataa

SEQ ID NO: 885 - DNA, 1284 bp, Streptococcus pneumoniae
atgaaactaaaaacaaacattcgccatttacatggtagtatccgcgtcccaggtgacaagtctatcagccaccgttccattatctttggaagtttggctgagggtgagaccaaggtttatgatattctgcgaggcgaagacgttctttcgaccatgcaggtttttcgtgaccttggtgttgaaattgaggataaagatggggttattaccattcaaggtgtaggcatggctggcttaaaagcgccgcaaaatgcccttaatatgggaaattctggcacctcgattcgcctgatttcaggtgtccttgctggtgcagatttcgaagtagagatgtttggagatgatagtctttccaaacgtcctatggaccgtgtgacccttccactgaaaaaaatgggcgtcagcatttcagggcaaactgaacgagacttgcctccccttcgcttaaaagggacgaaaaacctaagacctattcattatgagttgccaattgcctctgcccaagtcaagtcagccttgatgtttgcagccttacaagctaagggggagtcagttattatcgaaaaagagtgcactcgtaatcatactgaagatatgttgaaacaatttggtggtcatttaagtgtggacggtaagaaaatcatagtccaagggccacaaaaattgacaggacagaaggtggtcgtaccaggagatatttccagtgcagccttttggttagtcgcaggtttgattgttccaaattctcgtctagtgctgcagaatgtggggatcaacgaaactcgcaccggtattattgatgtcattcgtgccatgggtggaaaattggaaataactgaaatcgatccagtcgctaaatctgcaaccttgattgttgagtcttctgacttgaaaggaacagagatttgtggcgctttgattccacgtttgattgatgaattgcctattattgccctacttgcgacccaagcccaaggtgtaacagttatcaaggatgctgaggagctcaaggtcaaggaaacagaccgtattcaggttgtggcagacgccttaaatagtatgggagcagatattactcctacggcagatgggatgattatcaaaggaaaatcagctcttcacggtgctagagtcaatacgtttggtgaccaccgtatcggcatgatgacagctatcgcagccctcttggttgcagatggagaggtggagcttgaccgtgcagaagccatcaataccagctatcctagtttctttgatgatttggagagcttgattcatggctaa

SEQ ID NO: 886 - DNA, 477 bp, Streptococcus pneumoniae
atggctaaggtgttattagggtttatgggggctggaaaatcgactattgcaagaggcttggacactaattaccttgatatggatgctctgattgagaagcgcctaggtatgtccattgcgaattttttcgctgaaaagggagaagagacctttcgtcaggtagaatcagaagtcctagctgatttactacaaacagaccaagtcgtgtcaactggaggaggagtggttatttctcagagaaatcgtgacttactcaagactaatacagataacatctacctgaaagcagattttgaaaccctctaccaacgtatcgcagctgataaggacaatcagcgaccgctttttctaaataatagcaaggaagaactagtagctatttttcaagaaagacaggcttggtatgaggaagtggctagtcgggttttggatgtgaccaagctaagcccagaggaaattatagaggaactaagatga

SEQ ID NO: 887 - DNA, 846 bp, Streptococcus pneumoniae
atgaaaattgcttatctaggtcccaaaggatcattttcacaccacgttgtgcagacagcttttcctcatgaggaattgcaggcttttgccaacattacagatgtcatcaaggcttatgagcaaggattagtggactattctgtggtgccagttgaaaattctattgagggtagtgttcatgaaaccttggactatctttttcatcaggctcacatccaagcagtagcagaaatcgttcagcctattcatcagcagttgatggtggttccaggccatactaagattgaaaagattttttcacatccacagggcttggctcaaggaaagaaattcatcgatgaacaatatccagaggctcaaatcgaggtaacagctagtacagcttatgcggcccgttttatttccgaacatccagaccagccctttgcagcagttgcacctagaagttctgctgaagaatatggattggaactgattgccgaggatattcaggaaatggaagccaatttcacacgtttctgggttctaggagctgaaaagcctagtattcccttgcaagcacaaactgaaaagatgagtttggccttgacattacctgacaaccttccaggtgcactttataaggccttgtcgacctttgcttggcgaggaattgacttgacaaaaattgaaagtcgtccactcaagacagcactgggtgaatactttttcattatcgatgtggattatatcgataaggacttggtccactttgcccaaaaagaattagaagcgattggaatccagtataaaattctgggtgcctatcctatttatccaatatcagaccatggaaaggagagaaga

SEQ ID NO: 888 - DNA, 693 bp, Streptococcus pneumoniae
atgagtaaagaaaatcccttaagtcatcatgagcagttgcgttatgattatttgctaaaaaatattcactatctcaatgagagagaaaaaaatgagtttgcctatttgcaagaaaagctaactcttgctaggggaaatagtagctctagcttggaacaagaaagagaagagcaggttgacttaccaagctatgcgaaccggagtcgctcacaatccaaatcacaagcactctctttccctccaaaaaagaaaagacggaagctccgtcttaaacgaatttttatggtgattttttcacttttggtctgtgtggctttggccatggtattcatgtttttgcgtggttaccaagatgctagcgcaaagaaaactgctgatgcccgggcagctcaagtagaagtctttaatggtcaggacactagagatggagttaatattttaatcatgggtactgatggtcgaatcggccagaacagtgttgagacacgaactgactctattatggtattaaatgtcgggggctcagataagaaaatgaagctagtcagtttcatgcgtgataatttggtctatatagatggttatagtcaagtgattaatggtagaaaacagacagataacaagttaaacgtagcctacgagttaggagaacaagagggcaaaaaggggcagaaatgtttcgccaagtcttga

SEQ ID NO: 889 - DNA, 600 bp, Streptococcus pneumoniae
atgtttcgccaagtcttgaaagataattttgacttggacattaagttctacgccttggttgattttcaggcctttgccacagcgattgacacgcttttccctgatggggtgacgattgatgctcaattttcaacattgaatgggcgtcccctaacagaagctacagtcggagatgatttatatgctaccgagactgagtctccaacccaaaccattaaagtcggaaaacagcagatgaatggctcgaccctgctcaattatgctcgtttccgtgatgatgatgaggcggattacggccgtacaaaaagacagcaacaagttttaacagcaattttagagcaaattaaagatcccactaaacttttcactggttctgaagctcttggaaaggtttttgctatgacctcaaccaacgtaccttatactttcctcctaacaaacggtttatctgttttggatggagcaaaaaatggtattgaaaaattgacgattccagaactgggtgactgggtagacgcctatgatgtttatggaggcttgggcttgctggttgatcaaaacaaatatcaaaccaagctcgctcaaatgggcttgagataa

SEQ ID NO: 890 - DNA, 846 bp, Streptococcus pneumoniae
atgaacaatatgactgatttaaaagcaattcaggctcgtagtctggagatggctgaatattttgtggccttttgcaaggaacatgatttactttgctatctctgtgggggaggcgctattggtgcccttcgaaacaaggggttcattccttgggacgacgacctagacttttttatgcctcgtaaagattatgagaaattagcagaattatggcctcgttatgcagatgaacgttatttcttgtcaaagagttacaaggattttgttgatcgtaatctttttattaccattcgtgacaaggaaaccacctgtatcaagccttatcagcaggatttggatttgccacatggtctggccttggatgttttgcctttggattattatccgaaagatccagctgagcggaaaaaacaggttcgttgggccttgatttattcactcttttgtgcgcaaactattccagaaaagcatggtgctctcatgaaatggggaagtcgcattttactgggtttgactccaaaatctctccgttatcgcatctggaaaaaagctgagaaagaaatgactaagtatgatttggctgattgtgatggcattacagaattatgctcaggtcctggctacatgagaaacaagtacccaatcacatcttttgaagacaatcttttcttgccatttgaaggaacaaagatgcctattccaatcggctatgatgtctatctcagaactgcttttggggattatatgacgcctccaccagcagacaagcaggtaccgcatcatgatgttgtcatcgctgatatggataagtcttatacagaatacaagggagaatatggtggctaa

SEQ ID NO: 891 - DNA, 402 bp, Streptococcus pneumoniae
atgcgtacatgctttggaacagattcatatcccttgtcaaagtgctccatttcaagaatatcaatatcatacttttctggatccagatttgaaacaatggttgatagaatcttctctgcaccacctccaagagaaaaagaccacataaaaaataagatttttttcttagccaccatattctcccttgtattctgtataagacttatccatatcagcgatgacaacatcatgatgcggtacctgcttgtctgctggtggaggcgtcatataatccccaaaagcagttctgagatagacatcatagccgattggaataggcatctttgttccttcaaatggcaagaaaagattgtcttcaaaagatgtgattgggtacttgtttctcatgtagccaggacctga

SEQ ID NO: 892 - DNA, 1158 bp, Streptococcus pneumoniae
atgatgttgtcatcgctgatatggataagtcttatacagaatacaagggagaatatggtggctaagaaaaaaatcttattttttatgtggtctttttctcttggaggtggtgcagagaagattctatcaaccattgtttcaaatctggatccagaaaagtatgatattgatattcttgaaatggagcactttgacaagggatatgaatctgttccaaagcatgtacgcattttaaaatcccttcaagattatcgccaaaccagatggttacgagcttttttgtggagaatgagaatttattttccaagactggctcgtcgtttgcttgtaaaagatgattatgatgttgaagtttcttttaccattatgaatccaccactgttgttctctaaaagaagagaagtcaagaagatatcttggattcatggaagtattgaagaacttcttaaggatagctctaaaagagaatcacatagaagccagttggatgctgcgaatacaattgtagggatttcaaaaaagaccagcaattctatcaaggaagtttatccagattatgcttctaaattacagacaatctacaatggatatgattttcagactattctagaaaaatctcaagagaagatcgatatcgagattgctcctcaaagtatctgtactatcggacggattgaggaaaataagggttctgaccgtgtagtggaagtgatacgattattacaccaagagggaaaaaactatcatctctattttatcggggctggtgatatggaagaggaactgaaaaaacgagtcaaagagtatgggattgaggactatgtacatttccttggttatcaaaaaaatccttatcagtatttatctcagacgaaagttctcttgtctatgtctaaacaagaaggttttcctggagtgtatgtggaggccttgagtctgggactcccttttatctctacggacgttggaggggctgaggaattatcccaagaaggacgatttggacaaatcattgagagcaatcaagaggcagctcaggcgattactaattacatgacttctgcctcaaactttgatgtcgatgaggctagccaattcattcaacaatttacaattacaaaacaaatcgaacaagtagaaaaactattagaggagtag

SEQ ID NO: 893 - DNA, 987 bp, Streptococcus pneumoniae
atggaaactgcattaattagtgtgattgtgccagtctataatgtggcgcagtacctagaaaaatcgatagcttccattcagaagcagacctatcaaaatctggaaattattcttgttgatgatggtgcaacagatgaaagtggtcgcttgtgtgattcaatcgctgaacaagatgacagggtgtcagtgcttcataaaaagaacgaaggattgtcgcaagcacgaaatgatgggatgaagcaggctcacggggattatctgatttttattgactcagatgattatatccatccagaaatgattcagagcttatatgagcaattagttcaagaagatgcggatgtttcgagctgtggtgtcatgaatgtctatgctaatgatgaaagcccacagtcagccaatcaggatgactattttgtctgtgattctcaaacatttctaaaggaatacctcataggtgaaaaaatacctgggacgatttgcaataagctaatcaagagacagattgcaactgacctatcctttcctaaggggttgatttacgaagatgcctattaccattttgatttaatcaagttggccaagaagtatgtggttaatactaaaccctattattactattttcatagaggggatagtattacgaccaaaccctatgcagagaaggatttagcctatattgatatctaccaaaagttttataatgaagttgtgaaaaactatcctgacttgaaagaggtcgcttttttcagattggcctatgcccacttctttattctggataagatgttgctagatgatcagtataaacagtttgaagcctattctcagattcatcgttttttaaaaggccatgcctttgctatttctaggaatccaattttccgtaaggggagaagaattagtgctttggccctattcataaatatttccttatatcgattcttattactgaaaaatattgaaaaatctaaaaaattacattag

SEQ ID NO: 894 - DNA, 1434 bp, Streptococcus pneumoniae
gtgattgatgggaaacgattattatttagtttgaccatagtcagttatgccttgacgctagtaagtggagttgtgtatctgtttaataataataatgttagcttactttctactttattgttcttgttggttagtagcttaattgcttgttggaatgatatcaagtattacttaatccattttattttctatttaaccatttttgtatttctggtatcaagaccgaccattgattattttagggatggtgctttggatacctatcatccaatagcctatcgttttgcctttatagttgtcatggtttcgattctgggcttgaccacaggaggcattctggctcgttacttcatagctaggaagaaaataaaagtagcaaatataggaaattctctaaaagaggtttatatcaagcggttacgctttgtatcactaggagtttttcttctaacctatcctttctatttcattcggttatttgaacggctcttgtatcgtttgcagacttcctactatgcctactatgcaaattttgaaagtaaactgccttattttacctacattttgtctacctttacggtctatgcaatgtgtatgtatctagcaaccaagccaaagaaattgcaggccacagcagtgcttgtctcctttattgcagctaatactattcatttggcaattgggacacgaaatccctttattttaagtattttatttgcttttgtttattactttatgcgggagcaaactgaaaaaggaaaatggattgggtttaaagaaaagttagcgatttttgtaggttctcctattctcatgttagcgatgggagtactcaattatgtacgggataatgtccaagtttcccatacaggtttctgggatatcttacttgactttatctataaacaagggactagttttggtgttctggctcgaggttttctatttaacagtagcctcccttaccgagatttccgtaattttacttttggtcctgttcttgattattttgcaagggggagtttgggagccattttcggaggaaaagcctttgaacatacaaccaatagtgtggaactagctattgatagtaatagttatgcccacaatctatcctatcttgtcttgaacaaggaatacttgaaagggcatggtatcggaagtagttatatcatggagttgtataccgactatggtatgattggagtctttctgcttagtttcttactcggcgtattatttatagccatgctgcaagtagcctatcgctcaaggacaatcctatttgctttatccctactcatcttgaataatctattctttatgccaagaagcagcttttcagaaagtttcttcaatttatttacaatgcaattctggggaattgttcttgtgattatatttgtagcaaaaatgcttacaaaggaaaactag

SEQ ID NO: 895 - DNA, 453 bp, Streptococcus pneumoniae
atgtttgaacattattcagtagctgatttgtttgcaaatctttataaaaagcgaaaagcaaatattttagctctcatcgctttatttgctctcattgctgtaccatttacaattaaagcagttaggaataaaaacactgtcaaagatacaacaagttattcaacttatcttatctataaaatcactcctccaaaagagtcggccaaaacgattttgaatcatcaaattggtggttatagtgatttttatgggaaattgattgatggtaatttgaatggagcttatcttttcaatgatgtagaacccagtgagttgaaaaaaattgccagtgaattagacacgacagaaacaaccttgaaaaattcaacgaatgactattggtggaaaaaattgaccgtctactatatgattgacgatgcatggggttggtgtgaaaattttgacatcaagtaa

SEQ ID NO: 896 - DNA, 606 bp, Streptococcus pneumoniae
gtgaaaattttgacatcaagtaaagatgccaatgacttgttagagaaaaaaattgatgggttgattgagaaatttaaacatgcttatgcaaatgtgaaaattgaaaaactggaaaccatcaactctaaagaattgaacgcaaatggtgaaacagcgcttggcttaaatgtgaaaaatctgattcttcgtttagttgttattggagtggtttgtgtgattttggttgtgatgggaaatgtgttagtttatctctttaatccaacaatcaatagagtaggtgatttttctcagtatcaaattgattttgtaacagagattacaacaattgctaacctagcagatgttttgtcatacaaaaatactggacaggaattgaccatcgttagctcaaataaagctatcctagataaattgaaacagagtcaagaagctttaaaaggaatgcattttgtagatttacaggatgtatcatctcttttggaaagagatacagtccttcttgttgaagagtacggagtgactcgttataagaaatttgagcaaagtcttcaaattctcagaaacttaaatcgttctatcctcggtgtagcaacctttaaattataa

SEQ ID NO: 897 - DNA, 297 bp, Streptococcus pneumoniae
ggaacgagaaagtcagcaatctccattccacgatccatcaaatcctctaaagatatcgtgatttttaaagttgtatcactaatttgtttcattttcattgatagtaacctcatactttcagttctatctattatactagatttttacgattttatcaaaagaaaatttctgcagacagatagaaaaagccttcaaaatcggctcttagccgactttgaagaccttatacatcagaatacttataatttaaaggttgctacaccgaggatagaacgatttaagtttctgagaatttga

SEQ ID NO: 898 - DNA, 555 bp, Streptococcus pneumoniae
atgaaaatgaaacaaattagtgatacaactttaaaaatcacgatatctttagaggatttgatggatcgtggaatggagattgctgactttctcgttcctcaagaaaaaacagaagagttcttttatgctatcttggatgagctagagatgcctgatagctttctggatacaggcatgttgagcttccgtgtgactgcaaaacctgataaggtagatgtctttgtgaccaactcaaagattgaccaaaatctagattttgaagacttatcggatgggccagatatggaagaattggctcaaatgtctgcagatgaatttatcaaaaccctggaaaaaagcatcgcagacaaaaccaaggatgatatcgaagccattcaatctcttgagcaagttgaagccaaggaagaagagcaagagcaggctgaacaagaagctgagagtaagaaagaaccttacatctactacatcctttcttttgctaagttggctgacttgggagctttttgccaagacagtgactttttgaaatggaaacttctgaactctacaaaatga

SEQ ID NO: 899 - DNA, 384 bp, Streptococcus pneumoniae
gtgcaaactcgcgcatacgggccaacagccaagctggatatgggcttggatgattttcaatatccactaaaatggtcaaataatagcgctcgttcattttgtagagttcagaagtttccatttcaaaaagtcactgtcttggcaaaaagctcccaagtcagccaacttagcaaaagaaaggatgtagtagatgtaaggttctttcttactctcagcttcttgttcagcctgctcttgctcttcttccttggcttcaacttgctcaagagattgaatggcttcgatatcatccttggttttgtctgcgatgcttttttccagggttttgataaattcatctgcagacatttgagccaattcttccatatctggcccatccgataa

SEQ ID NO: 900 - DNA, 213 bp, Streptococcus pneumoniae
atggaaacttctgaactctacaaaatgaacgagcgctattatttgaccattttagtggatattgaaaatcatccaagcccatatccagcttggctgttggcccgtatgcgcgagtttgcacaggatagtgatatcagtcgctcagtcttacaagagtatggtcaagtcttgatgagtcgcgatgcagtgctcaatctgcaaaaaatcggctaa

SEQ ID NO: 901 - DNA, 1287 bp, Streptococcus pneumoniae
atgacagttaaaattgctttactgggatttggtaccgttgcaagtggtgtgcctttcctcctaaaggaaaatggaggaaaaatcaatcaatcagcacattcagatatcaaagttgctaaggtattggtcaaggatgaagatgaaaaaaatcgcttgcttgcagcagggaatgactttaactttgtaaccaatgtggatgatattttatcagaccaggatattactatcgtagtggaattgatggggcgtattgagcctgctaaaacctttatcactcgtgccttggaagctggaaaacacgttgttactgctaacaaggaccttttagctgtccatggcgcagaattgctagaaatcgctcaagctaacaaggtagcactttactacgaagcagcagttgctggtgggattccaattcttcgtactttagcaaattccttggcttctgataaaattacgcgcgtgcttggagtagtcaacggaacttccaacttcatggtgaccaagatggtggaagaaggctggtcttacgatgatgctcttgcggaagcacaacgtctaggatttgcagaaagcgatccgacgaatgacgtagatgggattgatgcagcctacaagatggttattttgagccaatttgcctttggcatgaagattgcctttgatgatgtagcccacaagggaatccgcaatatcacaccagaagacgtagctgtagctcaagagcttggttacgtagtgaaattggttggttctattgaggaaacttcttcaggtattgctgcagaagtgactccaaccttcctacctaaagcgcacccacttgctagtgtgaatggcgtaatgaacgctgtctttgtagaatctatcggtattggtgagtctatgtactacggaccaggtgcgggtcaaaaaccaactgcaacaagtgttgtagctgatattgtccgtatcgttcgtcgtttgaatgatggtactattggcaaagacttcaacgaatatagccgtgacttggtcttggcaaatcctgaagatgtcaaagcaaactactatttctcaatcttggctccagactcaaaaggtcaggtcttgaagttggctgaaatcttcaatgctcaagatatttcctttaagcaaatccttcaagatggcaaagagggtgacaaggcgcgtgtcgttatcatcacacacaagattaataaagcccagcttgaaaatgtctcagctgaattgaagaaggtttcagaattcgacctcttgaataccttcaaggtgctaggagaataa

SEQ ID NO: 902 - DNA, 870 bp, Streptococcus pneumoniae
atgaagattattgtacctgcaaccagtgccaatatcgggccaggttttgactcggtcggtgtagctgtaaccaagtatcttcaaattgaggtctgcgaagaacgagatgagtggctgattgaacaccagattggcaaatggattccacatgatgagcgtaatctcttgctcaaaatcgctttgcaaattgtaccagacttgcaaccaagacgcttgaaaatgaccagtgatgtccctttggcgcgcggtttgggttcttccagctcggttatcgttgctgggattgaactagccaaccaactgggtcaactcaacttatcagaccatgaaaaattgcagttagcgaccaagattgaagggcatcctgacaatgtggctccagccatttatggtaatctcgttattgcaagttctgttgaagggcaagtctctgctatcgtagcagactttccagagtgtgattttctagcttacattccaaactatgaattacgtactcgcgacagccgtagtgtcttgcctaaaaaattgtcttataaggaagctgttgctgcaagttctatcgccaatgtagcggttgctgccttgttggcaggagacatggtgaccgctgggcaagcaatcgagggagacctcttccatgagcgctatcgtcaggacttggtaagagaatttgcgatgattaagcaagtgaccaaagaaaatggggcctatgcaacctacctttctggtgctgggccgacagttatggttctggcttctcatgacaagatgccaacaattaaggcagaattggaaaagcaacctttcaaaggaaaactgcatgacttgagagttgatacccaaggtgtccgtgtagaagcaaaataa

SEQ ID NO: 903 - DNA, 426 bp, Streptococcus pneumoniae
atgaaaccctctggtcaagagtttccccatcctatcttctattctttattttgcttctacacggacaccttgggtatcaactctcaagtcatgcagttttcctttgaaaggttgcttttccaattctgccttaattgttggcatcttgtcatgagaagccagaaccataactgtcggcccagcaccagaaaggtaggttgcataggccccattttctttggtcacttgcttaatcatcgcaaattctcttaccaagtcctgacgatagcgctcatggaagaggtctccctcgattgcttgcccagcggtcaccatgtctcctgccaacaaggcagcaaccgctacattggcgatagaacttgcagcaacagcttccttataagacaattttttaggcaagacactacggctgtcgcgagtacgtaa

SEQ ID NO: 904 - DNA, 225 bp, Streptococcus pneumoniae
ctaatactcttcgaaaatctcttcaaaccacgtcagcgtcaccttaccgtatatatgttactgacttcgtcagttctatctgcaacctcaaaacactgtcttgagctgacttcttcagttctatccacaacctcaaaacactgttttgagcagcctgcggctagcttcctagtttgctctttgattttcattgagtataaacttcttttcacaaaaaggatatga

SEQ ID NO: 905 - DNA, 258 bp, Streptococcus pneumoniae
atggcagaaatttatctagcaggtggttgtttttggggcctagaggaatatttttcacgcatttctggagtgctagaaaccagtgttggctacgctaatggtcaagtcgaaacgaccaattaccagttgatcaaggaaacagaccatgcagaaacggtccaagtgatttacgatgagaaggaagtgtcactcagagagattttactttattatttccgagttatcgatcctctcatctatcaatcaacaagggaatga

SEQ ID NO: 906 - DNA, 768 bp, Streptococcus pneumoniae
atgagaaggaagtgtcactcagagagattttactttattatttccgagttatcgatcctctcatctatcaatcaacaagggaatgaccgtggtcgccaatatcgaactgggatttattatcaggatgaagcagatttgccagctatctacacagtggtacaggagcaggaacgcatgctgggtcgaaagattgcagtagaagtggagcaattacgccactacattctggctgaagactaccaccaagattatctcaggaagaatccttcaggttactgtcatatcgatgtgaccgatgctgataagccattgattgatgcagcaaactatgaaaagcctagtcaagaggtgttgaaggccagtctatctgaagagtcttatcgtgtcacacaagaagctgctacagaggctccgtttaccaatgcctatgaccaaacctttgaagaggggatttatgtagatattacgacaggtgagccactcttttttgccaaggataagtttgcttcaggttgtggttggccaagttttagccgtccgatttccaaagagttgattcattattacaaggatctgagccatggaatggagcgaattgaagttcgttctcgttcaggcagtgctcacttgggtcatgttttcacagatggaccgcgggagttaggcggcctccgttactgtatcaattctgcttctttacgctttgtggccaaggatgagatggaaaaagcaggatatggctatctattgccttacttaaacaaataa

SEQ ID NO: 907 - DNA, 309 bp, Streptococcus pneumoniae
atgaaacacctattatcttacttcaaaccctacatcaaggaatcaattttagcccccttgttcaagctgttagaagctgtttttgagctcttggttcccatggtgattgctgggattgttgaccaatctttacctcagggagatcaaggtcatctctggatgcagattggcctgctccttatctttgcagtaattggcgttttagtggccttgatagctcaattttactcagcaaaggcagcagtaggctttgctataggaattgacaaacgatctttatcgtcatattctttccttgcccaagcatag

SEQ ID NO: 908 - DNA, 1464 bp, Streptococcus pneumoniae
ttgacaaacgatctttatcgtcatattctttccttgcccaagcatagcagagaccgtctgacaacttctagtttggtcactcgcttgacttcggatacctaccagattcagactggtatcaatcaattcctgcgtctctttttgcgagcgcccattatcgtttttggtgccatttttatggcttatcgaatctcagctgagttgactttctggttcttagtcatggttgccattttgaccattgtcattgtagggttatctcgattggtcaatcctctctacagtagtctcagaaagaaaacggaccaactggttcaggaaacgcgccagcaattgcaagggatgcgggttattcgtgcttttggtcaagaaaaacgagagttacagatttttcaaacccttaaccaagtttatgctagattacaagaaaagacaggtttctggtctagtttattaacacctctgacctatctgattgtcaatggaactcttctcgttattatctggcaaggctatatttcaattcaaggaggagtgctcagtcaaggtgctctcattgctcttatcaattacctcttacagattttggtggaattggtcaagctagccatgttgatcaattccctcaaccagtcctatatctcagtcaagcgaatcgaggaagtctttgttgaggctccagaggatatccattcagagttagaacaaaagcaagctaccagagataaggttttacaagtccaagaattgacttttacctatcctgatgcggcccagccttctctgagatacatttcctttgatatgactcaaggacaaattctaggtatcatcgggggaactggttctggtaaatcaagcttggtgcaactcttacttggactttatccagtagacaaggggaacattgacctttatcaaaatggacgtagtcctcttaatttggagcagtggcggtcttggattgcctatgtacctcaaaaggtcgaactctttaaaggaaccattcgttccaacttgactctaggtttcaatcaagaagtatctgaccaggaactctggcaggccttggagattgcgcaagctaaggattttgtcagtgaaaaggaaggactcttggatgctctagttgaggcaggggggcgaaatttctcaggtggacaaaaacaaagattgtctatcgcccgagcagtcttgcgccaagctccgtttctcatcctagatgatgcaacctcggcactggataccattacagagtccaagctcttgaaagctattagagaaaattttccaaacacgagcttaattttgatctctcaacgaacctcaactttacagatggcggaccagattctcctcttggaaaaaggtgagttgctagctgttggcaagcacgatgacttgatgaaatccagccaagtctattgtgaaatcaatgcatcccaacatggaaaggaggactag

SEQ ID NO: 909 - DNA, 186 bp, Streptococcus pneumoniae
gcaatagttcctagaaaggctaggaaaaggaggaaaggatggcttgctaaatctacggctaaacgtttgagcgtctggtttacagtttgtcgtttcattctagtcctcctttccatgttgggatgcattgatttcacaatagacttggctggatttcatcaagtcatcgtgcttgccaacagctag

SEQ ID NO: 910 - DNA, 1752 bp, Streptococcus pneumoniae
atgaaacgacaaactgtaaaccagacgctcaaacgtttagccgtagatttagcaagccatcctttcctccttttcctagcctttctaggaactattgctcaagttggcttatcaatttacctacctattctgattgggcaggtcattgaccaagtcctagtggctggttcatcaccagttttttggcagatttttctccagatgctcttggtggtaataggaaatactctggtacaatgggccaatcctctcctctataatcgtctaatcttctcttataccagagatttacgggagcgaatcatccataagctccatcgtttaccgattgcctttgtagataggcaaggtagtggagagatggttagtcgtgtaaccacggacatcgaacagttggcagctggcttgaccatgatttttaaccaatttttcattggtgttttgatgattttggtcagtattctagccatgctccaaattcatctcctcatgactctcttagtcttgctgttgacgccactgtccatggtgatttcacgctttattgccaagaaatcctatcatctcttccagaagcaaacagagacgaggggaattcagactcagttgattgaagaatcgcttagtcagcagactataatccagtccttcaatgctcaaacagaatttatccaaagattgcgtgaggctcatgacaactactcaggctattctcagtcagccatcttttattcttcaacggtcaatccttcgactcgctttgtaaatgcactcatttatgcccttttagctggagtaggagcttatcgtatcatgatgggttcagccttgaccgtcggtcgtttagtgacttttttgaactatgttcagcaatacaccaagccctttaacgatatttcttcagtgctagctgagttgcaaagtgctctggcttgcgtagagcgtatctatggagtcttagatagccctgaagtggctgaaacaggtaaggaagtcttgacgaccagtgaccaagttaagggagctatttcctttaaacatgtctcttttggctaccatcctgaaaaaattttgattaaggacttgtctatcgatattccagctggtagtaaggtagccatcgttggtccgacaggtgctggaaaatcaactcttatcaatctccttatgcgtttttatcccattagctcgggagatatcttgctggatgggcaatccatttatgattatacacgagtatcattgagacagcagtttggtatggtgcttcaagaaacctggctcacacaagggaccattcatgataatattgcctttggcaatcctgaagccagtcgagagcaagtaattgctgctgccaaagcagctaatgcagactttttcatccaacagttgccacagggatacgataccaagttggaaaatgctggagaatctctctctgtcggccaagctcagctcttgaccatagcccgagtctttctggctattccaaagattcttatcttagacgaggcaacttcttccattgatacacggacagaagtgctggtacaggatgcctttgcaaaactcatgaagggccgcacaagtttcatcattgctcaccgtttgtcaaccattcaggatgcggatttaattcttgtcttagtagatggtgatattgttgaatatggtaaccatcaagaactcatggatagaaagggtaagtattaccaaatgcaaaaagctgcggcttttagttctgaataa

SEQ ID NO: 911 - DNA, 258 bp, Streptococcus pneumoniae
gtgtggttactgatttcgtcagttctatctgcaacctcaaaacagtgttttgagctgacttcgtcagttctatctgcaacctcaaaacagtgttttgagctgacttcgtcagttctatctgcaacctcaaaacagtgttttgaactgacttcgtcagtcttatctacaacctcaaagctgtgctttgagcaacctacggctagcttcctagtttgctctttgattttcattgagtattacagtgaacaatttttctag

SEQ ID NO: 912 - DNA, 387 bp, Streptococcus pneumoniae
  unsure (372): n at each above location is unknown.
atgaaaatcaaagagcaaactaggaagctagccgtaggttgctcaaagcacagctttgaggttgtagataagactgacgaagtcagttcaaaacactgttttgaggttgcagatagaactgacgaagtcagctcaaaacactgttttgaggttgcagatagaactgacgaagtcagctcaaaacactgttttgaggttgcagatagaactgacgaaatcagtaaccacacctacggcaaagtgaatctgaagtggtttgaagagagtacaacttgtcttttaaaaaaggagcctataatgaaagtctttcagcttgtaaatatcgtgacttgtgatcaagatttccatgtttatcttgatggaattttagcngtcaagggtttttaa

SEQ ID NO: 913 - DNA, 192 bp, Streptococcus pneumoniae
  unsure (59),(60),(62),(63),(64),(72),(75),(83),(98),(113),(115),(159),(160),(187): n at each above location is unknown.
aacacaaaaaaaataaagaaaggggggggagggggggccctttttggccctgtctttgnngnnngggtgttnccnttggccgngcccgggtatttccngggccccttatggtntntgttgggggcggcgggtttaaaaaacccttacttatttttaccnnaaaaaacaatattaaaaacccttgacngctaa

SEQ ID NO: 914 - DNA, 222 bp, Streptococcus pneumoniae
attactgaaaatcaaaaaagagagaaccaaactgattccctcttaatgtatataatatctagttttaaaaatacacactcacatatctctgtaatgaatcgggaagacaggattcgaacctgcgacaccttggtcccaaaccaagtactctaccaagctgagctacttcccgagttaaatagaaaaatgcaccctagaggagtcgaacctctaaccgcctga

SEQ ID NO: 915 - DNA, 207 bp, Streptococcus pneumoniae
atgggggaagaagagatgagaaataaaatgattatcgcagtaagtttagtagtagcaggagttatgacctatctcatgttttcgggattggatgaggatttctaccattttccttggaaggtctttgctggctttggaatcatgtcttggcttgttagagaaggtttgaaattagtcagagatgtgaaaaaggagtttgaagaatga

SEQ ID NO: 916 - DNA, 195 bp, Streptococcus pneumoniae
atgaagagagggatcatctatttctttatcggcctgtcactcttggtatggttagtggaaatgtttactgattggtttgatcaagccttgctttgccaattcattcgtggtgctttggagtttggatttatgattttcgtcgttttccctatgggaatggagtggttgaaaggagagtctcatgacggtggttaa

SEQ ID NO: 917 - DNA, 297 bp, Streptococcus pneumoniae
gtgaccagtttatctccaagcaaacaatctaagagtgttgtctttccggcaccatttggaccaattaaggcaacacattcaccatcgttgatttcaaaggagatgttccgcaaaatttccttgtcttttattttcttactcaatttctcaactttaaccaccgtcatgagactctcctttcaaccactccattcccatagggaaaacgacgaaaatcataaatccaaactccaaagcaccacgaatgaattggcaaagcaaggcttgatcaaaccaatcagtaaacatttccactaa

SEQ ID NO: 918 - DNA, 885 bp, Streptococcus pneumoniae
atgacggtggttaaagttgagaaattgagtaagaaaataaaagacaaggaaattttgcggaacatctcctttgaaatcaacgatggtgaatgtgttgccttaattggtccaaatggtgccggaaagacaacactcttagattgtttgcttggagataaactggtcacaagcggtcaagtatctattcaaggtttaccagtgacgagttctaagttagactatactagggcttacctccctcaagaaaatataatcgttcagaaattaaaagttaaagagttgattgctttctttcaacgtatctatccaaatcctttgagcaatcaggaaattgatcaactattgcagtttgtcaagcaacaaaaagaacagttggcagaaaaattatcaggcggtcaaaagcgtctcttttctttcatcttgaccttaattgggcgaccaaagattgtttttttagatgagcctactgcgtccatggatacctcaactcgtcaacgtttttgggaaattgtccaggagttaaaagcgcaaggagtcaccattctctattcgtcccattatattgaggaagtggaacacactgcagaccgcattttgctcttaaataagggagagttgattcgagatacgacgcctctagctatgcgtagcgaggaaatagaaaagcactttatccttcctatagcttacaaggaagtcgtagagcagtcaaatttggttgaaaactggaccctaaagcaagattctttacaagtagtcactcgagaagcagatgctttctgggaactattagcccaagcaggatgtaggatgcaagaaatcgaagttaataatcgtagtttgttgaatacaatctttgaagagacgcagaagggagataactaa

SEQ ID NO: 919 - DNA, 738 bp, Streptococcus pneumoniae
atgaaacgatggatagcacttagtaagatagaatttttattgaccaaacgacaattaatctattatctattgtcggtagggatgccgacggctttctatttatttttttctggtatctatcaggacacaccaggtgaactcgcgaattttatgcgtgattatcttatctccatgactgcattttccatgatgtcaacagctatcttctcattcccagttgttttacataccgacaagatcaacaactggcagaaaacattgcgtcatagccctgtaaatatggtagaatattatctatcaaagataacaagtatgctggttgattatttggtttcaatcttggtggttttctcagttgggcattttgtaagaggtgtggacatgtctcttggaaattggattggggctgcacttttgctgatagtaggaagtattgccttcgtagcgcttggtttgaccttgactctcttaccaactagtcagttgatgtctgtcgtgggcaatcttctttatctagggttggctgttttaggtggactctggatgcctatctctttatttccagactggatgcaagtagtaggtaagtgtctcccgacctatcagttgatggagttgctcaagaccttcttaaatgagggtggcatcaatctatcagccacagtttatttacttgttttttcagtagttttgtttggtttgaccatttaccttcaaggtcataaggagaatgcttaa

SEQ ID NO: 920 - DNA, 1098 bp, Streptococcus pneumoniae
atgcttgaaagactgaaaagcatacattatatgttttggatcagtttaatttttatggttttccccatcctaactgtagtgactgggtggctttctgcctggcatttattgattgatattctatttgtagtggcgtatttgggtgttttaacaactaagagccagcgtctatcttggctatattggggcatcctgctgacttatgtagttgggaatactgcctttgtggctgttaattatatctggtttttctttttcctatccaatctcttaagctatcatttcagcgtaggtggtttaaagtctttacatgtctggacttttcttcttgctcaagtccttgttgtgggtcaactgttgatttttcagagaatcgaagttgagtttctattctatctacttgtaattcttgcttttgtcgatttaatgacttttggcttggttcggattcgaattgtggaggatttgaaagaagcacaggctaagcaaaatgcccagataaatctattgcttgctgaaaatgaacgcaatcgtatcggtcaagatttgcatgatagtctggggcatacctttgctatgcttagtgttaaaactgatctagccttgcagttatttcagatggaggcttatccacaggtggaaaaggaattaaaagaaattcaccagatcagcaaggattccatgaatgaagttcgaactatcgtggaaaatcttaagtctagaactttgacatccgaactagagactgtgaaaaagatgttagaaattgctggaattgaggtggaaacggataaccaactagatactgctagccttactcaagaattggagtcaatggcttctatgattttgcttgagttggtgaccaatatcatcaaacatgccaaagcgtctaaagcttacttaaaattagaacggacagagaaggaactcattttaacagtaagtgatgatggctgcggctttgcttttctaaaaggagatgagctccatacagtccgagatcgtgtttttccattttcaggagaagtaagtgtaatcagtcagaaacatccaacggaagtgcaagttcgactaccttataaggagagaaactaa

SEQ ID NO: 921 - DNA, 600 bp, Streptococcus pneumoniae
atgaaagtattagtcgcagaagatcaaagtatgttgcgagatgccatgtgtcaattgctcacgcttcaaccagatgtggagtctgtccttcaagccaagaatgggcaagaagcaatccaactattagaaaaggagtctgtagatatcgccatccttgacgtagaaatgcctgttaagacaggtcttgaagtcttggagtggatacgatcagaaaagcttgaaacaaaggtggttgtggtgacgaccttcaagcgtgctgggtattttgaacgtgcggtcaaggctggagtggatgcttatgtattaaaggaacgaagcattgcagacctcatgcaaaccttgcacaccgtcctcgaaggacgcaaggagtattcgcctgaattgatggaaatggtgatgacccgtcccaatccgttgacagaacaagagattgctgtcttaaagggaatcgcccggggcttatccaaccaagaaatcgcagatcagctttacctctcaaacggaactattcgaaactatgtcaccaatattctttcaaaactggatgctggtaatcgaacagaggcagctaatatcgcaaaagaatctggttggttatga

SEQ ID NO: 922 - DNA, 1011 bp, Streptococcus pneumoniae
atgaatgcagatgatacagtaaccatttatgatgtcgctcgtgaagcaggtgtttccatggcgacggtcagccgtgtggtcaatggcaataaaaatgtaaaagagaatacccgtaaaaaagtgctagaggtaattgatcgtttggattatcgtccaaatgcagttgcgcgtggtcttgcaagtaaaaagacaaccactgtcggtgtcgtgattccaaatattaccaatggttatttttcgagtttggctaaggggattgatgatattgcagaaatgtacaagtacaatattgtcctagctaatagcgatgaagataacgagaaagaagtttctgttgtcaataccctcttttcaaagcaggtagatggcattatctatatgggttatcacttgacagataaaattcgctcagaattttcgcgttcacgtactccgattgttctcgcaggaactgtcgatgttgagcaccagttgccaagtgtcaatattgactataagcaagcaacaattgatgcagtgagttaccttgctaaagaaaatgagcgtattgctttcgttagcggtccgctagtggatgacatcaatggtaaggttcgtttagttggctacaaggaaaccttgaaaaaagcaggaatcacttatagtgagggtttggtatttgaatctaaatatagctatgatgatggttacgccttagcagagcgtttgatttcatcaaatgcaactgcagcagttgtgacaggtgatgagttggcagcaggagtcttgaacggtttggctgataagggtgtttctgtgccagaagattttgaaattattactagtgatgattcacaaatctcacgctttacccgtccaaacttgacaacgattgcccaacctctttatgaccttggtgccattagtatgcgtatgttgaccaagattatgcataaggaagagttggaagaacgtgaagttctcttacctcatggtttgacagaacgtagctcaacacgaaaacgtaaatag

SEQ ID NO: 923 - DNA, 393 bp, Streptococcus pneumoniae
ctaatactcttcgaaaatctctgcaaaccacgtcacgtcgccttaccgtatgtatggttactgacttcgtcagtttcatccacaacctcaaaaacatgttttgagctgacttcgtcagtttcatccacaacctcaaaaacatgttttgagctgacttcgtcagtttcatccacaacctcaaaaacatgttttgagctgacttcgtcagtttcatctgcaacctcaaagcagtgctttgagctgacttcgtcagttctatctacaacctcaaagcagtgctttgagctgacttcgtcagttctatctgcaacctcaaaacagtgtgttgcacagcctttaaccagccgcctagtccgctctatggtattcattaagtcaacatctcttgtttaa

SEQ ID NO: 924 - DNA, 339 bp, Streptococcus pneumoniae
atgaataccatagagcggactaggcggctggttaaaggctgtgcaacacactgttttgaggttgcagatagaactgacgaagtcagctcaaagcactgctttgaggttgtagatagaactgacgaagtcagctcaaagcactgctttgaggttgcagatgaaactgacgaagtcagctcaaaacatgtttttgaggttgtggatgaaactgacgaagtcagctcaaaacatgtttttgaggttgtggatgaaactgacgaagtcagctcaaaacatgtttttgaggttgtggatgaaactgacgaagtcagtaaccatacatacggtaaggcgacgtga

SEQ ID NO: 925 - DNA, 963 bp, Streptococcus pneumoniae
atgcctaagaaaatccttgttttacatacgggtggaactatttccatgcaggccgatgcttctggcgctgttgtgacgagttcagataatcccatgaaccatgtgtccaacccacttgaaggaatccaagtccacgccttggacttttttaaccttccaagtccccatatcaaacccaaacatatgctggtcctctaccagaaaattaaagaggaagcagataactacgatggagtggtgatcacacacggaaccgatactttagaggaaacagcctatttccttgataccatggaagttccccatatgcctatcgttctaacaggagccatgcgtagctccaatgagctcggtagtgatggtgtttataattacctaagtgctttacgagtggccagtgatgacagggctgctgacaaaggagttttggtcgttatgaacgatgaaatccacgctgccaagtatgtcaccaaaacacatacgactaatgtcaacaccttccagactccaacacatggccccctcggtctcatcatgaaacaggaaatcctctacttcaaaacagctgaacctcgtgttcgctttgaccttgatcacatacaaggtttagtccctatcatctcggcttatgctggtatgacagatgagctgattgatatgctggatttagaacacttggacggtttgattatccaagccttcggagctggtaatattcccaaagaaacggctcaaaaattagaaagccttctgcaaaaaggaatcccagtcgctctggtatcacgatgctttaacggtattgccgagcctgtttatgcctaccagggtgggggcgtacagttgcaaaaagcaggcgttttctttgttaaagaactcaacgcccaaaaagcccgcttgaaactcctcatcgccctcaatgccggactaacaggacaggctttgaaagactatatggaaggctaa

SEQ ID NO: 926 - DNA, 1389 bp, Streptococcus pneumoniae
atggaagtcaaagctgttttttttgatatcgatggaaccttggtcaacaatcgcaagagtgttttgaaatccactaaggatgcgattaagattgtcaaagaacaaggggtactagttggcgtagcgacagggcgaggacctttttttgttaaggaattgatggacgatttggatctggattttgcggtaacctataatggccagtatatctttagtaaagacagagtcttgttcacgagccctatttccaagttacatttgcgccatctaattagctatgctaaaaaagagggcacggagattgccctagggaccaaggatgccatgttgggttctaaaatcatgtcctttggtctgggttctttttcccaacgaattagtcgcttcgttccctctgttttaactcggacggtgagtcagtcttttaatcgcatggtcagcaaggttgttccccaaaaggaagaggacctgcttcacctgatgaatcagcctatctaccaagttttgatgctgatgacaccagaagaatctgagaaggcggcagctgattttgaagacttgaaattgacacgtagcaatccttttgcatcggatgtcatcaatcagggaaattctaaattagaaggcattcgccgagttgggaaagaatatggctttgacctcaatcaagtcatggcttttggtgactcagataatgaccttgaaatgctggctggcgtcggtatgtcggtcgctatgggaaatggtagtagcagtgtcaaggaagctgccaagcacattaccactagcaatcaacaagatgggatccacaaggccttggaacattttggtgttttgtcttcagaaaaagtctttgtcagccgtgactatcatttcaataaggtcaagaccttccaccacatgatggatgaacgaacccaagaagaacctcgagcttgggatttagagggtgcaacccatagggctggttttaaaatagaagaattggtggagtttgttcgagcagccagtccttctgaagaagattttggtcaagctgtatcgcaacttcatcaggcccttgataaggcagcagataaagtagccaagaagacacctgctcagcaagatttgatagggcaagtggatgccttgattgacacgctttacttcacctacggcagttttgtcttgatgggggtggacccagaacgtatttttgatattgtccatcaggccaatatggggaaaatttttccagatggcaaggctcattttgatccagtgacccataaaatcttaaaaccagataattgggaagaaaaatatgctccagaacctgctattaaaaaggaactgcagcgccagctcaaggcttacgaacgccataaagagagaaataaatcgtaa

SEQ ID NO: 927 - DNA, 453 bp, Streptococcus pneumoniae
atggcacaacgttaccaaaatatcatggtcgcaatcgatggttctaaggaagcggacttggcttttgtcaagggagttcattctgctctacgaaacgacgctaaactcaccatcgcacatgtcattgacacacgcgctctccaaagcgtatccacctttgatgctgaagtttacgaagaactccaagtcgacgctgaaagtctgatgaaagagtacgaaaaacgtgctaaagatgctggggtagcagatgttcatatcgtcattgaaatgggaaatccaaagaccctgctagcacgtactattccagatgccgaggaagtggacctcatcctcgttggcgcaactggtctcaacgcctttgaacgcctcttggtcggctcttcatctgaatacatactccgccatgctaaggtcgatttgctggttgtgagagaacaagaaaaaaccttataa

SEQ ID NO: 928 - DNA, 291 bp, Streptococcus pneumoniae
atgaaaaactcttttcaaaaatcaaatttcctttattatggaattatcctagtttcagtcttggtagaagtgatcatgatctgtcaattagagagtctggtaccgcttctttatccaagttttattggatttttagtttttcatgtactctaccatctaatcttatttctagttgcaaaacgaagcgggcgttgggattacttgatgatatgggggcttttcctcatgtttaatcttctttatgactcctttctaggcttgctttttctaggtttatcttttggtttgtga

SEQ ID NO: 929 - DNA, 717 bp, Streptococcus pneumoniae
atgaaagaatataacaagtctagtaaggtagagcatgttgcttatgatatccgaggtcctgtattggaagaagccatgctgatgctagcgaatggagaaaagatcttacgtctgaatacaggaaatccagcacaatttggctttacagcgccagacgaggtcattcatgacttgattatgaatgcgcgtgatactgaaggctattctgactccaaaggaattttctcatcccgtaaggccatcatgcagtatcgccagctgaagatattcccaaacgtagatattgatgatatttactttggaaatggtgtcagtgagttgattgtcatgtccatgcaggggcttttggacaatggggatgaggtcttagtgccaatgccagactatcctctatggacggcggctgtcagcctagctggaggaaatgccgttcactatatctgtgatgaagctgttgaatggtacccagatattgacgatatcaagtcaaaaatcacttccaataccaaggcaatcgtccttatcaatccaaataacccaactggagccctttatcctaagaaactcttgctggagattattgagattgcccgtcaaaacgatttgattatctttgcggatgaaatctatgaccgcatggtaatggacggacatgtgcatacgcctgtggcgagcttggcaccagatgtcttctgtgtcagcatgaatggtctgtaa

SEQ ID NO: 930 - DNA, 333 bp, Streptococcus pneumoniae
ttggacagcatattgagccctttcgatatatcccttaacatgagtcttatggccagacaagaccatccaacccacacggaaacctgctatgcggtgggatttttacagaccattcatgctgacacagaagacatctggtgccaagctcgccacaggcgtatgcacatgtccgtccattaccatgcggtcatagatttcatccgcaaagataatcaaatcgttttgacgggcaatctcaataatctccagcaagagtttcttaggataaagggctccagttgggttatttggattgataaggacgattgccttggtattggaagtgatttttga

SEQ ID NO: 931 - DNA, 375 bp, Streptococcus pneumoniae
ttggcccaacaagtcgtacaaacttccttggggggtcaccaatcagtcgatgaattgcttcttcctggtggacgaatctacgagcaaagaaatttcatctataatgccattcaagatattccaggtttgtctgccgttaaacccaaggcggggctctatatcttcccaaaaatcgaccgcaatatgtaccgtatcgatgatgatgagcagtttgtccttgatttcttgaagcaggaaaaggttctcttggttcatggtcgaggctttaactggcaggaaccagaccacttccgtatcgtttaccttcctcgtgttgatgagttagcccaaatccaagaaaagatgactcgtttcttgaaacagtatcgtagatag

SEQ ID NO: 932 - DNA, 135 bp, Streptococcus pneumoniae
gtgaaacgtacttatcaaccaagtaaacttcgtcgtgcgcgcaaacacggattccgtaaccgtatgtcaactaaaaatggtcgtcgcgtattggcagctcgtcgtcgtaaaggacgcaaagttttggctgcataa

SEQ ID NO: 933 - DNA, 201 bp, Streptococcus pneumoniae
ttgcatctactgaacttttttacaaaaataaaaatcagtagactcgagttcctactgatttttgatagaattcgtttggattatgcagccaaaactttgcgtcctttacgacgacgagctgccaatacgcgacgaccatttttagttgacatacggttacggaatccgtgtttgcgcgcacgacgaagtttacttggttga

SEQ ID NO: 934 - DNA, 654 bp, Streptococcus pneumoniae
gtgacgattctaggaaaagatacagttcaacaatctgcgaaaggtgaatctgtaactcaagaagctacaccagagtataagccagaaactacaccaggtggagataagggaggcaatactggaaactcagatgctaatgcgaatgcaggcggtggtagccaggcgggtggatcagctcacacaggttcacaaaactcagctcaatcacaagcttctaagcaattagctactgaaaaagaatcagctaaaaatgccattgaaaaagcagccaaggacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaagacaacaagtgcaccgcaagcaactgcaggaacaatgcaagatgttacctaccagtcacctgctggcaaacaattacctaacacaggttcagcatcaagtgcagcacttgctagtcttggtctagtggtggcaacaagtggttttgctttgctaggaagaaagactagacgtagaaaatag

SEQ ID NO: 935 - DNA, 225 bp, Streptococcus pneumoniae
atgatttttgatacacatacacacttgaatgtagaagaatttgcaggtcgtgaggcagaagaaattgccttggctgatgagatgggtgtgacacagatgaatattgttggttttgatataccgacgattgagcgtgccttggagttggtagatgagtatgagcagctctatgcgactattggttggcatcctacagaagctggtatttatacagtaggaagttga

SEQ ID NO: 936 - DNA, 543 bp, Streptococcus pneumoniae
ttgttggataagttaaaacatcccaaggttgtggctttaggtgaaattggcttagactaccattggatgacagcgcctaaagaggtgcaggagcaggtttttcgccgtcagattcagctatctaaggacttggatttgccttttgttgtccatacccgtgatgcgctggaagatacctatgagattatcaagagtgagggcgttggtcctcgtggtggtatcatgcattcattttcagggacgcttgagtgggcagagaagtttgtggatcttggtatgaccatttccttctcaggagtggtgactttcaagaaggcaactgacctccaagaagcagctaaagagttacctttggacaagatgttggtggaaacagatgcgccttacttagcacctgtacccaagcgtggtcgtgaaaataaaacagcctatactcgctatgtggtcgactttatcgctgacttgcgtggtatgacgacagaagagctggcggtagcaacgactgcaaatgcagaacgaatttttggattggacagcaagtaa

SEQ ID NO: 937 - DNA, 561 bp, Streptococcus pneumoniae
atgaaagagaaaatttctcaagttatcgtggttgaaggtcgcgatgatacggtcaatctcaagcgttatttcgatgtggagacctatgagacacgaggttctgccatcaatgatcaggatatagagcgaattcagcgtctacaccaacgtcatggagtcattgtctttacagacccagattttaatggggagcggattcggcgcatgatcatgacggccattccaacagttcagcatgcctttctcaagcgagatgaagctgttcccaagtccaagaccaaggggcgttctctgggaattgagcatgccagctatgaagacctgaaaacggctctagctcaggtgacagaacaatttgaacatgagagtcagtttgacattagtcgtagcgatttgattcgccttggttttctagcaggggcagacagccgtaagcgtagagaatatctcggagagactctccgaatcggctattctaacggcaagcaactcctcaaacgcctagagttgtttggggttactttggcagaagtggaagaagctatgaaatcttatgagtag

SEQ ID NO: 938 - DNA, 912 bp, Streptococcus pneumoniae
atgttaattggtcaaaaaattaaagagattcggatagaaaaaggaattagtcgtccagatttttgtggagatgagcaagaactgacagttcgtcaactgtcgcgaattgaaagtggagcttcgcaaccgagtttgcccaagttagactatattgctcgccggctaggagttccagtttatagccttatgccggatttttcagctcttccttctgcttatttagaattgaaataccagattttacgtgaaccaatctatgataaagaagaggagtatgataagaaagaagcgtgtttggaagagatagaggatttattttatgagcaacttcctaatgaggagaaagtatggtttgaagctactagagcaacgatagatgttattcgaagcggacaaccagaatacggggaaaccgtactggacgattattttaaaacaatttatgataaggaattgtttttgataaatgaattagaagttatcaacttatattttgctatagtgcttacaaagataaaacaaggtcaaaatcagattgaagaaattaacagaattcattcgtttttagttcgtttgacaaatcatgtagaattaattgcaccagaatatctgtttgctttaagtaacactttgttttcgggtctagcctgtttggataatttgtcgtcttatgattcactaggagcttatatctttagccttaatcatataatggaaaaaacacaagatttccagaagaaaccaattatattaatgttggagtggaaattatctctaataataaacaatgattatgtttctgccgaacagttctatcagaaatcgaagctatttgctgatataatagaaaattcttatttagttactatgttagaaaaacaatggcaagaagatttaaaaaaatatttataa

SEQ ID NO: 939 - DNA, 297 bp, Streptococcus pneumoniae
atgaaacaaacagttaaaaaattagctcttgtagcgagcattgcagcaacattaggtggaagtgtagcagttgcctctgcagccgttcaatacccagaaggtggtgtttggacttatggttcaggtaacggtggtgcttactcaaactactatcacccttcaaaataccatagttcaacagttgttagcagaaaaactggttcatctgacaagggatatgctggtgctggagggacttctcgtgcatggattcgtacttcttggggagagaaagttgcattctactataatgtttag

SEQ ID NO: 940 - DNA, 807 bp, Streptococcus pneumoniae
atgatgaaacgtttatttattttgatttcaatggtattagtatcgctttatatggtgataacttccgttgaccatcgagaagagattttatttggtaactatccttctgttgatgtgacaggaatgatgataaatcaaccagtagctagtcgcgaagaggtgacagaggctttgagtcacttggcggtagagcacaatagtctcattgctcgtcgaatcgttgagccaaatgaagctggagaaacacgctttacctatgccacttatggtgagggaaagcttccagaaggtctgaccatttcctccaaggagagtgcagaaacgagtgatttattagggtcttacttgattgtatcaggaagtttggatggagtgagcttacagaccaccttgaaagagcttggttatcaaggctttgtttcgaatggagaagatccattttcgatagtcttactattgacggccacccctatggtgctactgagtttagctatttttctgctgacctttatgagtctgaccctgatttatcggatcaaatcccttcgtcaggcagggattcgcttaatagctggtgagagcttgtttggagttgctctcagaccagtgttagaagatgtgagacagcttatctgctcagtgctggtatccagtcttttgggattggggattctctggtatcaaggtgccttgtttatggcaacggtgcaactggtcatcattgctcttctactttatggattgcaccttggcagggatttctaccttactaagtgtcgtctatctacttggtttacaggaaaatag

SEQ ID NO: 941 - DNA, 1350 bp, Streptococcus pneumoniae
gtgccttgtttatggcaacggtgcaactggtcatcattgctcttctactttatggattgcaccttggcagggatttctaccttactaagtgtcgtctatctacttggtttacaggaaaatagtctggtggatctattgaaagggaaactccctctcaaacgtatgatgacattgatgatggtggggcaactcttagctgtattggtggtcggatcgagtgcgacacgtctcctaccccactaccgtgaaatgcaggaaatggagagagctagcaataaatggagccagtcctcagaccgttaccgtctatcctttggttggtctagtgcatttgccgatgaagaaggaacgcgtaaggataatcgtgagtggcagacatttactgaagaacggttagccaatacagactctttttatattatgagcaatgttgacaatttctcagatggagcagaagtggacctagatggcaatcgtctcagtgactacacaccgtcagggaatgttatctatgtctcaccgcgctatctgatagaagaaaagattaccgtttcttcagagtttatggacaagatgcaaaacttgtctgagggagagtttgggctgatcttgcctgagagcttgcgagagcagtctatctactaccaaggattgtttacagattacctgcaaaacttttcatctgaaagtgtagaagtgacgagtcagaaacactacctcccacaggtaaggctagcttttacagaaataggacaggaacgtttcctctataatgatgggtacaagacaacacgccagtacctaaaagatccgattattgtagttctaacgccgcaagcgactggaacaagacctgttgcagggatgttgtggggaactacggctaatagtgccttgaaactagatcgatatggagacagcatcacagctctaaaagagcaaggtctgtatcacaaggtttcttacttggtaaaaagccagctattttttgccaaggtactaaatgacaaacgggtggagttttactctctccttattgggacgattttgaccctgtctacggctatcttgttatttgattccatgaatcttctctattttgagcagttcagacgggatcttatgattaaacgtcttgctggtatgacaatctatgagcttcatggcaagtatttactggcgcaaggaggagttctcttgcttggcctagtcctatctagtattttgacaagagatggtttgattagcgctctagttgtagctttgtttacgcttaacgccctcttgattttagtaaggcaggacaaaaaagaagaagctggtagcatggcagtattgaaaggaaaataa

SEQ ID NO: 942 - DNA, 642 bp, Streptococcus pneumoniae
atgattgatattcaaggattggaaaagaaatttaatgaccgcgcgattttctctggtttgaatctcaagctggagaagggcaaggtttatgccttaatcggaaagagtggaagcggaaagacgacgctgctgaatatcttgggaaagctagaaaagatagatggaggaagggttctctatcaggggaaagatttaaaaaccattcccactcgtgagtattttcgagatcagatgggctatctctttcaaaattttggcctcttagaaaaccaatcaatcaaagaaaatttggatttgggttttgttggtcagaaaatctcaaaagtagaacgtttggaaaggcaagtgggggctttagaaaaagttaatctagggtatttggatttagaacaaaaaatttatactttatctgggggagaggcccaacgagttgcccttgcaaaaactattttgaaaaatccacccttgattttggcagatgaaccaacagcagctcttgatcctgaaaattcagaggaggttatgaatctcttggtggatttgaaagatgaaaatcgaattatcatcattgcgacccataatcccctagtctggaataaggctgatgaaatcattgatatgaggaaacttgctcatgtgtga

SEQ ID NO: 943 - DNA, 309 bp, Streptococcus pneumoniae
atgtgtgaaaaaatccgtattcgcagggtatctgattatcctagtgccagaggtggtttagaagatatcctcatcatggaaaatatgaccaatcatctccttttggttcaaatccgagtgcatggctatttgcttgattttgctagtattgaagggcaaaggcaaaagcattatcgtttgaaaaatttacctcagacggttgaactgacagtggatgatgtggaggaggatgtggatttgaccctacccgaaaatcgaagttatcaagaagctgatttttttgaacgcatgtttcgagagaactgttaa

SEQ ID NO: 944 - DNA, 507 bp, Streptococcus pneumoniae
gtgcatgagaataggcgtcgtgatgtagtaaggcaaattagccactaccttgattggcaggttaggatttttaaaattttggatatgttgcgccaaatcaaccttgagaatatcttcgttaactacagtcacattatcaaaatcacgcagggtatctgccaaaattggcaccaaacggtggtcaatctcaaaagccatgacttgggctgcacgctcagccaaaaattctgtcaaggcaccaatacctggcccgatttcgatgacattgacctgatcatcaatttcagccgtatccacaattttttgaaggatattggtatccgtcaagaaattttgcccaaaggactttttaaaggtaaaaccgtgacgctccaacactgccttggtcacgctataatctgcaattctcatctattctcttttctattatctgttactactattgtaacacattccccttgtattttgggaatgaaaatcataccaaaaaactatctttcctcatga

SEQ ID NO: 945 - DNA, 873 bp, Streptococcus pneumoniae
atgagaattgcagattatagcgtgaccaaggcagtgttggagcgtcacggttttacctttaaaaagtcctttgggcaaaatttcttgacggataccaatatccttcaaaaaattgtggatacggctgaaattgatgatcaggtcaatgtcatcgaaatcgggccaggtattggtgccttgacagaatttttggctgagcgtgcagcccaagtcatggcttttgagattgaccaccgtttggtgccaattttggcagataccctgcgtgattttgataatgtgactgtagttaacgaagatattctcaaggttgatttggcgcaacatatccaaaattttaaaaatcctaacctgccaatcaaggtagtggctaatttgccttactacatcacgacgcctattctcatgcacttgattgagagtggcattccttttagtgagtttgtggtcatgatgcagaaagaagtagcggaccgcatttcagcccagcctaacaccaaggcttacggtagcttgtctatcgccgtgcagtattacatgacagccaaggttgcctttatcgtgcctcgtacggtctttgtgccagcgccaaatgtggattcagccatcttgaaaatggtgcgccgtccagagccagctgtagcagtggaagatgagaacttcttctttaaggtttccaaggctagttttacccatcgccgtaagaccttgtggaataacttgacaggttactttggcaagactgaggaagtcaaggacaagctgaccaaggctttggaccaggcagacttgtcgccaagtgtgcgtggggaagctctcagcttggcagaatttgccggtctagcagacgcacttaaagggcaaggactctaa

SEQ ID NO: 946 - DNA, 879 bp, Streptococcus pneumoniae
atgcagggacaaatcattaaagccttggctgggttctactatgtagagagtgatggccaagtctatcaaacacgcgcgcgtgggaatttccgtaaaaaagggcataccccttacgttggggactgggtagatttctctgccgaggaaaattcagaaggctatattctcaagattcacgaacggaaaaacagtctggtccgtccgcctattgtcaatatcgaccaagctgtagtaatcatgtccgtcaaggaacctgattttaacagcaatttgctggatcgtttcttggttcttttggagcacaagggcatccatcccattgtctatatttccaaaatggatttgttggaagataggggagaactggatttttaccagcagacctatggtgacatcggctatgactttgtgaccagtaaagaggaactcctgtctttgttaacaggcaaggttacggtctttatggggcagacaggtgttgggaagtcaactcttctcaataaaatcgcaccagacctcaatcttgaaacgggagaaatttcagacagtctaggtcgcggtcgccataccactcgagctgttagtttttacaatctcaacgggggtaaaatcgcagatacaccaggattttcatccttggactatgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgacaattacctgcaattccttagtgaaattgaaaatcgtagagaaacctataaaaaagtcagcaaaaaaattccaaaataa

SEQ ID NO: 947 - DNA, 903 bp, Streptococcus pneumoniae
atgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgacaattacctgcaattccttagtgaaattgaaaatcgtagagaaacctataaaaaagtcagcaaaaaaattccaaaataaggagaaacctatgtctcaatacaagattgctccgtcaattctggcagcagattatgccaactttgaacgtgaaatcaaacgtctagaagcaactggggcagaatatgcccatatcgatatcatggacagtcattttgtaccgcaaatcagttttggtgcaggtgtggtcgagagccttcgtcctcatagtaagatggttttcgattgccacttgatggtgtcaaaccctgagcatcatctggaagattttgcgcgtgcaggtgcagacatcatcagtatccatgtagaagcaacacctcatattcatggcgccctccaaaaaattcgttcactcggagttaagccttcagtcgttatcaatcctggcacaccagttgaagccatcaagcacgtccttcatctagttgaccaagttttagtcatgacggttaatccaggttttggtgggcaagcctttctgccagaaaccatggataaggttcgtgagttggttgctcttcgtgaggaaaaaggtttgaactttgaaatcgaagtggatggtgggattgatgaccaaactattgctcaagccaaagaagctggtgcgactgtttttgtagcaggttcctatgtctttaagggagaagtcaatgagcgagtacaaactctcagaaaacaactggactag

SEQ ID NO: 948 - DNA, 663 bp, Streptococcus pneumoniae
atgagcgagtacaaactctcagaaaacaactggactagggttgcagtttttgcaggcggaaaccgcggtcattatcggacagattttgatgcttttgttggggtggatcgaggctcgctctgggtcttggaagaagacttacctcttgctctagcagtcggagattttgattctgtgacggaagaagagcgacaggtgattcaaaaacgtgcccagtattttgtccaagcccgaccagaaaaagatgataccgatttggaattggctctcttaaccatctttgagaaaaatcctcaggctcaggttactattttcggtgccttgggtggccgtattgaccatatgttggccaatgtctttctgcctagcaatcctaagttggcaccctatatgcatcaaatagaaattgaggatgggcaaaacttgattacttattgtccagaagggaccagtcagctagaacctcgttcagactacgactatctagcctttatgccagttcgggatagccagctgactattcttggagccaagtatgagttgacagaggaaaattttttctttaaaaaagtgtacgcttctaacgaatatatagatagggaagtgtcggtaacttgcccagatggttatgtggtcgtactgcatagcaaggataggaggtag

SEQ ID NO: 949 - DNA, 1215 bp, Streptococcus pneumoniae
atggaaagtttacttattctattattaattgccaacctagctggtctctttctgatttggcaaaggcaggataggcaggagaaacacttaagtaagagcttggaggatcaggcagatcatttgtcagaccagttggattaccgctttgaccaagccagacaagccagccagttagaccaaaaagatttggaagtggctgtcagcgaccgtttgcaagaagtgcggattgaattgcaccaaggcctgacccaagtccgtcaagaaatgacagataatctcctccaaactagagataagacagaccaacgtctccaagccttgcaggaatcaaatgagcaacgtttggaacaaatgcgccagacggtcgaggaaaaactagaaaagaccttgcagacacgcttacaggcttcctttgagacagtttctaaacaactggagtctgtcaatcgtggtcttggagaaatgcagacagttgcccgtgatgtcggagctcttaacaaggttctctctggaaccaagacgcgagggattctgggagaattgcaactggggcaaattattgaagacatcatgacacctgcccagtacgaacgagaatacgcaacggttgaaaactctagtgaacgagtggagtatgccatcaagttacccggacaaggcgaccaagaatacgtctatcttccaattgactctaagtttccactggcagattattaccgcttggaagaagcctatgagacaggtgacaaggatgagattgaacgctgtcgtaagtcactcctagcaagcgtcaagcgctttgccaaggatatcaagagcaagtacatagcaccgcctcggacaaccaactttggaatcttgtttgttccgacagaaggtctttattcagagattgtgcgcaatccggtcttctttgatgatttgagacgggaagaacagattattgttgcaggaccaagtaccctatcagcccttcttaactccctatcagttggtttcaagacccttaatatccaaaagagtgccgaccatatcagcaagactcttgccagtgtcaagaccgagtttggcaagtttggtggtattctggttcaggcacaaaaacatctccaacatgcctctggcaatattgatgaattattaaaccgtcgtaccatagctatcgagcggacgctccgtcacattgagttgtcagaaggtgaggcctgcgcttga

SEQ ID NO: 950 - DNA, 942 bp, Streptococcus pneumoniae
atgaagattagtcacatgaaaaaagatgagttatttgaaggctttaacctaatcaaatcaggtgacctgaggcaaactcgagttgggaaaaactacctagcctttaccttccaagatgatagtggcgagattgatgggaagctctgggatgcccaacctcataacattgaggcctttaccgcaggtaaggttgtccacatgaaaggacgccgagaagtttataacaatacccctcaagtcaatcaaattactctccgcctgcctcaagctggtgaacccaatgacccagctgatttcaaggtcaagtcaccagttgatgtcaaggaaattcgtgactacatgtcgcaaatgattttcaaaattgaaaatcctgtctggcaacggattgtccgaaatctctacaccaagtatgataaggaattctactcctatccagccgccaagaccaaccaccatgcctttgaaacgggcttggcttatcatacggcgaccatggtacgtttggcagacgctattagcgaagtttatcctcagctcaataagagcttactctatgcggggattatgctgcatgacttagctaaggttatcgagttgacggggccagaccagacagagtacacagtgcgaggtaatcttcttggacatatcgctctcattgatagcgaaattaccaagacagttatggaactcggcatcgatgataccaaggaagaagtcgttttgcttcgtcatgtcatcctcagtcaccacggcttgcttgaatatggaagtccagtccgtccacgtattatggaggcagagattatccatatgattgacaatctggatgcaagtatgatgatgatgtcaacagctctggctttggtggataaaggagagatgtccaataaaatcttcgctatggataatcgttccttctataaaccagatttagattga

SEQ ID NO: 951 - DNA, 828 bp, Streptococcus pneumoniae
atgaaattaagaagaagtgatcggatggttgtcatttccaactatttgattaataatccttataaactaactagtctcaatacttttgctgaaaagtatgagtctgctaaatcatccatctcagaagatatcgtcattatcaaacgcgcctttgaggaaattgaaatcggtcatatccagacagtgactggggctggcggaggtgtcatcttcacaccgtctatttcgagtcaggatgctaaggaaatggttgaagacttgcgtaccaagttgtcagaaagtgaccgtatcttgccaggtggttatatctatctgtctgatttgcttagcacaccagccatcttgaaaaatattggtcgtattattgccaaaagctttatggaccaaaaaattgacgcggttatgaccgtagcaactaagggtgtgccacttgcaaatgcagttgccaatgtcctcaatgtctcttttgtcattgtgcgccgtgacctgaaaattaccgaaggttcaactgttagcgtcaactatgtttcaggttcaagtggtgaccgtatcgagaaaatgttcctttcaaaacgtagtcttaaggcaggcagccgtgtcttgattgtggatgacttcttgaaaggtggcggaacggtcaacggtatgattagtctcttgcgcgagttcgactcagaactggcaggtgtagcggtctttgcggacaatgcccaagaagaacgtgaaaagcagtttgactacaagtcactcttgaaggtaactaatattgatgtcaagaaccaagccatcgatgttgaggttggcaatatctttgacgaagataaataa

SEQ ID NO: 952 - DNA, 210 bp, Streptococcus pneumoniae
gagatagaactaaaggttggaacgattgtcccagcctttctttgcaaacagaatagaaggaagcttatgaaaacaccatttatcaatagagaagagttagaagcgattgttgccgagttcccgactccctttcacttgtatgatgagaaggggattcgtgagaaggcaagagccgtcaaccaagctttttcgtggaaacaagggctttaa

SEQ ID NO: 953 - DNA, 384 bp, Streptococcus pneumoniae
ttgttgccgagttcccgactccctttcacttgtatgatgagaaggggattcgtgagaaggcaagagccgtcaaccaagctttttcgtggaaacaagggctttaaggaatattttgcagttaaggctactccaactccagctattttgaaaattctccaagaagaaggttgtggtgtggactgctctagttatgtagagcttttgatgagccataaactggactttctgggttctgagattatgttctcttccaacaacacgccagacaaggaatacgcctatgcacgtgaattgggtgcgaccattaacttggatgcctttgaagatattgaacattctggagagagcagcaggtattccagaaatcatctcttgtcgttataa

SEQ ID NO: 954 - DNA, 300 bp, Streptococcus pneumoniae
atgatttctggaatacctgctgctctctccagaatgttcaatatcttcaaaggcatccaagttaatggtcgcacccaattcacgtgcataggcgtattccttgtctggcgtgttgttggaagagaacataatctcagaacccagaaagtccagtttatggctcatcaaaagctctacataactagagcagtccacaccacaaccttcttcttggagaattttcaaaatagctggagttggagtagccttaactgcaaaatattccttaaagcccttgtttccacgaaaaagcttggttga

SEQ ID NO: 955 - DNA, 1005 bp, Streptococcus pneumoniae
gccataaactggactttctgggttctgagattatgttctcttccaacaacacgccagacaaggaatacgcctatgcacgtgaattgggtgcgaccattaacttggatgcctttgaagatattgaacattctggagagagcagcaggtattccagaaatcatctcttgtcgttataatcctggaggcgtttttgaactggggacagacattatggacaatcctggggaggctaagtttggcatgaccaaggaccagctctttgaagcctttgctatcttgaaggaaaaaggagccaagacttttgggattcactccttcctagcgtccaataccgtgacccatctctattatccagagttggctcgtcagctctttgaactggctgttgaaatcaaggaaaagttgggcatttggctagactttatcaatctttctggcggtattggtgttaattatcgtccagaccaggagccgaacgatatcgccttgattggtgagggagttcgtaaggtgtatgaagaagttcttacgtcagcaggtcttggtcaggtcaagattttcaccgaattgggtcgttttatgctggcacctcacggtgctctagtcacaagagtgactcataagaaggaaacctaccgtacctatctaggtgtggatgcctcagcagtcaacctcatgcgtccagctatgtacggagcttaccatcatattagcaacgtgacccatccagatggaccagctgaagcggtagatgtggttggttcactctgtgaaaacaatgataaatttgcagtcaatcgcgaactgcctcatacagaaatcggtgatttgctggtaattcatgatacaggtgcccacggattttcaatgggctaccagtataatgccaaattacgttctgcggaaatcctctataccgaagaaggtaaagcccgtcaaatccgccgtgcagagcgccctgaggactattttgcaaccttatatggcttcgattttgaagaataa

SEQ ID NO: 956 - DNA, 795 bp, Streptococcus pneumoniae
atgtctgaagaaacaattgattatggacaagtgacaggaatggtgcattcgacagaaagctttgggtcagtagatgggcctggtattcgctttattgtctttttgcagggctgtcacatgcgttgccagtattgccacaacccagacacttgggctatggagtccaataagtcacgtgaacggacggtagatgatgtcttgacagaggccttgcgctaccgtggtttctggggaaataagggtgggattacagtcagtggaggagaagctctcttgcagattgatttcctgattgctctcttcaccaaggctaaggaacaaggaatccactgtaccttggatacctgtgctcttcctttccgtaataaaccacgttaccttgagaagtttgacaaactcatggctgtcactgacttggttcttttggatatcaaggaaatcaacgaagaacagcacaagattgtcactagccaaactaataaaaatatcttggcttgtgcccagtatctatcagatattggaaaacctgtctggattcgccacgtgctagttccaggattgacagacagagatgatgacttgattgaacttggtaagttcgtcaagaccctcaaaaatgttgataagtttgaaattctaccttatcacaccatgggtgagttcaagtggcgtgaacttggaattccatattccctcgaaggagtcaaaccaccaacagcagatcgcgtcaagaacgctaaaaaactcatggataccgaaagttatcaagattatatgaaacgtgtacatggatag

SEQ ID NO: 957 - DNA, 927 bp, Streptococcus pneumoniae
gtgaaatctattaaacgttttgcactctcggctatgggagtggctatgttgcttgtcttgactggctgtgtcaatgtcgataaaaccacaggtcagccaacaggatttatttggaatacgatcggagcgcctatggctgaagccatcaagtacttcgctactgataaaggtctaggctttggtgtcgctatcattatcgtaaccattatcgtacgcttgattatcttaccacttggtatctaccaatcatggaaggcaacgcttcactctgaaaagatgaacgccctcaagcacgtccttgagccacaccaaacgcgtctcaaagaagcgactactcaagaagaaaaactcgaagcccaacaagctctctttgctgctcaaaaagagcacggtatcagcatgtttggcggtgtaggatgtttccctatcctccttcaaatgcctttcttctctgctatctactttgctgcccaacatactgaaggggttgctcaagcaagctacctaggcattcctctaggttctccaagtatgattttggttgcctgtgctggtgtcctttactatcttcaatcgctcctttcacttcacggagtagaagatgaaatgcaaagagaacaaatcaagaaaatgatttacatgagcccactcatgatcgtcgtcttctccctcttctcaccagctagtgtcacactttactgggttgtcggtggtttcatgatgattctccaacagtttatcgtcaactatatcgttcgtccaaaacttcgcaaaaaagtccgtgaagaactagccaagaacccaccaaaagcaagtgctttctctaaaccaagtggacgaaaagacgttacccctgaacaaccaactgctatcacaagcaagaaaaaacacaaaaatcgtaacgctggaaaacaacgttcgagataa

SEQ ID NO: 958 - DNA, 279 bp, Streptococcus pneumoniae
atgcaaaaggttagaatgattgcccaaggtagggtgcagggagtcggctttcgttggggtgtttatagcctggcccttgaaatcggtggcatcacaggtcgggtatggaataacgacgatggcacagtggaaatcttagcccaagcagactcatcagctattatggcaaaatttatccaagaaatccgaaaaggaccgacacctttttcaaaagtcagttacttagatgtcaaactgagcaactttcctccctaccctgactttaaaatcgcaaattag

SEQ ID NO: 959 - DNA, 759 bp, Streptococcus pneumoniae
ttgtgttataatatttctatgactattataacctcaaaagccaattctgtggtaaaaaataccaagaaattacaccaaaaaaaataccgcaagtcagcctatttgattgaaggctggcacttgtttgaagaagctgttcaagctggagtgacgattgagaaaatctttaccctagaaaattatcgagatcagttagcaactttttcgcaaactgtctgggtgtcagaggatattttgctagatttggcggattctcagactccacagggaattgtggccgtggttcaaaaagaagaagtaggacaagctgatttgagtcagggcaagttcttgtttttggaagatgtgcaagatcctggtaatgtaggaactatcattcgaactgcggatgcagcaggttttacaggagtgattgtttcagataagtcggcagacatctacagtctcaaaaccctacgttccatgcaaggtagtcatttccatctgcccatttaccggatgactagtcaagcgcttcttgacgaaactaaaaaggtagctatcccagtgctagcaacaaccctatctaaagattctgttgattacagagaactgccttctatagaaaattttgtactagttatgggaaatgagggtcaaggaattagtccccttatggctgaaagtgcagaccagttggtccatattagcatgaaggggcaggccgagagtttgaatgttgcggttgcagccggtattttaatcttccatttaagctaa

SEQ ID NO: 960 - DNA, 684 bp, Streptococcus pneumoniae
atgaatcacactattatacatgaccgtgcaggtctcaatcaattttacgctaaggtttatgcctttgttggtctgggaatcggactatctgctttggtatcaggccttatgttgacggtctttcagtctcagttggtttactttttgatgcaggggcgtctctggttgaccattgctacttttgcggagttggctttggttttcgttgccagtagcatggcttcaagaaatagtccagctgctcttccagtatttttactttactccgttttaaacggctttacccttagttttgtggtggctttctatactccgggtacagttttatctgcctttgtatcgagcgcccttctcttctttgtcatggcggcagttggtatttttaccaagaaagacttgagtgggattggtcgagcaatgatggcagctctcattggtttactgattgctatggtagtcaatattttcttggctagtggcttctttgattatatgattagcgtagccatggttttggttttttcagggttgattgcttgggataaccaaaagattcgcctcgcctatgaacaatcacaaggtcgtgtagcgacaggctgggtggtgtcaatggctctcagcatctatcttgattttatcaatcttttcctaagtattctacgtatctttggtcgcaatgactaa

SEQ ID NO: 961 - DNA, 216 bp, Streptococcus pneumoniae
cttatctttcaaatactgggtaaaagtgtttttgacaaaggaaatttcttcttgttgatggataaaacttttcttcatagacaactcctcaaaaatttaataaacgtattatacacctatttccaagaaaagaaaagagaaaatttaaaaaaaatcagtgtcactcaaaacactgatttcatagaccttttagtcattgcgaccaaagatacgtag

SEQ ID NO: 962 - DNA, 993 bp, Streptococcus pneumoniae
atgaagaaaagttttatccatcaacaagaagaaatttcctttgtcaaaaacacttttacccagtatttgaaagataagctagaagttgtcgaagttcaaggtcctatcttgagtaaggtcggtgacggaatgcaggacaacctgtctggtgtggaaaatccagtatcggtcaaggttctccaaatccctgatgctacttatgaagtggtgcactcacttgctaaatggaaacgccacaccttggctcgttttggctttggtgaaggagagggtctctttgtccacatgaaagcccttcgtccagatgaggattccttggatgcaacccactctgtttatgttgaccagtgggactgggagaaggttatcccaaatggtaagcgtaacatcgtttatctaaaagaaacagttgagaagatttataaggctattcgcctgactgagctagctgttgaagcccgctatgacatcgagtctatcttgccaaaacaaatcacctttatccatacagaagaattggtagaacgctacccagacttgacaccgaaagaacgtgaaaatgcgatttgtaaagaatttggagccgtctttttgattggtatcggtggcgagttgccagatggtaaaccgcacgatggacgtgcaccagactatgatgactggacaagcgagtctgagaatggctacaagggtctaaatggtgatattcttgtctggaatgagtctttaggtggagcctttgagttgtcttctatgggaattcgtgtagatgaagaaactcttagacgtcaggtggaaattacaggtgatgaagaccgcttggaattggaatggcacaagtctttgttgaatggtctattcccattgacaatcggtggaggaattggacaatctcgtatggccatgttcctacttcgcaagagacacatcggagaagtgcaaacaagtgtttggcctcaagaagtccgcgatacttacgaaaatattttgtag

SEQ ID NO: 963 - DNA, 540 bp, Streptococcus pneumoniae
atgaaaatcgtatcaggaatctatgggggacgtcccctcaagacactagaaggcaagacgacaagacctacttcggataaggttaggggagccatttttaacatgattggtccctactttgaagggggacgagtcttggacctttatgcaggtagtggtggtttatctatcgaagcagtatcgcgtggcatgtccagtgctgttttggtggagcgagaccgtaaggctcagaccatcgtggctgaaaatatccagataaccaaggaaattggaaaatttcaactcctcaagatggatgcagaaagggcattggaacaggtatctggggaatttgacctcgttttcttagaccctccctataccaaggaacaaatcgtagcagatattgaaaaaatggctgagagagagcttttttctgaagatgttatggttgtgtgcgagacggataaggccgttgaacttccagaagaaattgcctgtctgggtatctggaaggaaaagatttatggaattagtaaggtgacagtctatgtcagataa

SEQ ID NO: 964 - DNA, 357 bp, Streptococcus pneumoniae
tatgtcggtattttttttaatccccacaaacaaggatttcttcctatcgaaaatcgtaaacgggggctagaaaaggctttgggacatctggaaaatgttgaagtcgtggcttctcatgatgaattggtggtcgatgttgcaaaaagattgggtgctacttgtctagtgcgtggtttgaggaatgcgtcggatttgcaatatgaagccagttttgattactacaatcatcagctgtcttctgatatagagactatttatttacatagtcgacctgaacatctctatatcagttcatcaggcgttagagagcttttgaagtttggtcaggatattgcctgctatgttcccgagagtatt

SEQ ID NO: 965 - DNA, 717 bp, Streptococcus pneumoniae
atgaaaaaaaagattagatggcccttatacgtcattgcggccttgattgtgactttcttggcatttgtagtgcccttgccttattatatagaggttccaggtggttcggaagatattcgccaagtccttaaaataaatgacacagaagataaggaagctggtgcctatcaattcgttacggttggtgttcaacatgccactttagctcatatgatttatgcttggttgacaccttttacagatattcgtagtgctcaggagactacaggtggttcttccgatgttgaatttatgcgaatcaatcaattctacatgcaaacatcgcaaaatatggccaagtatcaaggactaaaaacagctggtaaggatatcgaactcaagtactttggagtttatgttttgaatgtgacggataattcaacctttaaagggattctcaatatctctgatacagtcacagcagtcaatgatcagacctttgatagttccaaagacttgattgattacgtcagttctcaaaaattaggggattccgtcaaggtcacctatgaagaggatgggcaaaccaagtctgcagaaggaaagattatcaccttggaaaatggcaaaaatggaattggaatcggcttgattgaccgtacagaggtaatcagcaatgtcccaattagcttttcaacaagctggtattggcggtccaagtgctggtctcatgtttag

SEQ ID NO: 966 - DNA, 234 bp, Streptococcus pneumoniae
gtgggagacattggaggtattgataagaaggttgtagcttcggctagggcaggtgctgctattttctttgctcctgataaccctgttagcgaagaagaacaaaaggcgcatccggacgcgaaaaacaactaccaaacagccctagaagcggctaaaacaatcaagacggatatgaaaatcgtgcccgttaaaaccctacaagatgcgattgattacttgaaaaacaatccctaa

SEQ ID NO: 967 - DNA, 285 bp, Streptococcus pneumoniae
ttgagtgaagtttccaaactagcgcacaaacatagaagatggtataatagtcaaatggttcaattattattcactctaagtagtcatatgctctttatttatgtgagtttttaccttttaaaggatcttgttagatgggagaaggttttaaaagtgacagatgagaatacaagaaaagttcgtttattagtagccttttttagcattgtcataggctacatcctgagttctttctttattagcctgtatcatttgtggcaagaagcgcttagaggattattatga

SEQ ID NO: 968 - DNA, 1284 bp, Streptococcus pneumoniae
atggataaaattgtggttcaaggtggcgataatcgtctggtaggaagcgtgacgatcgagggagcaaaaaatgcagtcttacccttgttggcagcgactattctagcaagtgaaggaaagaccgtcttgcagaatgttccgattttgtcggatgtctttattatgaatcaggtagttggtggtttgaatgccaaggttgactttgatgaggaagctcatcttgtcaaggtggatgctactggcgacatcactgaggaagccccttacaagtatgtcagcaagatgcgcgcctccatcgttgtattagggccaatccttgcccgtgtgggtcatgctaaggtatccatgccaggtggttgtacgattggtagccgtcctattgatcttcatttgaaaggtctggaagctatgggggttaagattagtcagacagctggttacatcgaagccaaggcagaacgcttgcatggtgctcatatctatatggactttccaagtgttggtgcaacgcagaacttgatgatggcagcgactctggctgatggggtgacagtgattgagaatgctgcgcgtgagcctgagattgttgacttagccattctccttaatgaaatgggagccaaggtcaaaggtgctggtacagagactataaccattactggtgttgagaaacttcatggtacgactcacaatgtagtccaagaccgtatcgaagcaggaacctttatggtagctgctgccatgactggtggtgatgtcttgattcgagacgctgtctgggagcacaaccgtcccttgattgccaagttacttgaaatgtgtgttgaagtaattgaagaagacgaaggaattcgtgttcgttctcaactagaaaatctaaaagctgttcatgtgaaaaccttgccccacccaggatttccaacagatatgcaggctcaatttacagccttgatgacagttgcaaaaggcgaatcaaccatggtggagacagttttcgaaaatcgtttccaacacctagaagagatgcgccgcatgggcttgcattctgagattatccgtgatacagctcgtattgttggtggacagcctttgcagggagcagaagttctttcaactgaccttcgtgccagtgcagccttgattttgacaggtttggtagcacagggagaaactgtggtcggtaaattggttcacttggatagaggttactacggtttccatgagaagttggcgcagctaggtgctaagattcagcggattgaggcaagcgatgaagatgaataa

SEQ ID NO: 969 - DNA, 225 bp, Streptococcus pneumoniae
gtgctaagattcagcggattgaggcaagcgatgaagatgaataagaaatcaagctacgtaatcaatcgtttacttttagtcatcatagtactgattttaggtactctggctctaggaatcggtctaatggtaggttatggaatcttgggcaagggtcaagatccatgggctatcctgtctccagcaaaatggcaggaattgattcataaatttacaggaaattag

SEQ ID NO: 970 - DNA, 825 bp, Streptococcus pneumoniae
atgaacaaaaaaacaagacagacactaatcggactgctagtgttattgcttttgtctacagggagctattatatcaagcagatgccgtcggcacctaatagtcccaaaaccaatcttagtcagaaaaaacaagcgtctgaagctcctagtcaagcattggcagagagtgtcttaacagacgcagtcaagagtcaaataaaggggagtctggagtggaatggctcaggtgcttttatcgtcaatggtaataaaacaaatctagatgccaaggtttcaagtaagccctacgctgacaataaaacaaagacagtgggcaaggaaactgttccaaccgtagctaatgccctcttgtctaaggccactcgtcagtacaagaatcgtaaagaaactgggaatggttcaacttcttggactcctccaggttggcatcaggtcaagaatctaaagggctcttatacccatgcagtcgatagaggtcatttgttaggctatgccttaatcggtggtttggatggttttgatgcctcaacaagcaatcctaaaaacattgctgttcagacagcctgggcaaatcaggcacaagccgagtattcgactggtcaaaactactatgaaagcaaggtgcgtaaagccttggaccaaaacaagcgtgtccgttaccgtgtaaccctttactacgcttcaaacgaggatttagttccctcatcttcacagattgaagccaagtattcggatggagaattggaattcaatgttctagttcccaatgttcaaaaaggacttcaactggattaccgaactggagaagtaactgtaactcaataa

SEQ ID NO: 971 - DNA, 984 bp, Streptococcus pneumoniae
  unsure (892): n at each above location is unknown.
tcagaatttgttgctacatttaacatagtgtttatcttgacgggattaatgccttttttgccagccacaaaaatggcaatggttttttttaatcgtgcccgagttgaccaaaaggggaattatggagacacccgctacttccgcctgttgaaggtactagaaaatcttaaccgctttttatcaaccattcaggtaggaatcaccctgattacaatcttatcaggggcgagtttaactaatactctaggacgtgtgattgcctcttggcttgggaatggcgaaacagcacaagccgtggcaacttttctatccttggcatttttgacctatatttccatcgtttttggggaattatatcctaagagaatcgctcttaatctaaaggatgccttggcaattcgtacagcgccggttatcattgggatcggaaaactagtcagtccttttgtttggcttttagctgcttcgaccaatttcttgagccatttgactcctatgtcattcgatgatgcggatgaaaagatgacccgtgatgaaattgcctatatgctgacaaatagtgaagaaacattggatgctgatgagattgagatgctacaaggtgtcttttcgctcgatgaactgatggcacgagaggttatggttcctcgaacggatgcctttatggtggatattcaggatgatagtcaagccattatccaaagtattttaaaacaaaattattctcgtatcccggtttatgatggggataaggacaatgtaattggaatcattcacaccaagagtctccttaaggcaggctttgtggacggttttgacaatattgtttggaagagaattttgcaagatccactttttgtacctgaaactatttttgtggatgacttgctanaagaactgcgaaatacccaaagacaaatggcgatcttgctggatgaatacagtggtatggctgggttggtgactttgggaaaactcttataa

SEQ ID NO: 972 - DNA, 285 bp, Streptococcus pneumoniae
  unsure (156): n at each above location is unknown.
ctttgggaaaactcttataaggaaattgttggtgaaattgatgatgaaacggacaaagcagcaatagatgttcatcagattggcgaagatacctacattgttcaaagaactatgaccctcaatgatttcaataattactttgatgttgaactgganagtgatgacgttgataccatcgctggttattatttgacaggagtgggaactattccaacgactgagaaactcagctatgaattggttagccaaaacaaacagtttatcttaaccaatgataaagtatag

SEQ ID NO: 973 - DNA, 3612 bp, Streptococcus pneumoniae
ttggcaggacatgacgttcaatacgggaaacatcgtacccgtcgtagtttttcaagaatcaaagaagttcttgacttaccaaatttgattgaaattcaaactgactcattcaaagctttcctagaccacggtcttaaggaagtgtttgaagatgtattgccaatttcaaacttcacagacacaatggagttggaatttgttggatatgaaatcaaggaaccaaaatatacgctagaagaagctcgtatccacgatgctagctactcagcaccaatttttgtaaccttccgtttgatcaataaagaaacaagcgaaatcaagacccaagaagttttctttggtgatttcccaatcatgacagaaatgggtactttcatcatcaatggtggtgaacgtattatcgtttctcagttggtccgctcaccaggtgtttactttaacgacaaagtagacaaaaatggtaaggtgggctatggttcaactgttatccctaaccgtggagcttggttggaacttgaaagcgactcaaaagatatcacctacactcgtatcgaccgtactcgtaagattccatttacaaccttggttcgtgctcttggtttctcaggtgatgatgaaatctttgatatctttggtgacagcgaattggttcgcaacactgttgaaaaagatatccacaagaatccaatggactctcgtacagacgaagccttgaaagaaatttacgaacgccttcgtccaggtgagcctaagacggctgaaagctcacgtagcttgcttgtagctcgcttctttgacccacgtcgttatgacttggcagcagttggtcgttacaaaatcaataaaaaactcaatgttaaaacacgtttgctcaaccaaaccattgcagagccattggtagaccctgaaactggagaaatcttggtagaagctggtacgattatgactcgtagcgtgattgaaagcattgaaagccatttggatggcgacttgaacaagattgtctacatcccaaacgatgcagccgttgtgactgagcctgttgttcttcaaaaattcaaggttattgctccaactgatccagatcgcgtcgtaacgatcattggtaatgctaacccagatgacaaggttcgtacggtgactcctgcagatatccttgctgagatgagctacttcctcaacttggctgaaggacttggccgtgtagatgatatcgaccaccttggaaatcgtcgtatccgtgcggttggtgaattgcttgccaaccaagtacgtttgggactttctcgtatggaacgtaatgtccgtgaacgtatgtctgttcaggacaatgaagtcttgacaccacaacaaattatcaatattcgtcctgtaacagctgcagttaaagaattctttggttcatcacagttgtcacagttcatggaccaacacaacccgctttctgagttgtctcacaaacgccgtttgtcagccttaggacctggtggtttgactcgtgaccgtgccggatatgaagtgcgtgacgtgcactacactcactatggtcgtatgtgtccaatcgagacacctgaaggacctaacatcggtttgatcaataacttgtcatcttacggacacttgaacaaatatggttttgttcaaacaccataccgtaaggttgaccgtgaaacaggtgttgtcacgaacgaaattgtttggttgacagctgatgaagaagatgaatatactgtagctcaggctaactctcgtctgaatgaagatggaacctttgctgagaagattgtcatgggacgtcaccaaggggtcaaccaagagtatccagctaatattgttgactacatggacgtttcaccaaaacaggtagttgccgttgcgacagcatgtattcctttcttggaaaacgatgactccaaccgtgccctcatgggagccaatatgcaacgtcaggctgtgccattgattaatcctcaggcaccttacgttggtactggtatggaataccaagcagcccacgattctggtgcggctgtgattgctcagtatgatggtaaagttacttacgcagatgctgacaaggtagaagttcgtcgtgaagatggttcattggatgtttaccacatccaaaaattccgtcgttcaaactcaggtactgcttacaaccaacgcactctcgtaaaagttggtgatgtcgttgaaaaaggcgatttcatcgctgacggaccttctatggaaaatggagaaatggcgcttggacaaaacccaatcgttgcctacatgacttgggaaggctacaacttcgaggatgccgttatcatgagcgaacgcttggtgaaggacgatgtctacacatctgttcaccttgaagaatacgaatcagaaacgcgcgatacaaagcttgggcctgaagaaatcactcgcgaaattccaaacgttggtgaagatgccctcaaagaccttgacgaaatggggattatccgtattggtgctgaggttaaagaaggtgatattcttgtagggaaagtaacacctaagggtgagaaagatctttcagctgaagaacgtctcttgcacgctatctttggagacaagtctcgtgaagtgcgtgatacttctcttcgtgtaccacacggtgccgatggtgtcgttcgtgatgttaagatctttacacgtgtaaatggagatgagttgcaatcaggtgttaacatgttggttcgtgtttacatcgctcaaaaacgtaagattaaggtcggagataaaatggccggacgtcacggaaacaaaggggttgtctctcgtatcgttcctgtagaagacatgccttaccttccagacggaactccagtcgacatcatgttgaacccacttggggtgccatcacgtatgaatatcggtcaggttatggagcttcaccttggtatggcagctcgtactcttggtattcacattgcgacaccagtctttgatggagcaagttctgaagatctttggtcaactgttaaagaagcaggtatggatagcgatgccaagacaatcctttacgatggacgtacaggtgaaccatttgataaccgtgtttctgttggagtcatgtacatgatcaaactccaccacatggttgacgataaattgcatgcgcgttcagtcggaccttactcaactgttacccaacaaccactcggaggtaaagctcagtttggtggacaacgtttcggtgagatggaggtttgggctcttgaagcctacggtgcgtcaaatgtccttcaagaaatcttgacttacaagtcggacgatatcaacggacgtttgaaagcctatgaagctattacaaaaggcaaaccaattccaaaaccaggtgttccagaatccttccgagttcttgtcaaagaattgcaatctcttggtcttgacatgcgtgtcctagacgaagatgaccaagaagtggaacttcgcgacttggatgaaggaatggacgaagatgtcatccacgtagatgaccttgaaaaagcccgcgaaaaagcagcccaagaggctaaagcagcctttgaagctgaagaagctgagaaagcaacaaaagcggaagcaacagaagaagctgctgaacaagaataa

SEQ ID NO: 974 - DNA, 348 bp, Streptococcus pneumoniae
atgttaacacctgattgcaactcatctccatttacacgtgtaaagatcttaacatcacgaacgacaccatcggcaccgtgtggtacacgaagagaagtatcacgcacttcacgagacttgtctccaaagatagcgtgcaagagacgttcttcagctgaaagatctttctcacccttaggtgttactttccctacaagaatatcaccttctttaacctcagcaccaatacggataatccccatttcgtcaaggtctttgagggcatcttcaccaacgtttggaatttcgcgagtgatttcttcaggcccaagctttgtatcgcgcgtttctgattcgtattcttcaagg

SEQ ID NO: 975 - DNA, 171 bp, Streptococcus pneumoniae
atgacatcttcgtccattccttcatccaagtcgcgaagttccacttcttggtcatcttcgtctaggacacgcatgtcaagaccaagagattgcaattctttgacaagaactcggaaggattctggaacacctggttttggaattggtttgccttttgtaatagcttcatag

SEQ ID NO: 976 - DNA, 3678 bp, Streptococcus pneumoniae
gtggttgatgtaaatcgttttaaaagtatgcaaatcaccctagcttctccaagtaaagtccgttcatggtcttatggagaagtcaaaaaacctgaaacaatcaattatcgtaccttgaaaccagaacgtgaaggactctttgatgaagtgatctttggtcctacaaaagactgggaatgtgcttgtggtaagtacaaacgcattcgttacagaggaattgtttgtgaccgctgtggggttgaagtaacgcgtacgaaagttcgtcgtgagcgtatgggacatatcgaattgaaagctcctgtatctcacatctggtacttcaaggggattccaagccgtatgggcttgacccttgatatgagccctcgtgccctcgaggaagttatctactttgcggcttatgtggtgattgatcctaaggatacaccacttgagcacaagtctatcatgacagagcgcgaataccgagagcgcttgcgcgaatatggttatggttcatttgttgccaagatgggtgcggaagccatccaagaccttttgaagcaagtagatcttgaaaaagaaattgctgaactcaaagaagaattgaaaacagctactggacaaaaacgtgtcaaagccatccgtcgtttggatgttttggatgccttttacaagtctggaaacaaacctgaatggatgattcttaacattcttccggttatcccaccagatcttcgtccaatgttgcagttggatggtggccgttttgcctcatctgacttgaatgacctttaccgccgtgttatcaaccgtaacaaccgtttggctcgtttgcttgagttaaatgcaccaggtatcatcgttcaaaatgagaagcgtatgcttcaagaagcagttgacgctttgattgacaatggtcgtcgtggtcgtccaatcacaggaccaggtagccgtccattgaaatcattgagccacatgcttaaaggtaaacaaggacgcttccgtcaaaacttgctcggtaaacgtgttgacttctcaggacgttccgttatcgccgttggtccaactcttaagatgtaccaatgtggtgtgccgcgtgaaatggcgattgaactctttaaaccatttgtcatgcgtgaaatcgttgcccgtgatatcgtgcaaaacgtcaaagcagctaaacgcttggtggaacgcggagatgagcgtatctgggatatccttgaagaagtgattaaagaacacccagtgcttttgaaccgcgcaccgacccttcaccgtttgggtatccaagccttcgagccagtcttgattgatggtaaggctcttcgcttgcacccacttgtctgtgaagcctacaatgctgactttgacggggaccaaatggccatccacgtaccactttcagaagaagcacaagcagaagctcgtatcctcatgctagctgctgagcacatcttgaacccgaaagatgggaaaccggtagttactccatctcaggacatggttttgggtaactactacttgaccatggaagaagctggtcgcgaaggtgaaggaatggtcttcaaagaccgtgacgaagcggttatggcttaccgcaatggttatgttcacctccactcacgtgttggtatcgcaacagacagcctcaacaagccttggacagaagagcaaagacataaggtcttgcttacaacagttggtaaaattctcttcaacgatatcatgccagaggggctaccatacttgcaagaaccaaacaatgccaacttgacagaaggtgttccagctaaatacttcttgccacttggtggagatatcaaggaagctatcagcaatcttgagctcaaccctccattcaagaagaaaaaccttggaaatatcatcgctgaaatcttcaaacgtttccgtacgacagaaacttctgccctacttgaccgcatgaagaacctcggttaccaccactcaactcttgcaggattgacagtgggtattgccgacatcccagtcgttgatgacaaggctgaaatcattgaagaatcacacaaacgtgtcgaacaaatcaccaaacaattccgtcgtggtatgatcacagacgacgagcgttacaatgctgttacagctgaatggcgtgctgcccgtgaaaaacttgagaaacgcttgattgctaaccaagatcctaagaacccaatcgttatgatgatggactctggagcccgtggtaacatctcaaacttctcacagcttgccggtatgcgtggtctgatggctgctccgaatggacgtatcatggaattgccaatcctttcaaacttccgcgaaggtttgtcggtattggaaatgttcttctcaactcacggtgctcgtaaaggtatgaccgatacggcccttaagacagccgactcaggttacttgactcgtcgtttggtcgacgttgcccaagacgttatcatccgtgaggacgactgtggaactgaccgtggtctcttgatccgttctatcgcagaaggaaaagagatgatcgagtctctcgaagagcgtctcaacggtcgttacactaagaaaactgttaaacatccagaaactggtgcagtgattattggtccaaatgaattgattacagaagacaaggcgcgtgaaattgtcaatgctggtgtggaagaagtgactatccgttctgtatttacatgtaacactcgtcacggtgtctgccgtcactgttacggtatcaacttggcgactggtgatgcggttgaagttggtgaagcagttggtacaatcgctgcccaatctatcggggaacctggtacacagcttacaatgcgtaccttccacacaggtggggttgcctcaaataccgatatcactcagggtcttcctcgtgtccaagaaatctttgaagcccgcaatcctaaaggggaagcggttatcacagaggttaaaggacaagttactgctatcgaagaggatgcatcaactcgtaccaagaaagtctttgttaagggtgaaactggcgaaggtgaatatgtcgttccatttacagctcgtatgcgtgtcgaagttgggggccaagtagcgcgtggtgctgctctgacagaaggttctatccaaccaaaacgtctccttgcagttcgtgatgtcttgtcagttgaaacgtaccttctcggtgaagtacaaaaagtttaccgtagccaaggggtagaaatcggtgacaaacacatcgaggtaatggttcgtcaaatgatccgtaaagtccgtgtcatggatccaggtgatacagatcttctcatgggtaccctcatggatatcaatgactttacagatgccaacaaagatgtccttatcgcaggtggagttccagcgacaggtcgcccagtccttatgggaattaccaaagcctcacttgaaacaaacagtttcttgtcagcggcttccttccaggaaacaactcgtgtccttactgacgcagctatccgtggtaagaaagaccatctccttggacttaaagaaaatgttatcatcggtaagatcatcccagctggtactggtatggcccgttaccgtaaccttgaaccacatgctgtcaacgaagaagaataccttaatcctccagtagaggaagaaggaaatgaagaaacaacagaagtagttgtggatactgccgttgaaactgtggaagaaacagtagaataa

SEQ ID NO: 977 - DNA, 393 bp, Streptococcus pneumoniae
atgtgtgttccatacccgtctcctttgtcagcttctttcttttattttaccacatttcgtggaaaaatggagaaagttttcagaagagagaatgagagaacccgagggttctctcattctctcttattctactgtttcttccacagtttcaacggcagtatccacaactacttctgttgtttcttcatttccttcttcctctactggaggattaaggtattcttcttcgttgacagcatgtggttcaaggttacggtaacgggccataccagtaccagctgggatgatcttaccgatgataacattttctttaagtccaaggagatggtctttcttaccacggatagctgcgtcagtaaggacacgagttgtttcctggaaggaagccgctga

SEQ ID NO: 978 - DNA, 414 bp, Streptococcus pneumoniae
atggaacacacattctttatcatcaaaccagatggtgtaaaaagagggctagtgggtgaagtgttaaagcgcatcgaacaacgtggatttacaatcgaaaaattggagtttcgttcacaggtttcagaagagttgattgaccagcactatcaggacttggttggtcagagtttttacccaccgattcgtgaattcatgacttcaggtccagttcttgtgggtgtcatttctggtcccaaagtaatcgaaacttggcggaccatgatgggtgcaactcgtccagaagaagctttaccaggcactattcgaggtgattttgcaaaagctgctggagaaaatgagattatccaaaatgttgtacatggttcagattcagaagagtcagctaagcgagaaattgctctttggttttaa

SEQ ID NO: 979 - DNA, 279 bp, Streptococcus pneumoniae
atgaaaaaattcgacaattatattattgagaagccttgcgattctaattcagataaactgcaaaaaatcttaataattgaaaatttggtagatgatattttgcaattttctctcagaatcaataatagtgtaggagagattttcctcctacaaccgtttcaaaagaaaactatctttattccatgttattttgaggaagatattgtgaaagtcaaagatgatgataaagttgagtggaatttgttagaatttcaaaaatttagagcatttttggcttag

SEQ ID NO: 980 - DNA, 633 bp, Streptococcus pneumoniae
atgattgaacttaaacaggtgagtaaatcttttggagaacgagagttattttcgaatctttcaatgacatttgaggctggaaaagtctatgccttaattggttcaagtggtagcggaaaaacaaccttgatgaacatgattgggaaattagaaccttatgatgggacgattttttaccgaggtaaagacttggccaattataaatcgagtgattttttccgtcacgaattgggttacctcttccagaactttggcttaattgaaaaccaaagtattgaagaaaaccttaagctaggtctcactggtcaaaagttgagtcggtcggaacagcggttgaggcagaagcaggctttagaacaggtcggcctggcttatcttgacctagataagcgcatctttgagttatcgggcggagaatcgcaacgggttgccttggcaaaagttatcttaaagaatccaccctttattctggcagatgagccaacagcttcaatagacccagcaacctctcagttgattatggagattttgctatctcttcgagatgataataggctaatcattatcgcaacacataatccagcaatttgggagatggctgatgaagtgttcacgatggatcgtctgaaataa

SEQ ID NO: 981 - DNA, 2016 bp, Streptococcus pneumoniae
atgaaaaaattatttatactcatatccaacctgcttgctagtttgttctttgtttgggtatttaccatttggactgatacatatgtctcctattattactccaacgttgttgtacatgattcttcccctgaaacaacttttcagcatgttgctacacgcttggaaaaactagcagaagaaacagatagctttattgcgattcaacaccaagatcctaactcagaaggtactacagttttttcttatacgacctttggggacggaaagttgcctgatgggcttcaggaaaaaaaactagaagatgctcaaagtagtagtgttgaaacaaactattttgtattcgatggacacctagatattcacttgctaagggaggagctaagtcaacttggcttgactaacatgaacctgacaattccatctaaactatctacgttaatggctatctttagtaacggatttcagttaatcagtctattgattttcatcttaacctttgtagcactgactttaattagtcaaattagccaattacggtcgtcgggcattcgcctcatttcaggagagaaacggtggtccattttccttagaccagttggtgaggatttgaaagggatagctgttggtttcagtttagctggcgtgctcgccattcttatgcaaaaaattctgtcgcttccaacgcaatccctaatgaccataggagcaggcttgctcagttataatctcatcttgttgtcgatctccctgtttttcgctcaactcttcgcagttgggataaaaaagatacacctgatgcagattataaaagggcaagtgcctgtcagaggaatcattagtttgattttaatcggtcaactattagcgattattattgtaacgctgggaatagggagtagcttaaagtattcccaagcctggcaacagcatcggattggacaagaggcttggagtcaggaaaggcaactgattaccctatcaatcagccgtgaaggaacgagtcctggttttgatgaacaagctcaaaggaaactcagaacttggtatcaattgatggatctggctgtttcagaacaaaaggctttcttatctagacaccagttaattgaccgtactttgcaaaatggcatggcttcctccaaaaacttgataacctctacagaatggcacgattacaacccgaatggcaatgtccttatcgtcacaccgcaatacttggagcgtcaaaacattcctgtagatacaactattgagcaaaagatgaatcaccttgatgtaggggagtttgtcttattgctgcctgaacacctccgttcagaggaagaacattataaatctgtttttgaagacgacttaaccagtcgcatgtctagtcaagatgaacgacagcaaatgactgctacggtaggttatttagaatcaggtcaggatcgttttgtgtataatacgacccctatttcttaccagcagtttttgaaagatccaatcatcattgttataacaccccaatcaactggtccacagtccattttgttttggatagacgcagtacagaactacgttctctttaatcaattgtctgatgcccaggagcttatccagagacaaggcattgaaaattgggtctcagaaatgcaaacaggttaccacaactacatcacattattggataatatccagagggaacgttgggtaatgctagcaggagctgtgcttgggattgcaacttcaatcttgttgtttaacactatgaataggctctactttgaagaatttagacgtgccatttttatcaaacgcattgcaggtctcaggttcttagaaatccatcgcacttatctctttgctcaactgggtgtgtttttactgggatttgttgcgagtgtatttcttcaggtagagataggagttgctttcttagtcttgttactctttactggtctatctcttttacagttacatgtccaaatgcagaaagaaaacaagatgtccattcttgttttgaagggaggttaa

SEQ ID NO: 982 - DNA, 195 bp, Streptococcus pneumoniae
atgaaaaagaaaagggtttcacgaatgaagaaaaatcgtggaattcaaaaattagctatattagtattactaggtgtttttatgtttagtaatacaattccttaccaacagtttattcagaagaatagacaattggagattcgagtgcaatcgcaaaagaagtccaatggtcttgatgttgggaaggctgattga

SEQ ID NO: 983 - DNA, 864 bp, Streptococcus pneumoniae
atgaatacactcgcagagaaattcagattgaaaagaaaagagttgagactctcccaacaaactcttgcagaaggaatttgtgaacaaagtcagattagtaaaattgagagagggcatttcattccctccgcagaccttttgttcaaactctctcaacgacttgaagtaccattagattatttttttaatgaacaaattgaaattaaatctaacctctctaatttcaagcaattgtctgctcgactattagacgatagaaattatgacgatttggaatatatttatagaatagagattgaacgaagtacttttctaacactagaagaccgaacttaccttgaatggattaaagctattattgacttctatcaatatgacagtaagtgtgaggcaatttcttcattggaaaatatattattaaaagtctcttcaaatactctgatttatttaaaggcgttgaatactctatctaatttctattccttagtgggtcgtgaacaagaatatgaggcaaactactctcatttaatagagttgtatcagacaaaaaatttggaccatcaagagtttttatttggctacatcagagttcgttacaactacgctcactacctagtatcaaaggaaaaatataatgaagccatccaagaagctcttgaaacgattgaactctgtaaacaaagacagacaagctaccaattggctcctctacttattcttgtaggaaatgctggagccaaatttctagacagagaacaagtcaaaaattattatatagaagcaagagagttatgtaagatttataacaatcctttaatgttgatgaagatagaaaattatttgaaggaactagatactgtttag

SEQ ID NO: 984 - DNA, 411 bp, Streptococcus pneumoniae
gtgaagcttttttacagtatgttactcttaattaatgtgttaggagctgttcttgttttgtcagataacttgttcatcaaaaatacgctgcagcaagaattagttgactttttattgccatccttctttttcctatttgggctagatttgctgatttttttacccttgaaaaaatacgtgcgcgattttcttgctatgctggacagaaaaaagacagtgttggtgactattttagcaacacttcttttcttaagaaatccaatgaccattgtctcacttctgatttatattggactgggcttgttttttgcagcctatcttgtcccaaattcggttaagaaggaagtttccttttatggtcatattttccgagatcttgtattggtcattgttacgctcattttcttttag

SEQ ID NO: 985 - DNA, 477 bp, Streptococcus pneumoniae
acacaaaagaaaagtttttggtataataagagtatgtacacaaaaaatgaagaagagttgcaagccttaggggagcgtttgggccatctattagcaaagaatgatgttttaatcttaactggagaactgggtgcaggtaaaacgacctttactaaaggacttgcaaaaggattacagatttctcaaatgattaaaagtcccacctatactatcgtgagagagtatgaaggtcgacttccactttatcacctagatgtttatcgtattgaaggagatgctgattctatcgacttggatgagtttatctttggtggcggcgtgactgttattgagtggggaaatctcttaggagatgccttgccagatgcttatttagaattggaaattctaaaagaagcagatggacgccgtttaaattttcaggcaaagggtttgcgtgctgagaaattgttagaggagcttcaatatggagtatga

SEQ ID NO: 986 - DNA, 519 bp, Streptococcus pneumoniae
atggagtatgaattgctcattagggaagcagagcccaaagatgcagctgaattagtggcctttttaaatcgtgtgagtttggagacagactttaccagcctagacggagatggtattctcttgactagtgaggagatggaaatattcctcaacaagcaagctagttcggacaatcagataaccttacttgcattcttaaatggcaaaattgctggtattgtaaatattacagctgatcagcgtaagagagtccgtcatattggagatctcttcattgtgattggaaaaagatattggaataatggcttgggaagtttgttgctagaagaagcgatagagtgggcacaagcaagtggcattctgcgtcgtctccaactgactgtccaaactcgtaatcaagcagcagtccatctttatcaaaagcatggctttgtcattgaaggtagccaagagcgtggggcatatatagaagaagggaaatttatcgatgtttacttgatgggtaaactgataggttag

SEQ ID NO: 987 - DNA, 1017 bp, Streptococcus pneumoniae
atggttaaaaaaattattggaatggtgctagctttactttctgtaactgtagtaggagtaggtgtttttgcttatactatttatcaacaagggacagaaaccttagctaaaacctataaaaaaatcggtgaagaaaccaaggttattgaagcgactgaacctctaaccattctgttaatgggagtggacaccggaaatgttgaacgaactgaaacttgggtcggtagaagtgatagcatgatcttgatgacagtgaatcctaaaacgaaaaaaacaacaatgatgagtttagagcgggatattctgacgcgcattgaatcagggaatggtcaggctcatgaagcgaaactgaactcagcatatgcagatggtggagcagagcttgctatagaaaccattcaaaaaatgatgaatatccatattgatcgctatgtgatggtcaatatgagagggttgcaaaaattagtggatgcagtaggaggtattacagtcaataatatcctaggtttcccaatttctatcagtgaccaagaagaatttaataccatttctatcggtgttggggagcaacatattgggggagaagaagccctagtctatgcacgaatgcgttaccaagatcctgagggggattatggtcgtcaaaaacgtcaacgtgaagttattcaaaaagtcatggaaaaagctctcagtttaaatagcgttggtcattatcaagagattctaaaagctttgagtgacaatatgcagaccaatattgatttgtctgcaaaaagtatccctaacttgctaggctataaagattcatttaaaaccattgaaactcagcagttgcagggtgaaggagagatacttcaaggtgtttcttaccagattgtttcgagagcacatatgttggaaatgcaaaatatactccgacgttctttgggacaagaagaagttactcagcttgaaaccaatgcggttttatttgaagatttatttggcagagcacctgttggtgatgaagataattaa

SEQ ID NO: 988 - DNA, 1257 bp, Streptococcus pneumoniae
  unsure (268),(288): n at each above location is unknown.
atgaaagcagaaatcattgctgttggaacagagattttgacaggacagattgtcaacaccaatgcccagtttttgtcggaaaaactagctgagattggggtagatgtatattttcagacggctgtaggagacaatgaagttcgtctcttgtctttgcttgagattgccagtcaacgtaaccatctggtgattttgacaggcggtttggggccaactggagacgaacctaccaaacaaaccctagctaaatttttagggaaagcattantctttgatcctcaggctcangaaaaattggatatcttttttgccctgcgaccagactatgcccgaacaccgaataacgaaagacaagctcaaattgtagaaggagcgattccactgccaaacgaaacaggactggctgttggaggaaaattagaagtagacggagtgacctatgtcgtccttccaggtccgccaagtgaattgaaacccatggtcttaaaccaacttctacccaagttgatgacagggagcaagctgtattcccgagttcttcgtttctttgggattggcgagagccagctggttacgattttggctgatttaattgataatcagatcgatcctaccttggccccttatgccaagacaggagaagtcactctacgtctgtcaacaaaggctagcagtcaagaagaggcgaatcaagcgctggatatcttggaaaatcaaatcttggactgccagactttcgaaggaatttctttacgagacttttgctatggttatggggaagaaactagtttagccagcattgtggtagaagaactgaaaaggcaagggaaaaccatcgcggctgcagagagtttaacggcaggtcttttccaagctaccgtggcgaatttttctggagcttcaagtatatttaagggtggttttgtgacctatagcttggaggaaaaatcaaggatgttggatattcctgccaagaatttggaagaacatggtgtggtgtctgaatttacagctcagaagatggctgagcaggcacgaagcaagacccagtctgattttggaattagtttgaccggagtggcaggaccagatagcctagaaggacacccagttgggacagtcttcataggcttggcgcaagagcaaggaactgaggttatcaaggttaatattggaggcagaagccgagcagatgtacgtcatattgcggttatgcatgcctttaacctagttcgcaaggctttattaagtgactaa

SEQ ID NO: 989 - DNA, 1167 bp, Streptococcus pneumoniae
atggcgaaaaaaccaaaaaaattagaagaaatttcaaaaaaatttggggcagaacgtgaaaaggccttgaatgatgctcttaaattgattgagaaagactttggtaaaggatcaatcatgcgtttgggtgaacgtgcggagcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgaccaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttacgcttgacttaggcgatgaacttgaaatcgaaattgaagaataa

SEQ ID NO: 990 - DNA, 1371 bp, Streptococcus pneumoniae
atgaataaaaaacgaacggtggacctgatacatggtccgattcttccctcgctcttaagcttcacctttccaattttgctatcaaatatttttcaacagctctataacactgctgatgtcttgattgttggacgatttcttggtcaagaatccttggctgcagtaggagcgacgacagcgatttttgacctgattgtaggttttacacttggtgttggcaatggcatggggattgtcattgctcgttattatggggctcggaatttcactaaaatcaaggaagcagtagcagctacttggattttaggtgctcttttgagcattctagttatgttgctgggctttcttggcttgtatcctctcttgcaatacttagatactcctgcagaaattcttcctcaatcttatcaatatatttctatgattgtgacctgtgtaggtgtcagctttgcttataatctttttgcaggcttgttgcggtctattggtgacagtctagcagccctgggatttctgattttctctgccttggttaatgtggttctggatctctattttattacgcaattgcatctgggagttcaatccgcaggacttgctaccattatttcgcaaggtttatcagcggttctctgcttttattatattcgtaaaagtgtgccagaactcttgccacagtttaaacatttcaaatgggacaaaagcttgtacgcagatctcttggagcaaggtttggctatgggcttgatgagttcaattgtatctatcggcagtgtgattttacagtcttctgttaatacatttggtgcagtgattattagtgcccagacggcagctcgacgcattatgacctttgcccttcttcctatgaccgctatttctgcatcaatgacgacctttgcttctcagaatctaggagctaagcaacctgaccgcattgttcaaggtcttcgaatcggcagtcgtttaagtatatcctgggcagtttttgtttgtattttcctcttttttgccagtccagctttggtttccttcttggctagttcgacagatggttacttgatagaaaatggaagtctctatctgcaaatcagttcaaccttttatcccattttgagcctcttgttgatttatcgcaattgcttgcagggcttggggcaaaagatccttcctctagtttctagctttattgaactaatcggaaaaatcgtttttgtggttttgattattccttgggcaggatataagggtgttatcctttgtgaacctcttatctgggttgccatgacagttcaactgtacttctcactattccgtcatcccttgataaaagaaggaaaggcaattttggcaaccaaagtgcaatcctag

SEQ ID NO: 991 - DNA, 957 bp, Streptococcus pneumoniae
atggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgcaggtaggacctgttgataatggtgcctgggacgttgggggcggttggaatgctgagacctatgcagcggttgaactgattgaaagccattcaactaaagaagagttcatgacggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccatgtggatccatacccttacttggcaaaatggggcattagccgtgagcagtttaagtatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaagccagaattcacagtagagccagatggcttgattacagtaaaataa

SEQ ID NO: 992 - DNA, 237 bp, Streptococcus pneumoniae
gtaagatttgaagatattctaagttcttttattctttttccaacatcacatacatttatcacatacatttatcatattcatacacctctcataaaaagaatagcacactcttgtcataattttttaaataaaaaaattatgacaaaacaaggaagcaatttattgatgctgcttaaaaatctaaaattgatgagttcctatcaaaaatcgtatcttcaacctcaaaacagtacttaa

SEQ ID NO: 993 - DNA, 243 bp, Streptococcus pneumoniae
ttgccaaaatggaaaaaggtgaaaggaatatcacgaatggatttaagtaataaagcttcaaatcttagaaaaaagttgggagctgatggtgaatcgccgatagatatttttaaattggtacaaaagatagaaaatttgacgctggtattttatggactcggaaagaatattagcggagtctgttataaaggaactcagttcagtctcattgcagtcaattcagacatgccattaggaaggtaa

SEQ ID NO: 994 - DNA, 360 bp, Streptococcus pneumoniae
gtgaagaagagttcagtcagtcttatcttgattggtgaaggagatgaaactgaaagaaaagcggatcagtttgcttcttattttttaattttcccatcttcactgtataggatggttgaggaaatcagagaaaatgccaatagaactcatcttgaagtagaagatattataaaattgggtcagttttatggtatcagtcataaagctatgttatatagattgaggaatgatggataccttgatgcagaagaaattaaaaatatggatattagtgttatagagacagcttcaagattaggctatgatacaagtttatatcgtcctttgtcagaaagtaaaaaagaaatggcattaggataa

SEQ ID NO: 995 - DNA, 426 bp, Streptococcus pneumoniae
ttgactagtcgtgtatttattgatgcagattgtatttcagtatttttatgggttggcactgaacatcttttagaaaagctctatttgggtaaaattgttattccacaagaggtgtatgatgaaatcaatatacctacaattccccatttaaaatctaggatagaccagttggtaactaagggttcagctgagattgtgagcatagacattggaactgaagaatacgcattatatagagatttaacaagaaatcatgatagtaacaagattattggtaagggagaagcgacttctattttcttagcgaaaaagcataatgggatattaggaagtaataacctaagagatgttaaaccatatgtagaagaattttctttagaacatatgacaacaggagatatactgattgaagcgtttaaagcgtaa

SEQ ID NO: 996 - DNA, 225 bp, Streptococcus pneumoniae
ttcaggaaaacttcaaggagaacttttctctcatccactatgcaggacttactatttcacttctactcctataggctcaatttgacacttttctttttcgaattgctcatatgcctcctgaatagtgagttcgatttatccaaatttatttttgtctattttgatgaatacttccacgaagatagtctgaaaatgaatttgcaccaattttccttctctttttaa

SEQ ID NO: 997 - DNA, 996 bp, Streptococcus pneumoniae
atgaatgtcaaaaagataatgtcaatttttcaatccttttatgttgatgtcagtattgaggaactgactttgactttaccaatcagttttgtaaaaaggtttgagtatactcaaatgacttttcataaggaatcatttttattgattaaagaaaagagaagggggagtttgagttcatttgttactcaggctcgcactatgggtgaaaaagccaatatggatgttgttttggtgttttcgaagttatcagacagtgaaaaaaagcaattacttcaagctagagttccgtttgtagactttaagggaaacctcttcttccctccattgggactagtactcaatgcgaatgatactgaaatccctaaggaattaacacctagcgaacaattaacgtggattgcctttttattgccaaaaggtcaaaaagtagtaaatgttgatttgctttcacaagtcactggacttccaaactcaacaatttataggtgtttgaggacttttaaagctttatattggttaaacaagcaaaataagctttacacatatacggtgtcaaagaaagaattattcttaaaatccgtgtcatgtttatttaatcccatcaaaaaacggattttattgccagatggcgatataaagcagataaaatctgtttctaaccttctatatggtggtgcttatgctttgtcgcattcaacttttttagctgaaacggatgaaaatactagctatgtcatatggcagagaaaattcaatcagttatccttgccactttctcagcatgttttaaaaggaaagatgctagagatatggaaatatcgtccttttgtatctgagttttggaatgattttaaaaataatcatgataaacaatttgtagatccgatttctctttatttgaccttaaaagatgatgatgacccacgtatagaggaagagagtgaagcactagaaaatatgatattacagtatctgggagaagatgatgccagctaa

SEQ ID NO: 998 - DNA, 246 bp, Streptococcus pneumoniae
atgatgccagctaatacgaaagttatttttcaagaaatgtttgcggattttcagaactattatgttctgattgggggaactgctacctctatcgtattggattcgcaaggatttaaaagtcgcacaacaaaagattatgatatggtcatcattgatgaagtaaaaaataaggaattttatactacctggaatcattttttagaattgggagagtatcaaggaagtcagaaagatgagaaagcgtag

SEQ ID NO: 999 - DNA, 270 bp, Streptococcus pneumoniae
atgattgaactatttagtatcttaccagaatatccattaaagaaggacggtcgagaaattcccttacattttgaccaagatgctagtttatcagccttattattggatgaagattattataatatattggtgcatgaaaaagaaaccattcaggggtattcggtattgagtaattgtggtctatactcttcgaaaatctcttcaaaccacgtcagcttccatctacaacctcaaaacagtgttttgagcagcctgcagctagcttcctag

SEQ ID NO: 1000 - DNA, 261 bp, Streptococcus pneumoniae
atgagggaacgctctgctacaggtgctcaaggtttaagtaagtccattaaaaagcatttgaatgacattacccgtttgacagcttccttgctaggagatgaaaagttatcggctataacatcaagtagtgcggtaaaagcagacatgcaccgctttgtgatagaattagagcttgtgaagtcaactattcttcaaaatgatgacatttcattagatcaaaatgaaatttttgaaattctgaaaaattttttcgatggttaa

SEQ ID NO: 1001 - DNA, 303 bp, Streptococcus pneumoniae
aaacagcttatcaaaaaagtcggacaagctggtaaaatcttggctgacagtggttatcaagggctcatgaagatatatcctcaagcacaaactccacgtaaatccagcaaactcaagccgctaacagttgaagataaaacctataaccatgcgctatctaaggagagaagcaaggttgagaacatctttgccaaagtagaaacgtttaaaatgttttcaacaacctgtcgaaatcatcgtaaacgcttcggattacgaatgaatttgagtgctggtattatcaatcatgaactaggattctag

SEQ ID NO: 1002 - DNA, 132 bp, Streptococcus pneumoniae
atgaattatgaagcaagtaaacaactaaccgatgcacgatttaagcgtcttgttggtgttcagcgcaccacttttgaagagatgttagctgtgttaaaaacagcttatcaaaaaagtcggacaagctggtaa

SEQ ID NO: 1003 - DNA, 459 bp, Streptococcus pneumoniae
atgacgccagaagaaatgtacctgacagagcgattagacgtacagatagctcattttttaaagaaaagcgttcaacatcgtaggcgctataaggtattaaaaataacagaaatcgtggcaggtttcctcatagctgtcttttgtgctattcctatgccaggtgatcgctaccgtttgatttcggttgccttatccagtctcggcttgctgtgtgaggggattatcaatttgtataatgcaaaggaaaattggatttcttaccaaaaaactgcgcaactcctggagaaagaaaaattcctctatcaatgccaaacggagaaatatgcaggaaagaccaaggcttttgccctatttgtcaagacatgcgaaggtcttatctcagaggagattaaccagtgggaaagtatccagtcaaaagaagtggcagctagtgcagatgctccagttaaaaaagagtag

SEQ ID NO: 1004 - DNA, 609 bp, Streptococcus pneumoniae
atgtctcaatccagctacctgtcgcccttgctctggttaaaaaaagaagccgataaggaaaagatgagcgcgacccagtgccagatatttttcttttactatcaaatgtttgagctcttatttgctagagaaagcgacatgaaagacttatgtctgggaacgaaaggtttttatttctcgcagttagagaaaaatttgctttctggagtttcccgatttctaaaaaacttggaggggaaagtaactctcaaggctaaccaagaagtatcagctcgcaaagccctttttctagccttgacaactagccaatcagattggcaggagttagctcctgtttttgatttttatcagactatcgggaggcttgaaaatccttctctcttgagttctcaggacagacaacatctgatgtggatttaccagtcagctttggagaaagattatattgtcaaggttattggcgacaagcattttgtattgaagagacaagatgctactaaattgacagcgcgccaaactcaaactttggaaattctgagtcaatcagaagacttggtcaatcctgtctatgttacattaggagaaaagggggtgctcttgcttgattaa

SEQ ID NO: 1005 - DNA, 411 bp, Streptococcus pneumoniae
ttgattaagagaggagatgttgtagctctttatttgccttttccgactattagtagcgatttggctgtgaagaatcatatgtatatctgtattgacaacagcatgactaaaaacaaagagctggttaaaaatcagaccttcaaaccagctctcttgaccagacgtttggtcaagaactttatgatagaagagccggatctagctcgtaatccttttacaagaccaaccttgattgacttagataaggtatttatgttggataatacggtcattccgacttcttatttagccagacggcgacgcaatgtctcagaagaattgtacgaggaaattttggattacttagtccaaccacggctgatttcgctgaacaagtctgagtttatgcaactcaatccaggaacttattag

SEQ ID NO: 1006 - DNA, 1416 bp, Streptococcus pneumoniae
atggcaaataaagcagtaaatgactttatactagctatgaattacgataaaaagaaactcttgacccatcagggagaaagtattgaaaatcgtttcatcaaagagggtaatcagctacccgatgagtttgttgttatcgaaagaaagaagcggagcttgtcgacaaatacaagtgatatttctgtaacagctaccaacgacagtcgcctctatcctggagcacttctcgtagtggatgagaccttgttagagaataatcccactcttcttgcggtcgatcgtgctccgatgacttatagtattgatttgcctggtttggcaagtagcgatagctttctccaagtggaagaccccagcaattcaagtgttcgcggagcggtaaacgatttgttggctaagtggcatcaagattatggtcaggtcaataatgtcccagctagaatgcagtatgaaaaaatcacggctcacagcatggaacaactcaaggtcaagtttggttctgactttgaaaagacagggaattctcttgatattgattttaactctgtccattcaggcgaaaagcagattcagattgttaattttaaacagatttattatacagtcagcgtagacgctgttaaaaatccaggagatgtgtttcaagatactgtaacggtagaggatttaaaacagagaggaatttctgcagagcgtcctttggtctatatttcgagtgttgcttatgggcgccaagtctatctcaagttggaaaccacgagtaagagtgatgaagtagaggctgcttttgaagctttgataaaaggagtcaaggtagctcctcagacagagtggaaacagattttggacaatacagaagtgaaggcggttattttagggggcgacccaagttcgggtgcccgagttgtaacaggcaaggtggatatggtagaggacttgattcaagaaggcagtcgctttacagcagatcatccaggcttgccgatttcctatacaacttcttttttacgtgacaatgtagttgcgacctttcaaaatagtacagactatgttgagactaaggttacagcttacagaaacggagatttactgctggatcatagtggtgcctatgttgcccaatattatattacttggaatgaattatcctatgatcatcaaggtaaggaagtcttgactcctaaggcttgggacagaaatgggcaggatttaacggctcactttaccactagtattcctttaaaagggaatgttcgtaatctctctgtcaaaattagagagtgtaccgggcttgcctgggaatggtggcgtacggtttatgaaaaaaccgatttgccactagtgcgtaagcggacgatttctatttggggaacaactctctatcctcaggtagaagataaggtagaaaatgactag

SEQ ID NO: 1007 - DNA, 717 bp, Streptococcus pneumoniae
atgggacgtaaatgggccaatatcgtagctaagaaaacggctaaagatggagccaactctaaagtatatgcaaaatttggtgtagaaatctatgtagcagctaaaaaaggtgatccagatccagaatcaaactcagctttgaaattcgttatcgaccgtgctaaacaagcccaagtgccaaaacacattatcgataaagcgattgataaagccaaaggaaacacagacgaaacctttacagaaggacgttacgaaggttttgggccaaatggctctatgctaattgtggatactttgacttctaacgtcaaccgtacagcagccaatgtccgtgcagcctttggtaaaaacggcggaaacatgggcgcttcaggttctgtttcttacctttttgacaacaaaggtgttattgtatttggaggtgaagatgcggacgcagtctttgagcaattgctcgaagcggatgtggatgtggatgacgtaaaagcacaagaaggtacaatcacagtttacacagcgccaactgaccttcacaaggctatcgttgctctccgtgagtctggtattgaagaattccaagtgactgaattggaaatgattcctcagtcagaagtggaattgtcaggcgaagaccttgaaacctttgaaaaactttacagcgttcttgaagacgacgaagacgtccaaaagatttatacgaacgtagatgggttttaa

SEQ ID NO: 1008 - DNA, 450 bp, Streptococcus pneumoniae
atgggtaaaccgatgttagtctttaagcgttttggtcatcaaattcacctgatggtgcaaaaggaagccaaacgttgcggcattgaatttatgggtgggccgcaaggtcaggttgtgcattttttggataatcgcgagaaaaaccaagacttggtcttgattaaagatatcgatcaggaactcaatattaccaagtctgttgctagtaatctggttaagcgtatagtgcaaaattgtttggtggaattggaggcgagtcctgttgataagcgggctaagtttgttcgtctgacggacaaagcacgttctcagatgcaacaggttaaggctttttttgaacgcatagacaagcagttgatggaagatattgatgaagatgaattactgatttttgagaaggttctcggtcaactacaggcaaaatatcaagggaataggaggagagaataa

SEQ ID NO: 1009 - DNA, 873 bp, Streptococcus pneumoniae
gaggagagaataaagaaattagccaaaagaattagtagaaaagaatgggggatgattttactagccattctctttacttgcttttcggtctatctagagttggaagtgccgacctatatctcgaaaattacggatttgctaggtagtcaagaaactaatttagatgagttgtggcagccggcaagcatgatgatgggaatgtcctttcttgccttcttgtccgtagttgcagttggattttttgcatcccgagtggcggcttcttatactagtaggctgagaagtgatatttttaaccgagttttggattactcgcagacagagattaagaaattttcaattcctagcctcttgacgcgtactaccaatgacattactcaagttcaaatgttgattactatgggcttgcaagtggtaacgcgtggttcaattatggctatctgggctattgggaagattttaggtcattcagaatactggctctgggccgtacttgtggtagtgattgtcaacgtcctgatgacgaccgttttgatgacgctagcctttccaaaacagtccttgattcaggggttgacagataaactgaacagtatcactcgtgagagtttaacaggtattcgtgtcgttcgtgcctacaatgcagaggattatcaaaatgaaaaatttgcagcagtaaatgatgaattgacccgtttgaatttgtttgtcaaccgtcttatggctattttgaatcctatcatgatggggatttcaagtggtttgagtgtagcgatttactggattggggcctatgtgattaacgacgctgctccgatagcgcgtctgcctctctttagtgacatgattgttttcatgtcttatgccatgtag

SEQ ID NO: 1010 - DNA, 1032 bp, Streptococcus pneumoniae
atggacttccttctcatgggagcactcttcatcgttcttccccgaactatggtctctgctaagcggattaatcaagttttagatttgcattcttctatccaaaaccctgctcaagtgcagctgactgatgaaaacttcaaaggtcaggtcgagtttaaggatgtgaccttccgctatgcggcaaattcggaggcagttattgaacatgttagctttaaagcagaaactggtcaaacagtggcctttattgggtcaataggttctggtaaatcaactctggtcaatctgattccacgtttctacgacgtgtcagcaggagaaattctggtggacggtgtcaatgttcaagactatgacttctctgcgacagctcatgctggtcaaagggttgccattgttgggccgactggggctggtaagacaaccattgtcaatcttttgatgaaattctatgagattgataagggaagtattcgcattgatggtgtggataccaaggctatgacgcgttcagaagtgcatgatgccttttcaatggtcttgcaggatacctggctctttgaaggaactattcgagacaatctcatctataatcaaatagggattagtgatgaacgaatgatggaagctagtaaggctgtgggaattcaccactttattatgaccttgccagatggctatgataccatcttggatgacaccgtgaccttgtctgtaggacaaaaacaactattgactattgcttgtgcccttcttaaggatgcatcgcttttgattttggatgaggcgacttcttctgttgacacacggacagaggaattgatccaaaaagccatggaccgtttgatggaaggacgcacatcctttgtcattgcccaccgcttgtcaatcatccgaaatgcagacttgatcttggtcatgaaagatggaaatatcatcgagcaaggcaactatgaggaactgatggcgcaaggtggcttctacgctgacttgtacaatagtcaatttacagaagatgaagcagaagaataa

SEQ ID NO: 1011 - DNA, 363 bp, Streptococcus pneumoniae
atgagtcagaaattatacaatatgaaatttgctgctgtctacttagccttgattgcaaaagttgagcgaaagggtgaaaaggcagagtcagttcaccaagtgaccagttggttgacagggtatgaagtgagtgacgttcttgcttgtctggatagggatgttacttacggagatttttttctacaagcaccatattatgtccctgaacgaattacaattacagggaagatttgcggtgtccgtattgaggaaattgatgatcctctgatgcaggaaatacgtcgcttagacaagctattggattggcttgccaaggggaaaacatctcaacaagttctagaaaagtatgagaagcataaatga

SEQ ID NO: 1012 - DNA, 504 bp, Streptococcus pneumoniae
atgaaaaattatcaagaatggtatcgaaatatcagctccagactaactagtcgtccaattcttttattcctattacgcagtttcaatcgtttgatgacagtcgccatgcccctggtctatctgatcttgctagtcaccacttacctgcaactaggacttggtcagcaagttggggtttatgtgcttattcctgcatcaggttttgtggccttgtccctgtttcgtaagaaaatcaatcacccgagaccttatgaaacttgggatatctgtccccttcttgataaggatagtgcgggacggtcgatgcccagtcgccatgtcttttctgcaactatcatctccatggcctgtctgcatgctagtctacctattggcttagtatgcttgatcttttcagctttgctggggttggtgagggttttagggggtgttcattatcccaaggatgtcttggttggctatgcttgtggtctggtgtggggattccttttcttcctattctga

SEQ ID NO: 1013 - DNA, 450 bp, Streptococcus pneumoniae
gtgatgaagttacgaattgagattgacggcaatttagaggagactgaaattgtcatcaagacccccactttgacagatgaaattgcagacttgcaacggctcttgcaagagtcaaaggctccgaggttgactttttacaaggggacaggtgaatattatctagacctgtcagaaattctcttctttgaaacagaagggagcaagatctacgctcataaccagaaggaagcttatgaggttcgcctcaagctctatgagttggagtctatcttgcctcgctattttaatcgagtttccaagtcaacgatcgcaaacatccgtcagatttactcagtggacaagtccttttcaggaacgggcaccatttccttttatcagacgcacaaggaggttcatgtctcacggcattaccaatccctcctaaaagaaaatctaagaaacatgaggtaa

SEQ ID NO: 1014 - DNA, 675 bp, Streptococcus pneumoniae
atgaaaaagaaagcatttggtattgtgttacttgtactagcagctttaatattagtacaaggaaattttggaatcccttctctaggagggcacatttggcccttgattggtattgctttttttgcctaccaatcagttggagctttgttgcgtcgccacttaacttcagcctcttttacagctctagtagccttaatgattgctaaccacttttatggcattttaccgattccaaaccagacactaatctgggcaggagttctaatcgttctcggagtaaatatgttgactcattctaacagaacttggaatgggaaaaaatggtggtatgatggtgaaaaaaacattcttatagataaggaagttgcttttgggacagggactttctacaagcaagaccaagaattggtagaagaccaagtagaagttggttttggcaatgcaaaaatctactatgacaatgcagagatgttaggtgattttgcaactttaaatattgaagtagcttttggtaatgcaactgtctatgttccgcaacactggcgtgtcgatttgaaagtagaaacatcctttggtacagccaaggcggacgctcctgtagcgccaacaagcaaaaccttgattattcgtggagacgtggcctttgggaagttggagcttgtctacgttaaataa

SEQ ID NO: 1015 - DNA, 222 bp, Streptococcus pneumoniae
gtgcctggcaataagaataatactcttcgaaaatctcttcaaaccacgtcagcttcatccacaacctcaaagcagtgctttgagcagcctgcggctagcttcctagtttggtctttgattttcattgagtataagaagtccttttccttaaaggaagaggctttttacttgcttttttgctgtttcctcatttgtcctaaagccttttttgtgttaaaatga

SEQ ID NO: 1016 - DNA, 300 bp, Streptococcus pneumoniae
atgaatggtatgaaagctaaaaaaatgtggatggcaggtctggctctgcttggtattgggagccttgcccttgctacgaaaaaagttgcagatgaccataagctcatgaagactcaggaagagttgacagcgattgtacgagaccatttttcagacatgggggaaattgcgaccctctatgttcaagtctatgaaagcagtctagagagcttgcttggtggcgttatttttgaggatggccgtcattatacctttgtctatgaaaatgaagacctagtctatgaggaggaagtcttatga

SEQ ID NO: 1017 - DNA, 318 bp, Streptococcus pneumoniae
atgatacaaccagcaagtttagaagaattggcatctttagtagaaaaagacggtaagaaggtcttcctttttgtggcggactggtgtggcgattgccgttatatctatcctgccttaccagaaattgaggagagtaatccagagtttacctttattcgagtggatagagaccagtatatagatttggccaaactctgggatgtatatggaatccctagccttgttgttctagaaaaggacaaggaaatcggtcgttttgtcaatcgcgaccgtaaaagcaagcaacaaattaacgattttttagcaggattgaaatag

SEQ ID NO: 1018 - DNA, 378 bp, Streptococcus pneumoniae
atgttccaagctactgtttccccattttctttgaggaaaacacgggctaccttgtctttgcgttccacattcagtttagcatctccgctatttttcacgatgaccataaggacatcaccgacatgttctttgttatatgtaaaaatcattgtttcctttttctcctatttcaatcctgctaaaaaatcgttaatttgttgcttgcttttacggtcgcgattgacaaaacgaccgatttccttgtccttttctagaacaacaaggctagggattccatatacatcccagagtttggccaaatctatatactggtctctatccactcgaataaaggtaaactctggattactctcctcaatttctggtaaggcaggatag

SEQ ID NO: 1019 - DNA, 627 bp, Streptococcus pneumoniae
atgatttttacatataacaaagaacatgtcggtgatgtccttatggtcatcgtgaaaaatagcggagatgctaaactgaatgtggaacgcaaagacaaggtagcccgtgttttcctcaaagaaaatggggaaacagtagcttggaacatttttgaggtttcgagcttgtttgaaattgcagagcgcggtcaagtctttttatcagatgagcaagtcgctcgtttgaaccaagaattacaggcggaaggttttacagaagaaattgttaatgataaggaacctaagtttgttgttggtgaaattgtcgagatggtagctcatccagacagtgaccacctcaacatctgccaagttgcagtcgcaagtgacaagatagtgcaaatcgttgcaggagcacctaatgcgcgtgttgggttgaaaaccattgtggctcttcctggtgccatgatgccaaaagggaatttcattttcccaggcgaacttcgtggtgaaaagagttttgggatgatgtgtagtcctcgtgaattgcatttgccaaatgctccgcaaaaacgtggggtgcttgaattatcagaagaccaagttgtcggaacaccgttcgacccagcgaaacactggactgcctag

SEQ ID NO: 1020 - DNA, 762 bp, Streptococcus pneumoniae
atggcaaaaaatgtagtgattacgggagcaacctcaggaatcggtgaagcgattgcgcgtgcttatctggagcagggtgaggatgtcgttctaacaggacgacggatagacagattagaaatcctcaagtcggagtttgcagtaagctttccaaatcaaaccgtctggacttttccactagatgtgacggatatggtcatggtgaagactgtttgctctgatattctagaaacgatagggaggattgatatcttggtcaacaacgccggactggctcttgacttggctccctatcaagactatgaggagttggatatgttgaccatgttggataccaatgttaaaggtctgatggcggttactcgctgtttcttgccagcaatgataaaagtcaatcaaggtcacgttatcaatatggggtcaaccgcaggaatctacgcctatgctggtgccgctgtttactcagctaccaaggcagcggttaagaccttttcggatggactgcgaattgataccatcgcaacggatatcaaggtgacaaccattcagcctgggattgtcgaaacagatttctcaactgttcgttttcatggtgataaagagcgggctgcgtccgtttaccaaggaatagaagccttgcaagctcaggatattgcagacacagtagtctatgtgaccagtcagcctcgccgtgttcagattacagatatgaccattatggccaatcaacaggcgacaggtttcatgattcataaaaaataa

SEQ ID NO: 1021 - DNA, 396 bp, Streptococcus pneumoniae
atgtataataaagttatcatgattgggcgtttaacgtctacaccagaattgcacaaaaccaacaatgacaagtcagtagcgcgagcaactatcgctgtcaaccgtcgttacaaagaccaaaacggtgaacgtgaagctgattttgtcaatatggttctatggggcagactagcagaaactttggcaagctacgcaaccaaaggtagtctcatttccgttgatggagaattgcgtacccgtcgctttgagaaaaatggtcagatgaattatgtaaccgaagtccttgtgacaggattccaactcttggaaagtcgtgcccaacgtgctatgcgtgaaaataatgcaggccaagatttggcagatttggtcttggaagaggaagaattgccattttaa

SEQ ID NO: 1022 - DNA, 285 bp, Streptococcus pneumoniae
atgttgaaaccattaggggaccgtgtgctcttaaaaatagaagaaaaagaacaaaccgttgggggctttgtccttgcaggctcagcccaagaaaaaaccaaaacagctcaagttgtggctactggacaaggtgttcgtaccttgaacggtgacttggttgctccaagtgttaaaactggagatcgtgtcttagttgaagcccacgcaggtcttgatgtcaaagatggcgatgaaaagtacatcatcgtaggcgaagctaacattttggcaatcattgaggaatag

SEQ ID NO: 1023 - DNA, 609 bp, Streptococcus pneumoniae
ttggcaacagggatggcgttgtttttcaaagcttcaactgctgcggcaactgctgtttcaatcccacgacgaataccgattggatttgcacctgctgtgacgtttttgattccttcacggacgatagcttgggtcaagactgttgcagtcgtagttccgtcacctgcgatatcattggttttagaagctacttctgatactaacttagcacccatattttcaaaatggtcttccaattcgatttctttggcaatggtcacaccgtcattggtaatcaagggtgaaccgaatgacttttcaagaacgacattgcgaccttttggtcccaaggttactttaacagtgtctgcaagaatatcgacaccacgaaccatggctgaacgggcatctgatgaaaatttaatttcttttgacatacttactttctccttctattcctcaatgattgccaaaatgttagcttcgcctacgatgatgtacttttcatcgccatctttgacatcaagacctgcgtgggcttcaactaagacacgatctccagttttaacacttggagcaaccaagtcaccgttcaaggtacgaacaccttgtccagtagccacaacttga

SEQ ID NO: 1024 - DNA, 1623 bp, Streptococcus pneumoniae
atgtcaaaagaaattaaattttcatcagatgcccgttcagccatggttcgtggtgtcgatattcttgcagacactgttaaagtaaccttgggaccaaaaggtcgcaatgtcgttcttgaaaagtcattcggttcacccttgattaccaatgacggtgtgaccattgccaaagaaatcgaattggaagaccattttgaaaatatgggtgctaagttagtatcagaagtagcttctaaaaccaatgatatcgcaggtgacggaactacgactgcaacagtcttgacccaagctatcgtccgtgaaggaatcaaaaacgtcacagcaggtgcaaatccaatcggtattcgtcgtgggattgaaacagcagttgccgcagcagttgaagctttgaaaaacaacgccatccctgttgccaataaagaagctatcgctcaagttgcagcagtatcttctcgttctgaaaaagttggtgagtacatctctgaagcaatggaaaaagttggcaaagacggtgtcatcaccatcgaagagtcacgtggtatggaaacagagcttgaagtcgtagaaggaatgcagtttgaccgtggttacctttcacagtacatggtgacagatagcgaaaaaatggtggctgaccttgaaaatccgtacattttgattacagacaagaaaatttccaacatccaagaaatcttgccacttttggaaagcattctccaaagcaatcgtccactcttgattattgcggatgatgtggatggtgaggctcttccaactcttgttttgaacaagattcgtggaaccttcaacgtagtagcagtcaaggcacctggttttggtgaccgtcgcaaagccatgcttgaagatatcgccatcttaacaggcggaacagttatcacagaagaccttggtcttgagttgaaagatgcgacaattgaagctcttggtcaagcagcgagagtgaccgtggacaaagatagcacggttattgtagaaggtgcaggaaatcctgaagcgatttctcaccgtgttgcggttatcaagtctcaaatcgaaactacaacttctgaatttgaccgtgaaaaattgcaagaacgcttggccaaattgtcaggtggtgtagcggttattaaggtcggagccgcaactgaaactgagttgaaagaaatgaaactccgcattgaagatgccctcaacgctactcgtgcagctgttgaagaaggtattgttgcaggtggtggaacagctcttgccaatgtgattccagctgttgctaccttggaattgacaggagatgaagcaacaggacgtaatattgttctccgtgctttggaagaacccgttcgtcaaattgctcacaatgcaggatttgaaggatctatcgttatcgatcgtttgaaaaatgctgagcttggtataggattcaacgcagcaactggcgagtgggttaacatgattgatcaaggtatcattgatccagttaaagtgagtcgttcagccctacaaaatgcagcatctgtagccagcttgattttgacaacagaagcagtcgtagccaataaaccagaaccagtagccccagctccagcaatggatccaagtatgatgggcgggatgatgtaa

SEQ ID NO: 1025 - DNA, 210 bp, Streptococcus pneumoniae
gtgcatgtttgctgtgccccttgtagtacctatacactagaatatttgaccaagtatgcagatgtgaccatctattttgccaattctaatatccatcccaaggcagaataccataagcgggtctatgtcaccaagaaatttgttagtgattttaatgagcggacaggaaatacggttcagtacctagaagctccctacgaacccaattaa

SEQ ID NO: 1026 - DNA, 252 bp, Streptococcus pneumoniae
gtggctatggacttgggctttgactactttggttcagccttgaccatcagtcctcataagaattctcaaactatcaatagcatcggaatcgatgtgcaaaaaatttacacgccccactattttcccaacgatttcaagaaaaatcaaggctacaaacgttcagtagagatgtgtgaggagtatgatatctatcgtcaatgttattgtggctgcgtctatgcagcccaagcccagaatattgacctggtttaa

SEQ ID NO: 1027 - DNA, 192 bp, Streptococcus pneumoniae
cttttatattgttcaattactttatcaatcattttaaatgacctccactctataatttggcattatatcacaagaataaagatagtgttaaataagttatataaatgcaaaaaaggaatattccgttatagcagagttgtaacacatttctataaagaaatttattcctacgactcagtttggcatgcttaa

SEQ ID NO: 1028 - DNA, 774 bp, Streptococcus pneumoniae
atgattgataaagtaattgaacaatataaaagtcatgataatcttgatattcgagtagaattgcataagaagtattcaaaaaataaattgggatttaataattggatattttctaactaccaaatcactgatgaagtaaaggttctagaattgggatgtggtacaggagaattgtggaaaagtaatagtgattctatagataaaatgaagcagttgattgttacagatttttctaaagatatggtaaaatcaacgaagtcagtgattggaaatagaaacaatgtcaattatgagataatggatattcaaaagatttcttttgagaatgaaacttttgatattgttattgctaatatgcttctacatcatgtgaatgatattcctaaagctctctctgaggtgaatagggtcttaaaaaccggaggcattttttactgtgctacatttggtgaaaatggagttgtaaattatttggcaagtttatttaaagatgaggttaatcaagatttagaaaatagaacgtttactttacaaaatggtaaaaggtacctgagtaggtattttaactctgtcgatacattactctatgatgatgagttacaggtaactagtatagatgacctagttaaatacatccaatcgtttaaaggaatttcagaaataggttcactagaagaggaaataatacgtaaaagattggaaagtgagtttaataatggtatgttgatcattcctaaagaatatggtatgtttatcgctcgaaaagaaagttaa

SEQ ID NO: 1029 - DNA, 339 bp, Streptococcus pneumoniae
gtgaaaaattacggagaagcttttcgatattttagaaaattaaacggatattctttagagtatgctgcagctgattttatatcaaaatctcaactttctagatttgaaaggggagaaaatgaaatttctctttcaacattttttgaattattatcaaatatcaatgtttcgatagagaatttttgtaatcacttagaatattataaaagatcggagcgtgatgattttttggttaatttatctccaaatttttatagtttgaatattaaaggattggaggtaataaaaaataagcaacaaaaactttttgagaagagtgggaaaaaactcataaaataa

SEQ ID NO: 1030 - DNA, 348 bp, Streptococcus pneumoniae
atggtcggaaaagaaatactagaacgtacacattattacgaaaaaatcggcaagaatagaaatttagttgtgtcagcttgtttaaatttttggttctgttgccttgaaaattcacatctaatatatgcagactactttgaaatgaaattacaaaaattattaaaagatgacacaaaagtttttgaaaaatctacattcaaatttgtagaaggatataaaatatacctgacagaatctaaagaatctggaattaaacaaatggacaatgtcataaaatattttgagtttattgaatctaaaagtattgctttatattttcaaaaacgattaaatgagctgatagattaa

SEQ ID NO: 1031 - DNA, 534 bp, Streptococcus pneumoniae
atgaagcttccaaaagaaggcgactttattacaattcaaagttataagcatgatgggagtctccaccgaacttggcgggacaccatggtactaaaaacaacagaaaacgccattattggtgtcaacgatcatacacttgttaccgaaagtgatggtcgtcgttgggtcactcgagaaccggctattgtttactttcacaagaaatattggtttaatatcattgccatgattcgtgataatggaacttcttactattgcaatatggctagcccctactatctggatgaagaagcactgaagtatattgattacgatttggatgttaaaatttttacagatggggaaaaacgtctcttggacgttgaagagtacgagcgtcacaaacgcaaaatgaattattctgatgacttggactatattttaaaagaacatgtcaaaattcttgttgattggattaacaatggacgtggtcctttctcagaagcctatgtaaacatttggtacaagcgctatgtagaactaaagaatcggtaa

SEQ ID NO: 1032 - DNA, 180 bp, Streptococcus pneumoniae
attgtaataaagtcgccttcttttggaagcttcataactaaccaactttctacaatttataagtttatcatttactattgtaccataaaattacctaaaatctgtgaatttcacttggaaatattaaagatattctctaagagcgcttgctatatccgaaaaatcgtagccctttcgtgc

SEQ ID NO: 1033 - DNA, 861 bp, Streptococcus pneumoniae
atgcgcttgatttttaatggtattttttgtttcactttcagattcatacccctatcttatcacattttgagttataatagagctatgaaaatcacaaaacttgaaaagaaaaaaagactctatctgatggagcttgataatggcgacaaatgctatatcaccgaagatacaattgttcgttttatgttatcgagagataaggtgataagcgaagaggaattgaaagagattcaagactttgctcaattttcttatggtaagaatctggccctctaccacttatcctttaaagcacgcactgaaaaagaagtcagagaatatctgaaaaaatacgatattgataaaaacatcgtttctcaagttattgctaatcttaaagaagataagtggattaatgatggtcagtacgcttatgctatcatcaataccaatcaactttcaggagacaagggtccttatgtgctgactcagaaactagctcaaaaagggatttcaaaatctactatagaagagaacttgaaagaatttgatttttctgaagttgctcaacgtgtagctaataaactattgaaaaaatatgagggaaaacttccagctcgtgccctgcaagataagattatccagaacttgactaacaagggcttctcttattctgatgctaaaattgcctttgacgacttagatagccaagttgaccaagaaacgactcaagaactcatcttcaaggaacttgataagcaatatactaagtatgctcgaaagtatgaaggatacgaactgaagcagcgtttaactcaagttttagcacgaaagggctacgatttttcggatatagcaagcgctcttagagaatatctttaa

SEQ ID NO: 1034 - DNA, 1356 bp, Streptococcus pneumoniae
atgaatctgaaagtgaaacaaaaaataccattaaaaatcaagcgcatgggaattaacggtgagggaatcggcttttaccaaaaaacattagtctttgtaccaggagctctcaaaggcgaagatatctattgtcagattacttctattagacgcaactttgttgaagcaaaattactgaaggtcaacaagaagtctaaatttcgaattgtgccatcttgtactatttataatgaatgcggaggctgccaaatcatgcacctgcattatgataagcagctggagttcaagacggacttacttcatcaagcgctgaaaaaatttgctcctgcaggatatgaaaattatgaaattcgtccaactattggaatgcaggaaccaaaatattacagagctaagttacaatttcagactcgaaaatttaaaaatcaggtcaaggcgggcttatatgcacaaaactctcactatttagtagagttgaaagactgcctggtacaagataaggaaacccaagtgattgctaatcgcttagcagaattacttacttatcaccagattccaatcacggatgagagaaaagttctaggtgtccgtactattatggtccgacgcgcgagaaagaccggacaggttcagattattattgttacaaaccgccagcttaatttaactcaattggtaaaagagttggttaaagatttcccagaagttgtgacagtagctgttaatacaaatacagctaaaaccagtgagatatatggtgaaaagacagagattatctgggggcaagagagtattcaagaaggtgtactcaattatgaattttcactatcccctcgagctttttatcaactaaatcctgagcaaacagaagtcctctatagcgaagcagtaaaagcgctggatgttgataaagaagaccatttgattgacgcttattgtggagttggaacgattggatttgcctttgcaaagaaagtaaaaacactcagaggtatggatattattccagaagctattgaagatgccaagcgaaatgctaaaagaatgggatttgacaatactcattatgaagctggaacggcagaagagattattcctcgttggtacaaggaaggctaccgagcagatgctttgattgttgacccaccacgtacaggtctggatgataagttattagatactattcttacttatgtaccagaaaaaatggtttatatttcttgtaatgtttcgaccttggctcgtgatttggtacgcttagtagaagtctatgatcttcattatatccagtcggtcgatatgttcccacatacagctcgaactgaagctgttgtaaaattaataaaaaaagtttaa

SEQ ID NO: 1035 - DNA, 246 bp, Streptococcus pneumoniae
tacaacgcaggtccatctggtagtgatgcaagtgcaccttttaagcaaatgtcatgcaacatccactcttatgcggtattagctatcgtttccaatagttatcccccgctaccaggcaggttacctacgcgttactcacccgttcgcaactcatccagagaagcaagctcctccttcagcgttctacttgcatgtattaggcacgccgccagcgttcgtcctgagccaggatcaaactctcattaa

SEQ ID NO: 1036 - DNA, 150 bp, Streptococcus pneumoniae
ttgctcggtcagacttccgtccattgccgaagattccctactgctgcctcccgtaggagtctgggccgtgtctcagtcccagtgtggccgatcaccctctcaggtcggctatgtatcgtcgccttggtgagcccttaccccaccaactag

SEQ ID NO: 1037 - DNA, 186 bp, Streptococcus pneumoniae
gacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaa

SEQ ID NO: 1038 - DNA, 261 bp, Streptococcus pneumoniae
gctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctccttacggttacctcaccgacttcgggtgttacaaactctcgtggtgtgacgggcggtgtgtacaaggcccgggaacgtattcaccgcggcgtgctgatccgcgattactag

SEQ ID NO: 1039 - DNA, 228 bp, Streptococcus pneumoniae
atgacttttgtcaacagacgaaactctttatactcttcgaaaatctcttcaaacttcgtcagcgtcgccttgccgtatgtatggttactgacttcgtcagtttcatctacaacctcaaaaacatgttttgagctgacttcgtcagttctatctacaacctcaaagcagtgctttgagcaacctgcggctagtttcctagtttactctttgattttcattgagtattag

SEQ ID NO: 1040 - DNA, 237 bp, Streptococcus pneumoniae
actaggaaactagccgcaggttgctcaaagcactgctttgaggttgtagatagaactgacgaagtcagctcaaaacatgtttttgaggttgtagatgaaactgacgaagtcagtaaccatacatacggcaaggcgacgctgacgaagtttgaagagattttcgaagagtataaagagtttcgtctgttgacaaaagtcattctctttagtagaatagtagatgcgatgagtcgatag

SEQ ID NO: 1041 - DNA, 282 bp, Streptococcus pneumoniae
atgggatatacagttgctgtagtcggcgcgacaggtgctgtcggtgctcagatgataaaaatgttggaagaatcaacactttcaatcgataaaatccgttaccttgcttgtgcacgttcagcaggtaagtcagtgggatttaaagatcaagatattacaattgaagaaacgactgaagcagcttttgaaggagttgatattgctctcttttcagcaggtagttctacatcagctaagtatgcaccatacgctagtaaaagctggcgtggtagtagtagataa

SEQ ID NO: 1042 - DNA, 276 bp, Streptococcus pneumoniae
aaagctggcgtggtagtagtagataatacatcttatttccgtcaaaatccagatgttcctttggttgttccagaggtcaatgctcatgcacttgatgctcacaacggaatcattgcctgccctaattgttcaacaatccaaatgatggtggctcttgagcggtttcgccaaaaatggggcttggagcgtatcattgttttaacttatcaagccagtattcaggagctggtatgggagcaattcttgagacacaacgtgaacttcgtgaagtcttga

SEQ ID NO: 1043 - DNA, 666 bp, Streptococcus pneumoniae
gcggtttcgccaaaaatggggcttggagcgtatcattgttttaacttatcaagccagtattcaggagctggtatgggagcaattcttgagacacaacgtgaacttcgtgaagtcttgaatgatggtgtgaaaccatgtgatttgcatgcggaaattttgccttcaggtggtgacaagaaacattatcctatcgcctttaacgctcttccacaaattgatgttttcactgataatgattacacgtacgaagagatgaagatgaccaaggaaactaagaaaattatggaagatgatagcattgcagtatctgcaacatgtgtgcgtattccagtcttgtcagctcactctgagtctgtttatatcgaaacaaaagaagtggctccaatcgaagaagtaaaagcagctatcgcagccttcccaggtgctgttcttgaagatgatgtagctcatcaaatctatcctcaagctatcaatgcagttggttcgcgtgatacctttgttggtcgtatccgtaaagacttggatgcagaaaaaggaattcacatgtgggttgtttcagataaccttctcaaaggtgctgcttggaactcagttcagattgctgaaactcttcatgaacgtggattggttcgtccaacagctgaattgaaatttgaattaaaatag

SEQ ID NO: 1044 - DNA, 936 bp, Streptococcus pneumoniae
atgtcttatcaagatttaaaagagtgtaaaatcatcacagcctttattactcccttccacgaggatggttccatcaactttgatgctattccagccttgattgagcatttattggaccatcatacggatggaattcttctcgcagggaccactgctgagagtccaactttgacccacgatgaggagttggagttatttgcggctgtacaaaagattgtcaatggacgagttcctttgattgcgggtgtaggtactaatgatacgcgtgactctatcgagtttgtcaaagaagtagcggaattcggcggttttgctgctggtcttgctattgttccttactacaacaaaccttctcaagaaggaatgtatcagcattttaaagccattgcagatgcttctgacctaccaattattatctataacattccagggcgtgtggttgttgaattaactccagaaaccatgcttcgcttggctgatcatccaaatattatcggtgtcaaagaatgtactagcttggctaatatggcttacttgattgagcacaaaccagaagagttcttggtctatactggtgaggatggagatgctttccatgccatgaaccttggggcggatggggttatttctgttgcctctcatacaaatggggatgaaatgcacgagatgtttattgccattgcagaaagtgatatgaagaaagccgcagctattcaacgtaaattcattcctaaggttaatgctctcttctcttatccaagtcctgctccagttaaggcagttttgaactacatgggatttgaagctggaccaactcgtctacctcttgttccagcaccagaagaagatgctaaacgcattatcaaggttgtcgtagatggcgactacgaagcgaccaaggcaactgtaacaggtgtcttaagaccagattactaa

SEQ ID NO: 1045 - DNA, 1374 bp, Streptococcus pneumoniae
atgattacacgtgaatttgataccatcgctgctatctctactccactaggtgaaggggctattggtattgtccgcctgagcggaacagacagttttgctattgtgcaaaagatttttaaaggaaaagacttgaacaaggttgccagccacactctcaactacggtcacattattgatcctctgactggtaaagtcatggacgaggttatggttggggctatgaagtctccaaagaccttcactcgtgaggatattatcgagattaacacccacggtggtattgcggtgaccaatgagattctccagctagctatccgtgaaggagctcggttggcagaacctggtgaatttaccaaacgtgcctttttaaacggtcgcgtagatttgacacaggccgaggcggtgatggatatcatccgcgccaagacagacagggccatgaacatcgcggtcaaacaacttgatggttccctttctgatcttatcaataatatccgtcaagaaatccttaatacacttgcccaagttgaggtcaatatcgactatcctgagtatgacgatgttgaggaagccactactgctgttgtccgagagaagacaatggagtttgagcaattactaaccaatcttcttaggacagcacgtcgtggtaaaatccttcgtgaaggaatttcaacggctatcattggacgtcccaacgttgggaaatcaagccttctcaacaacctcttgcgtgaggacaaggctatcgtaacagatatcgctgggacaacacgagatgtcatcgaagagtacgtcaacatcaatggtgtacctctcaaattgattgatacagccggtattcgtgaaacagatgacatagtggaacaaatcggtgttgagcgttcgaaaaaagccctcaaagaagccaacttggttctactagtgctaaatgccagtgaaccactgactgcgcaagacagacaacttcttgaaattagccaagataccaatcgcattattctacttaataaaaccgacctgccagaaacgattgaaacttcgaaactacctgaagacgttatccgtatttcagtccttaaaaaccaaaacatcgacaagattgaagagcgaatcaacaacctcttctttgaaaatgctggcttggtcgagcaagatgctacttacttgtcaaacgcccgtcacatttccctgattgaaaaagcagttgaaagcctacaagccgttaatcaaggtcttgagctggggatgccagttgatttgcttcaagttgacttgactcgtacttgggaaatcctcggagaaatcactggggatgctgctccagatgaactcatcacccaactctttagccaattctgtttaggaaaataa

SEQ ID NO: 1046 - DNA, 225 bp, Streptococcus pneumoniae
gtggtaaaatggaagaaatcaaaactagtggaggaagctattatgccatttgtacgcatcgatttatttgaaggacgcacgctcgagcaaaagaaagctcttgctaaggaagtaacggaagcggttgttcgcaacactggagcacctcaatctgctgttcatgtcatcatcaacgacatgccagaaggaacttatttcccacaaggggaaatgcgcaccaaataa

SEQ ID NO: 1047 - DNA, 492 bp, Streptococcus pneumoniae
gtgattatgacctcggctctggatacgcgtgaccgtgtgggctatgtgtcgagtcgaattggcatgaaacgccctgcccttgcgattgaggaaacaacggatatctttggctatatccgagacctaccagaaaaaccttactgtgttttggtcgatgaagcccagtttctcaaacgccaccatgtttatgacctagctcgtgttgtggacgagttagacatacccgtcatggcttttggcttgaaaaatgactttcgcaatgaattgttcgaaggttccaaatatctcttgcttttagcagacaagattgacgaaatcaagaccatctgtcagtattgcaagaaaaaggcgaccatggtgttgcgaacacaggatggactgcccgtttacgatggagaacagatccagattggtggtaatgaaacctatatctcggtttgccgtaaacattattttgcccctgaaatcaataaggagaatgaagaaaaatga

SEQ ID NO: 1048 - DNA, 843 bp, Streptococcus pneumoniae
atgaacatctatgatcaactacaagctgtagaagaccgttatgaagaactaggagaattgctgagtgaccctgatgtcgtttcagacaccaagcgttttatggagctttcaaaagaagaagcttccaatcgtgacaccgtaatagcctaccgtgagtataaacaagtccttcaaaatatcgtcgatgccgaagagatgattaaggaatcaggcggagatgcggacttggaagaaatggccaagcaagaactcaaagatgccaaggctgaaaaagaagaatatgaagaaaaactgaaaattttgctccttccaaaggatccaaacgatgacaagaatatcatccttgaaatccgtggagcagctggtggagacgaagcggcacttttcgctggagatttgctaactatgtaccaaaagtatgcggaagcccaaggttggcgctttgaagtcatggaagcctctatgaatggtgtcggtggttttaaagaagtggttgctatggtttcaggtcagtctgtatactctaagcttaagtatgaatcaggtgcccaccgtgtgcaacgtgttcctgtgacagaaagccaaggccgtgttcatacttcgacagcgacagttcttgttatgccagaagttgaagaggttgaatacgacattgatccaaaagaccttcgtgtcgacatctatcacgcctctggtgctggtggacagaacgtcaataaggttgcgactgccgttcgtatcgttcacttgccaaccaatatcaaggttgagatgcaggaagaactgtacccagcagaagaaccgcgagaaggctatgaagattatccgtgcacgcgtcgctga

SEQ ID NO: 1049 - DNA, 429 bp, Streptococcus pneumoniae
ttgatccaaaagaccttcgtgtcgacatctatcacgcctctggtgctggtggacagaacgtcaataaggttgcgactgccgttcgtatcgttcacttgccaaccaatatcaaggttgagatgcaggaagaactgtacccagcagaagaaccgcgagaaggctatgaagattatccgtgcacgcgtcgctgaccactttgctcagattgctcaggatgaacaagacgctgagcgtaagtcgacaatcggtactggtgaccgttcagaacggatccgaacttataacttcccacaaaaccgtgtcacagaccaccgtatcggcttgaccctccaaaaactagatacgattttgtctggtaaattggacgaagttgtggatgccttggtgctttatgaccaaacacaaaaactagaagaattaaacaaataa

SEQ ID NO: 1050 - DNA, 840 bp, Streptococcus pneumoniae
atgaaattagctcaattattttcaaattttgaagaagagttgataagacaaggagaggaagcggaaagcctctcttttgtctatcgtagtctgaaaaatctatcttttacagactttatttttgccctccagcaggaggtgacaacagaggaagaaaaacaatttgtagaagatatttaccagcaactagcagctcacaagccagctcagtacatcattggacaggcagatttttatggaatgcatttaaaggtggatgaacgggttttgattcctcgtccagaaacagaggagttagtggagcttattctaactgaaaatcttgagacgaatctctcagttctggatattggaacaggtagtggagctattgctctcgctctagcaaaaaatagaccagattggtcagtgacagcagcagatgtttctcaagaggccttagagcttgcatcagagaatgctagcgatcaaaatcttaatatattttttaaaaaatctgattgttttgcagaaatttctgaaaaatatgatataattgtatccaatccaccctatatctctcgtgaagatgagtcagaggtaggcttgaatgttttgcattcggagcctcatctagctctctttgcagacgaggatggcctagctatttactgtagaattgcggaagatgcaaaagactatctcaaggatggtggtaagatttaccttgaaattggatacaagcaaggtcaaagtgttcccgaactttttagaaaacatcttcctgaaaaaaaagttcgaacactcaaagaccaatttggtcaagataggatggtcgtggttgatgatggacaggattag

SEQ ID NO: 1051 - DNA, 603 bp, Streptococcus pneumoniae
atgatggacaggattagacaagagttggaaaagggtggagctgtcattctgcctacagagacggtttatggtctttttgccaaggccttagacgaaaaagcagttgaccatgtttaccagctcaaacgtcgtcctagagacaaggcgctcaatctcaatgttgcctctttagaggatatcttgcacttttctaagaatcagccagcttatctacaaaaacttgtagagacctttttgccaggtcccttgaccattattctcgaagccaatgaccgagttccctattgggtaaattctgaccttgcaactattggatttcggatgcccagtcaccctatcacactggatttaattcgagagacaggtcccttgattgggccgtctgccaatatctcaggtcaggcaagtggtgtaacctttgaacaaattctgaaggattttgaccaagaggttctgggtctggaagacgatgcttttctaactggacaggattcaactattgtggatttgtctggagacaaggtgaaaatcttacgccaaggcgcaattaaacgagaagatattcttgctcggttgccagagatttcttttgaggaggcttga

SEQ ID NO: 1052 - DNA, 432 bp, Streptococcus pneumoniae
atgctaagagatttgcaagaaacagatgtgaaagcgatatgtgacatcaaccaagagactttgggttatacttttagtccagaggaaacggctagccaactagctagactgtctcaggattcccatcatttcctacttggctatgaggatgcagctaatcatgtcttacttggatatgtccacgctgaagtttacgaatcactctattccaaagcaggatttaatatcttagctttagcagtttcacctcaagcgcaaggtcaaggtatcggtaaaagtttactacaagggttggaacaagaagccaaaagatgtggttatgggtttatccgcttaaattctgccaatcatcgtctgggtgctcatgcattttatgaaaaagttggctatacttgtgataaaatgcagaaacggtttattcgcatcttttag

SEQ ID NO: 1053 - DNA, 1257 bp, Streptococcus pneumoniae
atgatttctgacaaagatgattttaaagcatatgatgctgatctctggaatgctattgccacagaagaagaacgccaacaaaataatatcgagttaattgcttcggaaaacgtagtttccaaggctgttatggcagctcaagggtctatcttgacaaataaatatgccgagggttacccaggacgccgttattatggtggaactgatgtagtagacgttgtagagactcttgctattgaacgcgcaaaagaaattttcggtgctaaatttgccaatgtccaaccacattcaggaagccaagctaactgtgcggcttacatgtccttgattgagccaggtgatacggttatgggaatggatttggcagcaggtggacacttgacccacggagctccagttagcttctctggtcaaacctacaactttctttcctatagtgtggatcctgaaacggaacttttggactttgatgctatcttgaaacaagcccaagaagtaaaaccaaaactgattgtagctggtgcttcagcctattctcaaattattgacttttcaaaattccgtgaaattgcagatgctgttggggctaagcttatggttgatatggcccacatcgctggcttggttgcagctggtcttcacccaagcccagtgccatacgctcatatcactacaacaacgacccacaaaacccttcgtggtcctcgtggtggtttgattttgaccaatgatgaggatttagctaagaaaatcaattcagctattttccctggtattcagggtggtcctttggagcatgttgtggctgctaaggcagtttccttcaaagaagttttggatccagctttcaaggaatatgctgccaatgtaattaagaacagcaaggctatggcagatgtcttcttgcaagaccctgatttccgtattatttcaggtggaactgaaaaccatctcttccttgttgatgtgactaaggttgtagaaaacggaaaagttgctcaaaacttgctggatgaagtcaatattaccctaaataaaaattcaatcccttacgaaaccttgtcaccattcaagacaagtgggattcgtatcggagcagcagctattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggaataa

SEQ ID NO: 1054 - DNA, 1008 bp, Streptococcus pneumoniae
atgccttcccattatacgaggaataaaacttttatggacatttatattaagaaagccattattcaccagttcagtccggatgataccgagctgttcttagcagataagtttctcaatattactccaaaaatcgaagaatacctacgtaaaaaaattgaacatgtgtattcagatgaagccaagactgggattttcgaagaagaaaatcccttcttcaatcatattacagacgatttgttggagacatcagtaacgctggctaatctctggaaagaggagtttagcatttctgaaaatctcaagaccaatgacttgatttttgttcaattttctaaagaaggtgtagaacatttcgctttcttgcgaattgccctgcgggagaccttgacccacctcggaggagaagttgataatccaatcaagctgactcagaataacctgcctggatttggaacgggtgctgacgaggccttggtggtcaatcttcagagtcgcaagtatcacctgattgaaaaacgaatcaagtacaacgggacttttttgaactatttttcagataatcttcttgctgtcgctcctaagatttctcctaaaaaatctatcaaggaactggaaaaaacagcccagagaattgctgaatcttttaacacagatgattttcaatttcaatccaaggtcaaatcagcgattttcaacaacctagaagaaagcaatgaattgtcacctgagaaattggctaatgacctttttgacaacaatctgacggctcgtttgagctttattgaccaagtcaaagaagccgtaccagaacctgttcaatttgatgaaattgatgcaagtcgccaattaaagaaatttgaaaaccaaaaactctccttatcaaatggaattgagctcatcgttcccaataacgtctatcaagacgccgagtctgttgagtttatccaaaacgaaaatggaacctactctatcttaatcaaaaatatcgaggatatccaaagtaaataa

SEQ ID NO: 1055 - DNA, 615 bp, Streptococcus pneumoniae
atgtttaaacgaattcgaagagtgcttgtactagcagtcttcctttttgctggctataaagcttaccgcgttcatcaagatgtcaaacaagtcatgacctatcaacccatggtgcgagaaatcttgagtgaaaaagacaccccagcaaacgaagagcttgtgcttgctatgatttatactgaaacaaaaggaaaagaaggcgatgttatgcagtctagtgagtctgcaagtggttccaccaacaccatcaatgataatgcctctagcattcggcaaggcattcaaactctgacaggcaatctctatctggcgcagaagaagggggtagatatctggacagctgttcaagcctataattttggacctgcctatatcgattttatcgcccaaaatggcaaggaaaataccttggctctagccaaacagtactctcgtgagactgttgcccccttgcttggtaatacgactggaaagacttatagttatattcaccccatttccatttttcacggtgctgaactctatgtaaatggaggaaattattattattctagacaggtacgacttaacctttacatcatcaaatgtttcactctcttttcaacatctggctag

SEQ ID NO: 1056 - DNA, 975 bp, Streptococcus pneumoniae
atgagaaagaaactctttctgactagtgctgcggtcttgtgggcagtaacagctatgaatagcgtccatgcagcaacagatgttcaaaaagttatcgatgaaacctatgtccaacctgaatatgtcctaggttcctccctatctgaagaccaaaaaaatcaaactcttaaaaaactgggctacaatgcctcaacagataccaaagaactcaagaccatgacacctgatgtttattctaaaatcatgaatgtggccaatgactctagcttacagttgtattcatcagccaagattcaaaagctaggtgacaaatcgccacttgaggtcaagattgaaacaccagaaaatatcactaaggtgactcaggatatgtaccgaaacgcagcagtaacgctgggtatggaacatgccaaaatcactgtagcagcccctattccagttacaggagaaagtgctttagcagggatttactattcgctagaggctaatggagccaaggtgccacaagctaataaagatttggctcaagaagagctaaaagctttgtcagatatcaatgctgaaaacaaggacaaatcaggctatgatgctaataaattaaacgttgccctagctgatatcaagtcaggactcgccaaagctaaagaaagcaagggaaatctgacagaagaagatatccgcaagattgttgaagataccttaaaaaattacaaacttgatcaggtcataacaggaaaccagatcaatatcatcatcaattttgccttgaatctctcaaagagtgatatcctcagcaatgcagatttcactaaaaccctaaatgaccttaaacaaagcatcgtatcacaagctggcgacagttttaaaaatatcaaccttaactttgatgcggataaggcgctagaggacggtggtaacttcttaagctccctctggcaagcccttgtcaacttcttcaagagttttggttcttaa

SEQ ID NO: 1057 - DNA, 1644 bp, Streptococcus pneumoniae
aaagagaaaagaatgttaaagaaaaatgatattgtagaagttgaaattgttgacttgacccatgaaggggcaggagttgccaaggtagatggtttggtcttttttgtagagaatgctttaccgagtgaaaaaattctcatgcgtgtcctcaaggtcaataaaaagattggctttggaaaagttgaaaaataccttgtccagtcaccacaccgtaatcaagatctagatttggcttacctgcgttcaggaatcgcggatttaggacacctttcttatccagaacagctcaagtttaaaaccaagcaagtcaaggacagtctctacaagattgctggaattgcagatgtagaagttgctgaaacgcttggtatggaacatccagtcaagtatcgcaataaggcgcaggtgcccgttcgtcgagtgaatggtgtcttggaaacaggatttttccgtaagaattcgcacgacctcatgccccttgaagatttctttatccaggatcctgtcattgaccaagtcgtagtagctcttcgagacctgctccgtcgttttgatttaaaaccttatgacgaaaaggaacagtctggattgattcggaatcttgtggtgcgtcgtggtcactattcaggacaaatcatggtcgttttggtgacaactcgtccaaaagtttttcgtgttgaccaattgattgaacaagttatcaagcagttcccagagattgtgtctgtcatgcaaaatatcaacgaccagaataccaatgcgatttttggtaaggagtggcgcactctttatggtcaagactatattacggaccagatgttgggaaatgacttccaaatcgctggcccagccttttaccaagtcaatactgaaatggcggagaaactctatcaaacagccattgactttgcagagttaaaaaaagatgacgtgattattgatgcctattctggtattggaaccattggtttatcagtcgccaagcatgtcaaagaagtctacggtgttgaactgattccagaagcggttgagaatagtaaaaaaaatgctcagctgaacaatatttcaaacgcccactatgtctgtgacacagctgaaaatgctatgaagaattggcttaaagatgggattcaaccaaccgttatcttggttgatcctccacgcaagggcttgacagaaagctttatcaaagcaagcgcccaaacaggagccgatcgcatcgcctatatctcctgcaatgtcgcaaccatggcgcgtgatatcaaactctaccaagaattgggatatgaattgaagaaagtccagccggtggatctatttcctcaaacgcatcacgtcgagacggtagcacttttgtccaaactcgatgtcgataagcacataagtgttgaaattgagctggatgagatgaatttgacaagtgcggagagcaaagcaacatatgctcaaatcaaagaatatgtttggaataaatttgaattaaaagtttcgacattatatattgcacagataaaaaagaaatgtggaatagaattacgagaacattacaacaagtctaaaaaggataaacaaattattccacagtgtacacctgaaaaagaagaagccatcatggatgctttgagacacttcaaaatgatttaa

SEQ ID NO: 1058 - DNA, 294 bp, Streptococcus pneumoniae
ttgtatgccccttttatgaaaaaagataaagaggtttatgataaagtttgtgaatatcttagtcctcatttgaataaagatatggaggtgcttgaacttgcttgttggtttcgtgtcataacagttatagaggcaaatagttatgtaaatataaggagttcaagacttctaccaaagtttaaaactcaaaaaataaatagttggtgtgctgcttacaatatccattttaataatggatattgtaagcagcataccaatgaatttaaagattctttaaagagtcttattttgtga

SEQ ID NO: 1059 - DNA, 249 bp, Streptococcus pneumoniae
ttaagtgccataatatccctctttttttcttcattaaatttatttaattatagcataaatattgatttcattcaatcttacattgatttagtgatttgttttagagaatttgttgtgttattccgtccttattttgccataaattgttttaagtgggacctcttatccttaccatttttacctcctaattttgagtataaaaaagacgatagagtttttaatttctatcgtctgagatttacatattaa

SEQ ID NO: 1060 - DNA, 195 bp, Streptococcus pneumoniae
atggatacagttagcaaaaaaagactaaagaaaacagatgtaatagctatggcaggacttacaacaaatgttatggcacaaatgggaaaggataaaccaattacatttaagaatttagaaagaatatgtaaggctttatcttgcactcctaatgatattattagttttgaagataattttagtgacgaggaatag

SEQ ID NO: 1061 - DNA, 240 bp, Streptococcus pneumoniae
ggattatgcaagagaagtataggctttaatgaagttgaagaaaacatcaatcaaggtactggtcaaataactacttttaatcaattaggcttcaagggatattcagataagccagatggttggtatttacctaaaaatatgaatgatgtagcaataatccttgaaacaaaatcagaagaaagagatattagcaaacaaatttttattgatgagttaatgaaaaatatagacataatttaa

SEQ ID NO: 1062 - DNA, 1035 bp, Streptococcus pneumoniae
ggagtttttatgaaaaacaaattttttctaatagctattttagctatgtgtatagtttttagcgcttgttcttctaattctgttaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatcaaaaattgctcctgtagcagcatacaaatctaaaccttggcaaactttatggagagatatgattaaaattgattcaaaagccttaggtatggaaaaagaaggtgatgagttaatcaaaaatactgaagctcgtatatccaaagaattagaaaaacatccagaaatcaaaggaaaaatcaaaggaaaaaaagtattatttactatgattaatgctgcagatacatcaaaattctggatttatactagcaaagatccaagagcaaattatttaacagatttaggtctagttttccctgaatcattaaaagaatttgagagtgaagatagttttgcaaaggaaatttctgcagaagaagcaaataagataaatgatgctgatgtaatcataacttatggtgatgataaaactcttgaagctttacaaaaagatcctcttttaggtaaaataaatgcaattaaaaatggtgccgttgctgtaattccagataatacaccgttagcagcctcatgcactccaacaccactttcaataaactatactattgaagaatacctaaatcttttaggaaatgcatgcaaaaatgcgaaataa

SEQ ID NO: 1063 - DNA, 636 bp, Streptococcus pneumoniae
cctaaaattataaaaggtagtagtgtagatatagaagataatgtagctgctccaaggctacctatttgccaaaatctaaatttgtctaagacgttattattcggtaaaattaaaaaacttacaaaactgcttaaagccatactaacacaagttcctgataaggctagttttataggggtaaggcctgcttttccgcttacagcaatcgcgtatacaaaaattacacttactaagccaccaatgattgcaaaacttatatggcttatgcttgatgaaattcctaaaaaagaaagaccaattactacactaagacttgctcctgtgtttataccgagtatacctggatcagctattgggtttctagtaactgattgcatcaatacaccgcttatggcaagactagaacctgctaaaattgcaaaaatagttctaggtattcttttatatataattgatttaataaaatcatcatttgtattgcccattccaaaagctgctaaaaaatctctgatattaatttcttttgttccaagctttaatgacaaaaatattgtaataagaagacctaggcagattacaaaaattatgcctaggtttatttgttttttatttcgcatttttgcatgcatttcctaa

SEQ ID NO: 1064 - DNA, 1008 bp, Streptococcus pneumoniae
atgcgaaataaaaaacaaataaacctaggcataatttttgtaatctgcctaggtcttcttattacaatatttttgtcattaaagcttggaacaaaagaaattaatatcagagattttttagcagcttttggaatgggcaatacaaatgatgattttattaaatcaattatatataaaagaatacctagaactatttttgcaattttagcaggttctagtcttgccataagcggtgtattgatgcaatcagttactagaaacccaatagctgatccaggtatactcggtataaacacaggagcaagtcttagtgtagtaattggtctttcttttttaggaatttcatcaagcataagccatataagttttgcaatcattggtggcttagtaagtgtaatttttgtatacgcgattgctgtaagcggaaaagcaggccttacccctataaaactagccttatcaggaacttgtgttagtatggctttaagcagttttgtaagttttttaattttaccgaataataacgtcttagacaaatttagattttggcaaataggtagccttggagcagctacattatcttctatatctacactactaccttttataattttaggtcacttgatagctatatttatttcatcagatttaaacgctttagctatgggtgatgaaatggctgttggtcttggagttaatgttaataggataagatcacttgcaataattgcaagtgtgcttttatgttcaagtattactgcaattggtggacctattggcttcgtaggtcttatagttcctcacttttgtggcttatttataagcaaagatatacgcacaatgaccatttcttcatcttttataggtgcagagctcttgcttatatgtgatataatcggccgtatgttaggtaaaccaggtgaaattgaagtagggataattactgcaataatcgggggtccagtacttatttatgtaactatgaaaaatagaggggttaataactaa

SEQ ID NO: 1065 - DNA, 1008 bp, Streptococcus pneumoniae
atgcaaaatttaattataggtattcaaaaaagaaaaaatagaataacactattttcctcactatttttattaataataatcagtctatcatttttcattttacttatcggagatgaaagttattctttttcaactttgattaaagtcttaaatagtgaaactgttcctggagctagtttttcgattatggaaattagattaccaaaattattagcaggaattatagctggctggtcttttggattggcaggatttatctttcaaactatgttaagaaatcctcttgcaagtcctgatataatcggtgtcacaagttcttcatctattgcagcggtcttttgcatattggtattaaaaacaaatagtttaactactggaattatttcaataacttgtggactaacatcatctttaatattatttttactagctaaaaaagatggtttttcagcagcaagactgataatattaggtattggttttcaagctgtcacaagagcaggcacctcatttttattgttgaaagtagcaagatatgaattacaagaagttatgagatggctcagtggctctttatcttttacaaagttagatgacatacctcttgttctaatagtaagtattattgctactatattagttttattttttaataaaagactagaaattattgaacttggtgaagaaatagcaatcggacttggagcaaatcccgagctttcaaggcttgttttaattttttgcgctgtatctttaactgctttttctacttcaattacaggaccaatagcttgtatatcttttttagctggtcccatagccttaaatattggcaagaaaagaagcccaatattagctggattggttggaattttactagttttgttatcagacatattctctcaaaatattttaccagctagatatccagtaggtgttgtaactggcttgttaggttcaccatacttaatatacttactaataaaaatgaacaggaggaatatataa

SEQ ID NO: 1066 - DNA, 222 bp, Streptococcus pneumoniae
aaaccaatacctaatattatcagtcttgctgctgaaaaaccatcttttttagctagtaaaaataatattaaagatgatgttagtccacaagttattgaaataattccagtagttaaactatttgtttttaataccaatatgcaaaagaccgctgcaatagatgaagaacttgtgacaccgattatatcaggacttgcaagaggatttcttaacatagtttga

SEQ ID NO: 1067 - DNA, 414 bp, Streptococcus pneumoniae
atgtctgataacaaaactagtaaaattccaaccaatccagctaatattgggcttcttttcttgccaatatttaaggctatgggaccagctaaaaaagatatacaagctattggtcctgtaattgaagtagaaaaagcagttaaagatacagcgcaaaaaattaaaacaagccttgaaagctcgggatttgctccaagtccgattgctatttcttcaccaagttcaataatttctagtcttttattaaaaaataaaactaatatagtagcaataatacttactattagaacaagaggtatgtcatctaactttgtaaaagataaagagccactgagccatctcataacttcttgtaattcatatcttgctactttcaacaataaaaatgaggtgcctgctcttgtgacagcttga

SEQ ID NO: 1068 - DNA, 795 bp, Streptococcus pneumoniae
atgaaaggtctgtggtcaaatagtcttacctgcggttatgatgaaaaaataatcttggaaaatataaatataaaaatacctgaagaaaaaatatcagttattattgggtcaaatggttgtgggaaatcaacactcattaaaaccttgtctcgacttataaagccattagagggagaagtattgcttgataataaatcaattaattcttataaagaaaaagatttagcaaaacacatagctatattacctcaatctccaataatccctgaatcaataacagtagctgatcttgtaagccgtggtcgtttcccctacagaaagccttttaagagtcttggaaaagatgaccttgaaataataaacagatcaatggttaaggccaatgttgaagatctagcaaataacctagttgaagaactttctgggggtcaaaggcaaagagtatggatagctctagccctagcccaagatacaagtatcctacttttagatgagccaactacttacttggatatctcatatcaaatagaactattagacctcttgactgatctaaaccaaaaatataagacaaccatttgcatgattttgcacgatataaatctaacagcaagatacgctgattacctatttgcaattaaagaaggtaaacttgttgcagagggaaagcctgaagatatactaaatgataaactagttaaagatatctttaatcttgaagcaaaaattatacgtgaccctatttccaattcgcctctaatgattcctattggcaagcaccatgttagctcttaa

SEQ ID NO: 1069 - DNA, 261 bp, Streptococcus pneumoniae
agaataacagcaatattaaaaagatcaggactgataataaacaaaaagaaagtacaacgactagttcaaaagctaaaacttcaagtaaaaagttattcaagaaaatctagaaaatactcatcctacaaaggacaggtaggaaaaatatcagacaacaaaataaaaagaaatatttattaccgaaaaaaaggggaaatcgagtcaagtaccaacaggctcatctattccaaaaagatatttactcgatggaaaaactcctag

SEQ ID NO: 1070 - DNA, 456 bp, Streptococcus pneumoniae
aaagaaatatttattaccgaaaaaaaggggaaatcgagtcaagtaccaacaggctcatctattccaaaaagatatttactcgatggaaaaactcctagaattagtgctacaaatattgacaatggtatcttaggttactacgaagatatagatgataaaaattatagagtttttgaaaattttatatctgtttcatgtttaggagcagtcttttatcataaatataaagcaagcctagatatgaaaattcattgtttaaaattaaaaaataaagaattgaataaagaagtagcattctatttaacttcaattattaggcaagctttaaaaaatactgaatataaagatcaaatatctagcacagtattgccagatatcaaaattaaattaccgatagacagtagaggtactccagattggaattacatggaaagatatagagagagggagagatag

SEQ ID NO: 1071 - DNA, 276 bp, Streptococcus pneumoniae
agagagggagagatagataaaaagtccacccccattttttatggagaattcaaaaatgtaaggttaagcaaagaagaatataaaaatctaaaagaaaaattaaactcacacacagatataatgataaataaactatccagatacatggaaagcagtggtaagacctatcaaaaccactatgtgacaatcttaaaatggtatgaagaagataaagacaaactaagacagaaaggtttaaataaaaaaatgaattatgatgtaggagaatctttatag

SEQ ID NO: 1072 - DNA, 249 bp, Streptococcus pneumoniae
gtgcctttccacctctttttatctataaagattctcctacatcataattcatttttttatttaaacctttctgtcttagtttgtctttatcttcttcataccattttaagattgtcacatagtggttttgataggtcttaccactgctttccatgtatctggatagtttatttatcattatatctgtgtgtgagtttaatttttcttttagatttttatattcttctttgcttaaccttacatttttga

SEQ ID NO: 1073 - DNA, 210 bp, Streptococcus pneumoniae
agaaatgctagaagacttttagatgacagttaccaagagggtctaattttcactgctacttatgcagtgggaattggacctttttatataagcaaattctatttcaaaattggttaccaagaaagacttcttttcactgttaagtataagagggtaatttatagaattttgttacatcaagataaatattttctgatggtcaaattttaa

SEQ ID NO: 1074 - DNA, 1680 bp, Streptococcus pneumoniae
atgtcaaaagaaaaaataaaagtatacctctatacacgagtatctacgtcaatacagatagaggggtattcgttagaggcacaaaaatcacgaatgaaagcttttgctatttacaacgattatgaaattgttggagagtatgaagatgccgggaagtctggcaagtctattgaaggtagaatacagttcaatcgaatgatggaagatataaaatctggaaaagatggagtatcttttgttcttgtgtttaagttatcaagatttgcaagaaatgccgctgatgttctttctacacttcagataatgcaggattatggagttaatcttatctgcgttgaagatggcattgattcatctaaagatgctgggaaactaatgatttctgttttatcagctgtggctgaaatagaaagagaaaacatccgtattcaaacaatggaaggtcgcattcaaaaagcaagggaaggaaaatggaatggtggctttgctccgtatggatataaacttgaagacggcaagctgtttataaatgaggaagaggcagttgcaataagaacgattttcgaccagtatgtaaatactacgataggagccaatgggatatctaaatacttagagaatcatggaattagaaaaatcccaagacagaatggtaagaatcctttgtttgatgcaggtcttataagaaagatattaaagaatcctgtatataatgggaaaatagcatttggaagaagaactttagaaaaagttcatggtacaagaaatgaatataagcaggttgaacaagatgaatatctaatatctgaagggatacatgaagctatagtttccgatgaagtttggcaagctgctcaggttaagctaaaatctcaagcaaagaaatatgagcatgtgaataaaggaaaagatacacgcacacacttgctttctggaattgtaaaatgcccgatatgtggagtgggaatgtttgggaacaagtgtatcaagaaaaagaaagatggcacaaagtataaagatttttattactatggttgtaaacataggcagatgataagaggtcataagtgtacattcagtaagcaaattagagaagaattgttagatgatgctgttgcagaggtgattgtcaagatagtaagtaatccgaaatttgcttctatgatgcaagaaaaaatcaacatgaaggtggatacctctgaaatagaaaaagaaatagataattaccaaaaggaattgagaaagagtcattctacaaagtttaagctaattgaggaaatagataatttagatgttgaagataagcattataagagaaggaaacaggatttagatgatagactatatcgtatgtatgacaaaatagatgaattagaatcatcactaattgatgcgaaagcaaagaaacagactattgaagctgaaaagcttacaggagataacatatataaggttctaatctattttgataagctctataaagtcatgaatgatgtagagcgtaggcagttaatttcagctttgatttctgaaattcaagtttatgaagaaaaacaatctaacggacaatggctaaaatccattacttttaagctaccaattatagaagaaaatctcaacataggtttggacaatgatgaacaagttgaatgtgtaagtttattagagaaacgtagttaa

SEQ ID NO: 1075 - DNA, 612 bp, Streptococcus pneumoniae
gtgcttatttacattagcctgataatgaaaatggagagattatcgatggttatattggaattgtaccaaaatgattattctaaagatttagtagcatttgattccatagaagatgggaaagcctttgtagctcaaatcccgggatacactctggaaacagaagatggttttgaagtggagtattttaatcctaaaaacataccggattatatggaaattatttttaacggaaatattgttcctttatctaaatttatgttcgatcctgaggaaaatgtaaacattatttggaaagagatttcaaatttatccctcaaaaatgatagagtgatcgaaggatattcaaaaattgatgcatatgtcgttaacaaccatgaagttaaagcctatgtcgaaacaagagaaacgaactatcgtaaagcaaaagacttcttagaaagccgcggatatgaaatcgacagaagctttttcggaagtgaagacggtgaagcgattctttacagaaaaaaagggatcgaagtttggcatttcttgtgtcacttagacccaatgtttgtagagattgaagatgtagaaggatatgttaaagaagaagttggagagattcaatag

SEQ ID NO: 1076 - DNA, 189 bp, Streptococcus pneumoniae
atggcaaccgataaaaatagaataatgattagcttggatgataaaaatctagagaaacttgaaaatttagtagaagatgctagagatagaaggggaatgcgactaacaaagtcccaggttattgaattactcctaaataccgttgattatttcgatgatattatgggggctatttactcaaaaaaataa

SEQ ID NO: 1077 - DNA, 759 bp, Streptococcus pneumoniae
atggttgtttatattagacaaagtaaattaccaagtgaggtttcaattaataaatacaatgctcaagtaggtgcctacttacaaggagaagaagctgttttatatcaatctttttctgaaataaaagagttaacaagtgaagatatagttgtagattatataatggagactagagcattactaaaaatgatgggcttaaacgttccggttcatgactatcctattgagcttaaagagttttatggtcgaaagatttatgctggtattttaggagagattgtgaatatacctgataattggggaaaatttattaagcctaaagctggttcaaaagtctttactggaagagttgttaatggaacccatgatttaataggtattggtctacctttcgactatcctatatggattagtgaggttgtagaattcatagctgaatggcgttgttttgtgttagatggtcgcgtattagatgttcgaccctatacaggtgattatcatgcacaatttgatgcaagtgtaattgatgaagcgatatcatgttggaaagatgcgccaatagcttatggactagatatcggtgttactcgcgatggcagaacacttgttgttgaagtaaatgatggttatgcattgggaaattatggcctatctcctttaaaatcaatcaattttcatagagctaggtggaaagaaatggtaaaaccctattttgaaaaaaatgaaatttttaaaatccaacaggatgttattttctaa

SEQ ID NO: 1078 - DNA, 855 bp, Streptococcus pneumoniae
atgcttggagcaattattggagatattgtcggttctgtttacgaatggaacaatatcaaaacaaaggactttcctttatttcggaaggactgcttttttacagatgacacggttatgacctgtgctgttgcagaagcaattatgaatggtggacaaaaagacgatttcattgacgcgatgaagaaatatggcagaatgtatccgaatgctgattacggtgctcggtttaatgcatggctaaacagcgataaccgtgagccttataatagctttgggaatggatcagctatgcgtatttctccatgtgcttggatcatggactgtggtttttatgcgaaaactggtatgtggccatcatctagaggacttacgagtctttctgcagaggtaactcataatcatccagaaggtgtcaaaggcgctatggctacagctgatgctatctttctatgtcgtttttactttggtggttattgtagagagtacgagcaatcaattaacgacaatcctacagagtgtaaaagacgaattaaggattatatagaaaaagaatacgattacaatctatctcaaactttagatgaaatccgtcctaactatcgttttaacgaaacatgtcaggaaactgtccctcaagccattatcgcctttcttgaaagtagagacttcgaagatgcgataagaaatgccatctcacttggtggcgacagtgatactctcgcagcaatcacttgtagcatagcagaggcagcttacggtattcctgattggatcaaggataaggcctattcttacttggatgaacccttaaaggatgtagttaggcgatgggaaaatagaataaaagcgtattaa

SEQ ID NO: 1079 - DNA, 885 bp, Streptococcus pneumoniae
atgaaaaaagcaatggtaattatcaaccctacttctggtggcgagaaggctttggattacaaagaaaagctggagaataaagcaaaagaatactttgaatatgttgaaaccaaaattaccgaaaaagcgctggatgcaacacattttgctgaagaagcttctcgtgagcagtatgatgcagtggttgtgtttggtggagatggaactgtcaatgaagtcatttcaggtattgatgagagagactacattcctaagttagggattatcccaggcggtacgggtaacctcattacaaaacttttggaaatcaatcaagacatcgatggcgcaattgacgaactggattttgatttaaccaataagattgatatcggtaaagcaaatgacaactattttggttatatctttagtatcggttctctgcctgaggcgattcacaatgttgaaatagaggacaaaacaaaattcggtattttaacctatgctgtaaataccatgaagtctgtcatgacagatcaggtctttaacattaaggttgagacagaaaatggaaattatgttggtgaagctagccatgttttggtccttttgacaaattacttcgctgataagaaaatctttgaagaaaacaaggacggctatgccaacattttgattctgaaagatgcctctatattctccaaattatccgtcattcctgatttattaaaaggggatgttatcgcaaatgataatatcgagtatatcaaagcgcgtaatattaaaatctcttcagatagtgaattggagtcagatgttgacggagataaatcagataacctacctgtagaaatcaaagtcctagctcagcgagtagaagtattttcaaaaccgaaagaggattag

SEQ ID NO: 1080 - DNA, 279 bp, Streptococcus pneumoniae
atggaattgagtgctatttaccataggactgagtcggagtatgcctatctttataaggataagaaactccatattcgaattcgaactaagaaaggggacattgaaagcatcaacttgcactatggggacccttttatctttatggaggagttttatcaggatacaaaagaaatggtcaagataacttctggtaccttatttgaccattggcaggttgaagtgtcagttgactttgcacgtatccagtatctttttgagctcagagatacagaaggttaa

SEQ ID NO: 1081 - DNA, 1455 bp, Streptococcus pneumoniae
ttgtatggcgataaagggtgtgtggaaaattctctagaaaatcttcatgcaattgggaatggatttaagttgtcttatcttcatgagattgatgcctgcaaggttcctgactgggtttcaaatacggtatggtatcagatatttcctgaaagatttgccaatggcaatgctctattaaacccagaagggactttagactgggattcatctgtcacacctaagagcgatgatttctttggtggtgatttacaggggattattgatcatatggattacttgcaagacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattggttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacggaaccgagctagccttgactggaggaccagatccagattgtcgtcgttgtatgccttgggaacgtgtatcaagtgacaatgatatgctgaactttatgaagaggctgattaagattcggaaatacgcgtcagtaatcatttcgcatggcaagtatagccttcaagaaatcaaatctgatctagtagctctggaatggaaatacgaaggacggatcctcaaagcaatattcaaccaatcaacagaagattatcttttagagaaagaagcagtagcactagcaagcaattgccaagaattggagaatcagcttgtcatctctccagatggatttgtgattttctaa

SEQ ID NO: 1082 - DNA, 303 bp, Streptococcus pneumoniae
atgggtgcggcaagggattttttagaactaattaatcacaaagggctacctctttttaatccgcttgtaggtgattctcatgtaaataatagacaagaatatgacaatacagggagtggaaatttacaacctgaaaagtggaatgaaactgcaaagcagctttataatgctataatgtggttgattattttatggaatgctaagccggatacacctttatttaattttaaagacgaagtaattaagtataaaacatatgagccttttgaaagcagtataaaattggtatcaatcaatgagtaa

SEQ ID NO: 1083 - DNA, 429 bp, Streptococcus pneumoniae
atggatggaataacaaaagattttataaaaacggctaaactaatgaaacaattatggccccaattgaccgataaagaagctattgatgaagtaaaaaaatatacgaatggcaaaaatactgcaatctttactgaagttgaaggtgacacaattgtaggtctagcactatgttcactcagatttgattatgttgaaggttgtaaatatagtcctgttggattcttagaagggattattgttgacgaggaatatcgtttaaaggatattgctaaaaatctctgtacaaaatgtgaggaatgggcgaaaaataaaggatgtaaggaatttgcaagtgactgtactttaacgaatacggattctataagatttcatctcaatattggatttcaggaggcaaatagaattattcattttaagaaaaaattataa

SEQ ID NO: 1084 - DNA, 570 bp, Streptococcus pneumoniae
atgaagaaatatagtattgttgataaaattgtattatcaaccaagattaaaagaattatcatttttacagtttttcgagaaaattgggaaccgtacatgaaaaagtacacggaagtttttcaaagtcaatttcctaatctaaacattgattacttgctcctggacactgagcagattgatcttgatagctatctagatgctgacataattatcatcggtggtggaaatacggaaaaatatattgctacttatgttaatcaggagttcaaaagttatatcgatcatatgcttaataaagaggcaaaaattataggattttctgcaggagccctactattaggagaaaaagtctatgtctcacctaatgataattcagatcatcagataaagataaaaaatggattaggactctttagtcagtttttaattagtgtccattatgattcctggaatgataaagcaaataaggatagagctgaagaactcgttaatgttcccataattccactaaatgatcattcttgtcttgtattggataaacttggaaacatcatagagaaaattgactaa

SEQ ID NO: 1085 - DNA, 213 bp, Streptococcus pneumoniae
atgtacttcgtcatcgcagagttcaatgctaattggtttacacatcggaactccaagagaagctactttctccatcatatcaaattcaaatttttttataatctaacttcgacttatcagaaacacgcaagaaatatttttactgattttgatctgtcacacaatattttttatcatctgaccagcctttatttatggctatcttactactaa

SEQ ID NO: 1086 - DNA, 282 bp, Streptococcus pneumoniae
atgatggagaaagtagcttctcttggagttccgatgtgtaaaccaattagcattgaactctgcgatgacgaagtacattctttacacgaatggatagacggaagagatgcaatagatagcattttaacttattcagaaaaccaacaatacacatatggtgtagaagcaggaaagatacttagaaagattcatacaattcctgctacagaagtttgtgaagattgggaaatcttttttaatctaaaaattgatgataaaatctccaacgaaatgatatggtaa

SEQ ID NO: 1087 - DNA, 195 bp, Streptococcus pneumoniae
atgaatgatgaagcaagtaaacaattaagagatagccgtttcaagagccttgcaggtgttcagcgcacgacttttgaagagatgttagccgtgctaaaaacaacttatcaacgtaaacacgcaaaaggtggacgaaaaaccaaattaagcctagacgatctcctcatggtaactattcaatacatgcgagaatag

SEQ ID NO: 1088 - DNA, 1230 bp, Streptococcus pneumoniae
atgaagattagtaagaggcacttattaaattattccatcttgattccctacttacttttatctattttgggcttgattgtggtctattcgaccaccagtgctattttaattgaagaaggcaagagcgccttgcagttggttcgaaaccaaggaatcttttggattgttagtttgatactgattgccttaatttataaattgagactagattttttgagaaatgagcgactaatcattttagttatattaatagaaatgcttttattgttcttggctcgttttattggtatttcagtaaacggggcatacggttggatttcggttgcaggagtaactattcagccagctgagtacttaaaaatcattattatttggtatttagctcaccgattctccaaacagcaagaagaaatagctacttatgattttcaagttttgactcaaaatcaatggcttccccgtgcttttaatgattggcgattcgttctcctagttctgattggaagtttgggaattttccctgatttaggaaatgcgactattttagtcttggtttccttgattatgtatacagttagtggaatcgcttatcgctggttttcaaccattctggcgctcgtatctgccacttctgtctttgtcttgaccactatcagcctaatcggtgttgagaccttttcaaaaattccagtatttggctatgtagccaagcgctttagtgccttttttaatccttttgccgatcgtgctgatgcaggtcaccagttagctaattcttattttgccatggtcaatggtggttggtttggtctaggtcttggaaactcgattgaaaaacgaggttatttgccagaagctcatacagactttgtcttttctatcgtgattgaagaatttggctttgttggtgccagtcttattttagctctcttgtttttcatgattttgcggattatcttggtcggtatccgagcggagaatcctttcaatgccatggttgcactcggtgtcggagggatgatgttggttcaggtatttgtcaatatcggagggatttcgggcttgattccatctacaggagtgactttccctttcttatcccagggtggaaatagtcttctagtcttatcagtggcagtagcctttgtcttaaatattgatgccagtgaaaaacgcgctaagttgtaccgagaattggaaaatcaaccaatgaaccttctgttgaagtag

SEQ ID NO: 1089 - DNA, 2697 bp, Streptococcus pneumoniae
atgtctcttcaaaaattagaaaattatagtaataaaagtgttgtgcaagaagaagtcttgattctaacagaattactggaagatattactaaaaatatgcttgccccagagacctttgaaaaaataatacagttgaaagaattatcaacgcaggaagattatcaaggtctaaaccgtctagtgactagcttatcaaatgatgaaatggtctatatttcacgctatttctctatcttgcctcttttgattaatatttcagaggatgtggatttagcttatgaaatcaatcatcaaaataatattgatcaggactatttaggtaaattatctacaacgattaaattggtagcagaaaaggaaaatgccgttgagatcctagaacacttgaatgttgtccctgttttgacagcccatccaacacaagtgcaacgcaaaagtatgttggatttaacaaatcatattcatagtcttttgcgtaaataccgtgatgttaagttggggttgatcaataaagataaatggtacaatgatttgcgtcgttacatcgaaattatcatgcagacagacatgattcgtgagaaaaaattaaaagtgactaacgaaatcacgaatgctatggaatattataacagctcctttttgaaagctgtacctcatttgacgacggagtataagcgcttagcgcaagcgcatggtctgaatttaaaacaggctaaaccaatcaccatgggtatgtggataggtggtgaccgtgatggaaatccatttgttacagcaaagaccttgaagcagtctgcactcactcagtgtgaagtcatcatgaactactatgataaaaagatttaccaactttatcgtgaattttctctttcaactagcattgtcaacgtcagcaagcaagtcagagaaatggctcgtcaatccaaggataactctatttaccgcgaaaaagagctttaccgtcgtgccttgtttgatattcaatcaaaaattcaggcaactaaaacctatctgattgaggatgaagaagttgggactcgttatgaaaccgccaatgatttctacaaggatttgattgccattcgagattctctactagaaaataagggtgagtccttgatttcaggtgattttgtggaattattgcaggcagtagagatatttggtttttacttagcgtcaattgatatgcgacaagactctagcgtctatgaagcctgtgtggcagaactcttgaaatcagcaggaattcattctcgttatagcgagttgagcgaagaagaaaagtgtgaccttctcttgaaagaattagaagaagatccccgaattctttctgcgactcacgcagaaaaatcagaattattagcaaaagaattagctatttttaagacggctcgtgttttgaaagataagttgggagatgatgtcatccgtcagaccatcatttcacatgcaaccagcctttctgatatgctagaattagctattctgttaaaagaagtaggactggtggatacggaaagggcgcgtgttcagattgttcccctttttgaaacaattgaagacttggatcattcagaggaaacaatgagaaaatatctttctcttagccttgccaaaaaatggattgactcacgaaataactaccaagaaatcatgcttggctactctgacagtaataaagatggcggttacttgtcatcatgttggaccctctacaaggctcaacaacaattgactgctattggagatgaatttggcgttaaggttaccttcttccatggtcgtggtggtactgtcggtcgtggtggtgggccaacctatgaagccattacatctcaaccgctcaagtctatcaaggatcgtatccgcttgacggagcagggtgaagtaattgggaataaatacggtaacaaagacgccgcttactataaccttgaaatgctagtatcggcagctattaaccgtatgattactcagaagaagagcgataccaataccccaaatcgttatgaagccattatggatcaagtagtggaccgtagttacgacgtctaccgtgatttggtctttggtaatgagcatttctatgattatttcttcgagtcaagtccaatcaaggctatttcaagttttaatattggttctcgtccagccgctcgtaagactattactgaaatcggtggattgcgtgccatcccttgggtattctcatggtcacagagtcgtgttatgttccctggatggtacggggttggttcaagcttcaaggaatttatcaataaaaatccagagaatattgctatcttacgagatatgtaccaaaattggcctttcttccaatcgcttctttcaaatgttgatatggttttgtcaaaatcaaatatgaatattgcttttgaatatgctaaactttgtgaagacgagcaagttaaggccatctatgagactattttaaatgaatggcaagttactaagaacgttatcttggctattgaaggacatgacgaactcttagctgacaatccatatctaaaagctagtctggattaccgtatgccttactttaatattctcaactatattcagttggagttgattaaacgccaacgtcgtggagaattgtccagtgatcaagaacgattgattcatatcaccatcaacggaattgcgacaggattgcgtaattcaggttga

SEQ ID NO: 1090 - DNA, 306 bp, Streptococcus pneumoniae
atgaaaaataaacgtttaattggaattattgctgcattagcagtcttagtagcaggaagcttgatttattcttcaatgaataaatcagaagctcagaataataaggatgagaagaaaataactaagattggtgtgcttcaatttgtgagccatccatcccttgatttgatttataaagggatccaagatggacttgcagaagaaggatataaagatgatcaagttaaaattgattttatgaactcagaaggtgaccaaagtaaggttgcgacaatgagtaaacaattggttgcaaatggggaatga

SEQ ID NO: 1091 - DNA, 630 bp, Streptococcus pneumoniae
atggccgctattacagacccaattggtgctaacttggttaaagatttgaaaaaaccaggtggcaacgttacaggggtatctgaccacaatccagctcaacaacaaattgaactcatcaaggctctgacaccgaatgtgaaaacaatcggagctctttactcaagtagcgaagacaattcaaaaacacaggtcgaagaatttaaggcttatgctgaaaaagcaggtctgacagtggaaacatttgcagttccttcaacaaatgaaattgcctcaactgtcactgttatgactagcaaggtagatgctatttgggttccaattgataacaccattgcatcaggatttccaacggttgtctctagcaatcaaagttctaagaaaccaatttatcccagtgcgacagctatggtagaagtaggtggtttggcatcagttgtaattgaccaacatgaccttggtgtggcaacaggtaaaatgattgtgcaagtcttgaaaggtgcaaaaccagccgataccccagtcaatgtcttttcaactggtaagtcagtcatcaataaaaaaatagcacaagaactaggtattactattcctgagtctgttctcaaagaagcaggacaagtcatcgaataa

SEQ ID NO: 1092 - DNA, 669 bp, Streptococcus pneumoniae
ttggctggaatggcagcaggccttctttatacaaaaggaaagatcccaaccttgctctcagggattttggtgatgacttctcgtcactcaatcatgctcttgattatgggacgtgcaaatttaggcctgcttggaaccaagcaaattcaggatgttttgccttttgattcggatttgaatcaactcttgacaggtctcatctttgtgagcattgttattgctctcatgctctttttcttggacactaaactcggacaagcctatattgctacaggggataatcctgatatggctagaagtttcgggattcatactggacgcatggagctcatgggcttggtcttatcaaatggtgtgattgcccttgcaggtgccctcattgctcagcaagaaggctatgccgatgtgtctcgagggatcggggttatcgttgtgggacttgcaagtttgattattggagaagttattttcaagagtttgagcttggcagagcgtttggttactatcgttgtaggttctatcgcttatcaatttttagtgtgggcagttatcgcacttggctttaatacaagttaccttcgtttatacagtgccttgattttagcagtctgcctcatgattccaacatttaagcaaacaatcttgaaaggagccaagttaagcaaatga

SEQ ID NO: 1093 - DNA, 759 bp, Streptococcus pneumoniae
atgacagcaattgtagaattaaaaaatgcaaccaaaatcgttaaaaatggctttgatgaagaaaagattattttaaatgatgtttccttagaaatttttgaacgggactttatcacgattttgggcggaaatggtgctggaaaatcaaccctctttaacactatagcagggaccttatcactaactagtggaactatccgtattttaggtgaagaactcactaagttttcacccgagaagcgtgccaagtacctgtctcgtgtcttccaagatccaaagatggggacagctccccgtatgacggtcgctgaaaatcttttaatcgccaagtttcgtggtgaaaagcgtggattgttaccacgacgcttgactagctataaggatgaatttcaggcaaccattgaaaaagtaggaaatggtcttgagaaacacttgaatacaccgattgagttcttatcaggtggacaaagacaggctttgagtctcttgatggcaaccttgaagcgacctgaattactcttgttagacgagcatactgctgccctggatccaaagactagtgttgctttgatgggattgacagatgaatttgttaagaaagatcaattgacagcccttatgattacccatcatatggaagatgctctcaaatatggcaatcgcttgattgtcatgaaagaaggacgggttatccaagatttgaaacaagaagaaaaagcaaaaatgaaaatctctgattattatcaactctttgaataa

SEQ ID NO: 1094 - DNA, 192 bp, Streptococcus pneumoniae
gtcaatcccatcaaagcaacactagtctttggatccagggcagcagtatgctcgtctaacaagagtaattcaggtcgcttcaaggttgccatcaagagactcaaagcctgtctttgtccacctgataagaactcaatcggtgtattcaagtgtttctcaagaccatttcctactttttcaatggttgcctga

SEQ ID NO: 1095 - DNA, 1776 bp, Streptococcus pneumoniae
atggaggtattgtgtatggttgacaaacaagtcattgaagaaatcaaaaacaatgccaacattgtggaagtcataggagatgtgatttctttacaaaaggcaggacggaactatctagggctctgtccttttcatggtgaaaaaacaccttctttcaacgttgtagaggacaagcagttttaccactgttttggttgtggtcgctcaggtgatgtctttaaattcatcgaggagtaccaaggggttacctttatggaggctgtccaaatcttaggtcagcgtgtcgggattgaggttgaaaaaccgctttatagtgaacagaagccagcctcgcctcaccaagctctttatgatatgcacgaagatgcggctaaattttaccatgctattctcatgacaacgactatgggcgaagaggccagaaattacctttatcagcggggtttgacagatgaagtgcttaaacatttttggattggtttagcacctccagaacgaaactatctctatcaacgtttgtctgatcagtatcgtgaagaggatttactggattcaggcctgttttatctctcggatgccaatcaatttgtagacacctttcacaatcgcattatgtttcccctgacaaatgaccaaggaaaggtcattgccttctcaggtcgtatctggcaaaaaacggattcacaaacttctaagtataaaaacagccgatcgactgcaatttttaacaaaagttacgaattatatcatatggatagggcaaaaaaatcttctggaaaagctagtgagatttacctgatggaaggattcatggatgttattgcagcctatcgggttggaatcgaaaatgctgtggcgtcgatgggaacggccttgagtcgagagcatgttgagcatctgaaaaggttaaccaagaaattggttcttgtttacgatggagataaggctgggcaagccgcgatattgaaagcattggatgaaattggtgatatgcctgtgcaaatcgtcagcatgcctgataacttggatcctgatgagtatctacaaaaaaatggtccagaagacttggcctatctattaacgaaaactcgtattagtccgattgagttctacattcatcagtacaaacctgaaaacagtgaaaatctgcaggctcagattgagtttattgaaaaaatagctcccttgattgttaaagaaaagtccatcgctgctcaaaacagctatattcatattttagctgacagtctggcgtcctttgattatgcccagattgagcagattgttaatgagagtcgtcaggtgcaaaggcagaatcgcatggaaagaatttccagaccaacgccaatcaccatgcctgtcaccaagcagttatcggctattatgagggcagaagcccatctactctatcggatgatggaatcccctcttgttttgaacgattaccgtttgcgagaagactttgcatttgctacacctgaatttcaggtcttatatgacttgcttggccagtatggaaatcttcctccagaagttttagcagagcagacagaggaagttgaaagagcttggtaccaagttttagctcaggatttgcctgctgagatatcgccgcaggaacttagtgaagtagagatgactcgaaacaaggctctcttgaatcaggacaatatgagaatcaaaaagaaggtgcaggaagctagccatgtaggagatacagatacagccctagaagaattggaacgtttaatttcccaaaagagaagaatggagtaa

SEQ ID NO: 1096 - DNA, 915 bp, Streptococcus pneumoniae
atggcaacaaaacaaaaagaagtaacaacatttgacgtacaggtagcagaatttatccgtaatcataagcaaaaagggacagcaacagatgatgaaatcaatgcaagtttggttattccttttaccttggacgctgatgggattgaagatctcttgcaacggattcaggatgcaggaatttctatcacagataacgaaggaaatccaagtgcgcgtgttcttagcaatgaagaagaaccagaactcagcgatgaggacttgattgggtcaacttctgctaaggtcaatgaccctgtccgtatgtacttgaaagaaataggggtcgttcctctcttgaccaatgaagaggagaaagagttggcactggctgttgaagctggtgatatcgaagccaaacaacgtcttgcggaagccaatcttcgtttggttgtttccattgccaaacgctatgtcggtcgtggtatgcagttccttgacttgattcaagaaggaaatatgggcttgatgaaggcggttgacaagtttgactattctaaagggttcaagttttcaacttatgcaacttggtggattcgtcaggctatcactcgtgctattgcagaccaagctcgtaccatccgtatcccagttcacatggttgaaactatcaataaattggttcgtgaacagcggaatctccttcaagaattggggcaagatccgacaccagaacagattgctgaacgaatggatatgacacctgataaggttcgtgaaatcttgaagattgcccaagaaccagtatctcttgaaactcctatcggtgaagaggacgatagccaccttggagactttatcgaagatgaagtgattgaaaatccagtggatctcatacgactcgtatcgtcttgcgtgagcaattggatgaaatcttag

SEQ ID NO: 1097 - DNA, 198 bp, Streptococcus pneumoniae
atactcttacagaccgtgaaagaaaatgttctgcgtctacgttttggactagatgatggaaaaatgcgcacacttgaagatgtggggaaagtctttaacgtaactcgtgagcgtatccgtcagattgaagcaaaggctttgagaaaactacgccaaccaagtcgcagcaaaccgcttcgtgattttattgaagactaa

SEQ ID NO: 1098 - DNA, 330 bp, Streptococcus pneumoniae
atggcttatacagaagagcaaattgaaaacatcaaaacacggattttaacagccttggaagaagtcatcgaccctgagttgggaatcgatattgtcaatcttggtttgatctatgagattcgttttgacggtgacacagggcaaacagagattgacatgactttgacaactatgggttgtcccttagcagaccttttgacagaccagatttatgatgctatgatagaggttccagaagtaacggatactgaggttaaattagtctggtatccagcatggacagttgaaaaaatgagtcggtatgcccgcattgccataggcattaagtaa

SEQ ID NO: 1099 - DNA, 207 bp, Streptococcus pneumoniae
aatcacgcaacaagaaaggatagactagaggaaaagaggggaaatttcctcgcttttccaacagtctctcacatgcttttatatgtttacttaatgcctatggcaatgcgggcataccgactcattttttcaactgtccatgctggataccagactaatttaacctcagtatccgttacttctggaacctctatcatagcatcataa

SEQ ID NO: 1100 - DNA, 801 bp, Streptococcus pneumoniae
atgttgagttcaagtgagaaagtagcaggacagggagtttcaggtgcttaccgtgaattagttcgtcttcttcaccgtgctgccaaggaccaattgattgttacagaaaatcttccaatcgaggcagatgtgactcactttcatacgattgattttccctattatttatcaaccttccaaaagaaacgctcagggagaaagattggctatgtgcatttcttgccagctacacttgagggaagtttgaaaattccatttttcttaaagggaattgtgaaacgctatgtattttctttttacaaccggatggagcacttggttgtggtcaatcctatgtttattgaggatttggtagcagctggtattccacgtgaaaaagtgacctatattcctaactttgtcaacaaggaaaaatggcatcctctaccacaagaagaggtagttagactgcgcacagatcttggtcttagtgacaatcagtttatcgtagtaggtgctgggcaagttcagaaacgtaaagggattgatgactttatccgtctggctgaggaattgcctcagattacctttatctgggctggtggcttctcttttggtggtatgacagatggttatgaacactataagaaaattatggaaaatccccctaaaaatttgatttttccaggcattgtatcgccagagcggatgcgcgaattgtatgctctagcggatcttttcttgttgcctagctacaatgagctctttcctatgactattttagaagctgcgagttgtgaggctcgctattatgttgcgtga

SEQ ID NO: 1101 - DNA, 198 bp, Streptococcus pneumoniae
ttttgggagggaaattatcgggcgacagcgggtagagaagagatgaaagaggctattttggaatatcaagcaaatcctgctgccttaaaagatctcaaagaaaaggctaagaatatttccagagagtattctgaagagcatctgttacaaatctggttggacttttatgagaaacaagccgctttagggagaaagtaa

SEQ ID NO: 1102 - DNA, 1326 bp, Streptococcus pneumoniae
atgcgaattggtttatttacagatacctattttcctcaggtttctggtgttgcgaccagtattcgaaccttgaaaacagaacttgaaaagcagggacatgctgtttttatctttacgacgacagataaggatgtcaatcgctacgaagattggcaaattatccgcattccaagtgttcctttctttgcttttaaggatcgtcgctttgcctaccgaggttttagcaaggcacttgaaattgctaaacagtatcagctagatattatccatactcagacagaattttctcttggcctgttggggatttggattgcgcgtgaattgaaaattccagtcatccatacctatcacacccagtatgaagactatgtccattatattgctaaggggatgttgatccggccgagtatggtcaagtatctggttagaggtttcctgcatgatgtggatggggttatttgccctagtgagattgtccgtgacttgctatctgattataaggtcaaggttgaaaaacgggtcattcctactgggattgaattagccaagtttgagcgtccggaaatcaagcaggaaaatttgaaagaactgcgtagtaaactagggattcaagatggtgaaaagacgttgcttagtctttcgagaatctcctatgaaaaaaatattcaagcagttttagtagcctttgctgatgttctgaaagaggaagacaaggttaaactggtagtagctggggatggcccttatctgaatgacctcaaagagcaagcccagaacctagagattcaagactcagttatctttacagggatgattgctcctagtgagacggctctttactataaagcggcggatttcttcatttcggcatcgacaagcgaaacgcaaggtttgacctacttggaaagcttagccagtggaacacctgtcattgctcacggaaatccttatttgaacaacctcatcagtgataaaatgtttggaaccttgtactatggagaacatgatttggctggtgctattttggaagccctgattgcaacaccagacatgaacgagcataccttatcagagaaattgtatgagatttcagctgagaactttgggaaacgagtgcatgagttttatctggatgccattatttcaaataacttccagaaagatttggctaaagatgatacggtcagtcagcgtatctttaagacagttttgtatcttccgcaacaggtggttgctgtacccgtaaaaggctctagacgcatgttgaaggcttcaaaaacacagttgatcagtatgagagactattggaaagaccatgaagaatag

SEQ ID NO: 1103 - DNA, 177 bp, Streptococcus pneumoniae
atgagaagcggtcgtgataaaaagattgcgggtgtttgtgctggggtggcccattatctggatatggatccgactatcgttcaagtcatttggggtgttcttacttgctgttacggatctggaattgtagcttacattattttatggattatcgcaccagtagcaactgactattga

SEQ ID NO: 1104 - DNA, 1176 bp, Streptococcus pneumoniae
gtggtcttcgttgtagacgaaggactacgtaccttgatggatttccgctacaatcgccatttcaaggctgattctggtgaaaaagggatgaccaaagggatgcatggtcgtggtgctgaggaccttagagttcgagtaccacaaggtacgactgttcgtgatgcggagactggcaaggttttaacagatttgattaaacatgggcaagaatttatcgttgcccacggtggtcgtggtggacgtggaaatattcgttttgcgacaccaaaaaatcctgcaccggaaatctctgaaaatggagaaccaggtcaggaacgtgagttacaattggaactaaaaatcttggcagatgtcggtttagtaggattcccatctgtagggaagtcaacacttttaagtgttattacctcagctaagcctaaaattggtgcctaccactttaccactattgtaccaaatttaggtatggttcgcacccaatcaggtgaatcctttgcagtagccgacttgccaggtttgattgaaggggctagtcaaggtgttggtttgggaactcagttcctccgtcacatcgagcgtacacgtgttatccttcacatcattgatatgtcagctagcgaaggccgtgatccatatgaggattacctagctatcaataaagagctggagtcttacaatcttcgcctcatggagcgtccacagattattgtagctaataagatggacatgcctgagagtcaggaaaatcttgaagaatttaagaaaaaattggctgaaaattatgatgaatttgaagagttaccagctatcttcccaatttctggattgaccaagcaaggtctggcaacacttttagatgctacagctgaattgttagacaagacaccagaatttttgctctacgacgagtccgatatggaagaagaagcttactatggatttgacgaagaagaaaaagcctttgaaattagtcgtgatgacgatgcgacatgggtactttctggtgaaaaactcatgaaactctttaatatgaccaactttgatcgtgatgaatctgtcatgaaatttgcccgtcagcttcgtggtatgggggttgatgaagcccttcgtgcgcgtggagctaaagatggggatttggtccgcattggtaaatttgagtttgaatttgtagactag

SEQ ID NO: 1105 - DNA, 1260 bp, Streptococcus pneumoniae
atgagaaaaattgttatcaatggtggattaccactgcaaggtgaaattactattagtggtgctaaaaatagtgttgtggccttaattccagctattatattggctgatgatgtggtgactttggattgtgttccagatatttcggatgtagccagtcttgtcgaaatcatggaattgatgggagctactgttaagcgttatgacgatgtcttggagattgatccaagaggtgttcaaaatattccaatgccttatggtaaaattaacagtcttcgtgcatcttactatttttatgggagcctcttaggccgttttggtgaagcgacagttggtctaccgggaggatgtgatcttggtcctcgtccgattgacttacaccttaaggcgtttgaagctatgggtgccactgctagctacgagggagataacatgaagttatctgctaaagatacaggacttcatggtgcaagtatttacatggatacggttagtgtgggagcaacgattaatacgatgattgctgcagttaaagcaaatggtcgtactattattgaaaatgcagcccgtgaacctgagattattgatgtagctactctcttgaataatatgggtgcccatatccgtggggcaggaactaatatcatcattattgatggtgttgaaagattacatgggacacgtcatcaggtgattccagaccgcattgaagctggaacatatatatctttagctgctgcagttggtaaaggaattcgtataaataatgttctttacgaacacctggaagggtttattgctaagttggaagaaatgggagtgagaatgactgtatctgaagacagcatttttgtcgaggaacagtctaatttgaaagcaatcaatattaagacagctccttacccaggctttgcaactgatttgcaacaaccgcttacccctcttttactaagagcgaatggtcgtggtacaattgtcgatacgatttacgaaaaacgtgtaaatcatgtttttgaactagcaaagatggatgcggatatttcgacaacaaatggtcatattttgtacacgggtggacgtgatttacgtggggccagtgttaaagcgactgacttaagagctggggctgcactagtcattgctgggcttatggctgaaggtaaaactgaaattaccaatatcgagtttatcttacgtggttattctgatattatcgaaaaattacgtaatttaggagcggatattagacttgttgaggattaa

SEQ ID NO: 1106 - DNA, 528 bp, Streptococcus pneumoniae
atgttttctttttttgaaacggatcgcttgtatttgcgtcctttcttttttagtgatagtcaggacttccgcgagatagcttcaaatccagaaaatcttcaatttattttcccaacgcaggcaagtctggaagaaagtcaatatgcactggccaattactttatgaagtcccctttgggagtgtgggcaatttgtgaccagaaaaatcaacaaatgattggttctattaaatttgagaagttagatgaaatcaaaaaagaagctgagcttggctattttttgagaaaagatgcttggtcgcaaggatttatgacagaggttgttagaaaaatttgtcagctttcttttgaggaatttggcttaaaacaattatctatcattacccaccttgaaaatgaagctagccaaagagttgctcttaagtctggatttagtttgttccgtcagtttaagggaagtgatcgttacacaagaaaaatgcgggattatcttgaatttcggtatgtaaaaggagagttcaatgagtaa

SEQ ID NO: 1107 - DNA, 1278 bp, Streptococcus pneumoniae
atgagtaagcatcaggaaattctaagctatttggaggaattaccagtaggtaaaagggtcagtgttcgtagcatttcgaatcatctaggagttagtgatggaacagcctatcgggctattaaagaagctgaaaaccgtggaattgtggagacccgtcctagaagtggaacaattcgtgttaaatcccagaaagttgctatagagagattaacgtttgctgaaattgcagaagtgacttcttctgaggttctggctgggcaagaaggtttagagagagaatttagtaagttttcaattggtgccatgactgaacaaaatatcttgtcttaccttcatgatggggggctcttgattgtcggagaccgaacccgtattcagttgctagccttggaaaatgaaaatgcagttctggttacagggggatttcaggttcatgatgatgtgcttaaactggccaatcaaaaagggattcctgttctaagaagtaagcatgatacctttaccgtcgcgaccatgatcaataaagccttgtcaaatgtccaaatcaagactgatattctgacagttgagaaactttatcgccctagtcatgagtatggttttctgagagagacagatacagttaaagattatttggacttggttcgtaagaatcgtagcagccgtttccctgttatcaatcaacatcaggtcgttgttggcgttgtaaccatgagagacgctggtgataaatcaccaagcacgacaattgataaggttatgtctcgtagtctatttttggttggattatcgacaaatattgccaatgtgagtcaacggatgatcgcagaagactttgaaatggtaccagttgttcgaagcaatcaaactttgcttggcgttgtgacgcgacgagatgtcatggagaagatgagccgttcccaagtttcggctctaccaactttttctgagcagattggacaaaagctctcttatcaccatgatgaagtagtcattacagtggaaccctttatgctagaaaaaaatggagttttggctaatggtgtattggcagaaattctgacccacatgacccaagatttagttgttaatagtggtcgcaatctcattatcgagcagatgctgatctactttttgcaggctgttcagatagatgatatattgcgcattcaggcacggattattcatcatacgagacggtcagctataattgattacgatatttatcatggtcaccagattgtttcaaaagcaaatgtgactgttaaaattaattag

SEQ ID NO: 1108 - DNA, 861 bp, Streptococcus pneumoniae
atgataacattaaaatcagctcgtgaaatcgaagctattgacaaagctggtgattttctagcaagtattcatataggcttacgtgatttgattaagccaggcgtagatatgtgggaagttgaagaatatgtccgccgtcgttgtaaagaagaaaatttccttccacttcagattggggttgacggtgccatgatggactatccttatgctacctgttgctctcttaacgatgaagtggctcacgctttccctcgtcattatatcttgaaagatggtgatttgctcaaagttgatatggttttgggaggtcccattgctaaatctgacctaaatgtctcaaaattaaacttcaacaatgttgaacaaatgaaaaaatacactcagagctattctggtggtttagcagactcatgttgggcttatgctgttggtacaccgtccgaagaagtcaaaaacttgatggatgtaaccaaagaagctatgtacaagggtattgagcaagctgttgttggaaatcgtatcggtgatatcggtgcggctattcaagaatacgctgaaagtcgtggttacggtgtagtgcgtgatttggttggtcatggtgttggcccaactatgcacgaagaaccaatggttcctaactatggtattgcaggtcgtggactccgtcttcgtgaaggaatggtcttaaccattgaaccaatgatcaatacaggcgattgggaaattgatacagatatgaaaactggttgggcgcataagaccattgacggtggattgtcatgtcagtatgaacaccaatttgtcattacgaaagatggacctgttatcttgactagccaaggtgaagaaggaacttattaa

SEQ ID NO: 1109 - DNA, 543 bp, Streptococcus pneumoniae
atgcgtttttctgcttttaagattttttccaactctgtttgtaagcgcatcataacaaagggtctaggattcagggctctcctcctatatactattagtaaagtaaaactaagagaggatattttagtgtcgcagtctattgttcctgtagagattccacaatattgtcgttttgattctaaaaagagaaatggaattctgtttaacgttcgtattgccaatcttaaatttaccttttttagattagacttcctgcgaaataaaatatggtatagtagttctatgaatgatgaagcaagtaaacaactaactgatgcacgatttaagcgtcttgttggtgttcagcgcacgacttttgaagagatgttagctgtattaaaaacagcttatcaacttaaacacgcaaaaggtggacgaaaacctaaattaagcctagaagaccttcttatggccactcttcaatatgtgcgagaatatcgaacttatgaagaaattgcggctgtttttggtatccacgaaagcaacttaatccgtcggagctaa

SEQ ID NO: 1110 - DNA, 225 bp, Streptococcus pneumoniae
tgggttgaagtaactcttgttcaaagtggtgttacgatttcaagaactcctctcagctctgaggccacggtaatgattgatgcgacggaagtaaaaatcaatcgccctaaaaaagaattagcgaattattcttgtaaaaaaatgccacgctatgaaggctcaagcgattgtcacaagtcaagggagaattgtttctttggatatcactgtgaactattgtcatga

SEQ ID NO: 1111 - DNA, 390 bp, Streptococcus pneumoniae
atgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaagggctcatgaagatatatcctcaagcacaaactccacgtaaatccagcaaactcaagccgctaacagttgaagataaagcctgtaaccatgcgctatccaaggagagaagcaaggttgagaacatctttgccaaagtaaaaacgtttaaaataatttcaacaacctatcgaaatcatcgtaaacgcttcggattacgaatgaatttgagtgctggtattatcaatcatgaactaggattctag

SEQ ID NO: 1112 - DNA, 2292 bp, Streptococcus pneumoniae
atgaacgcattattaaatggaatgaatgaccgtcaggctgaggcggtgcaaacgacagaaggtcccttgctaatcatggcaggggctggttctggaaagactcgtgttttaacccaccgtatcgcttatttgattgatgaaaagctggtcaatccttggaatatcttggccattacctttaccaacaaggctgcgcgtgagatgaaagagcgtgcttatagcctcaatccagctactcaggactgtctgattgcgaccttccactccatgtgtgtgcgtattttgcgtcgcgatgcggaccatattggctacaatcgtaattttacaattgtggatcctggtgaacagcgaacgctcatgaaacgtattctcaaacagttgaacttggatcctaaaaaatggaatgaacgaactattttggggaccatttccaatgctaagaataatttgattgatgatgttgcttatgctgcccaagctggcgatatgtatacgcaaattgtggtccagtgttatacagcctatcaaaaagaacttcgtcagtctgaatccgttgactttgatgatttgattatgctgaccttgcgtctctttgatcaaaatcctgatgttttgacctactaccagcaaaaattccaatacatccacgttgatgagtaccaagataccaaccacgctcagtaccaattggtcaaactcttggcttcccgttttaaaaatatctgtgtggttggggatgcggaccagtctatctacggttggcgtggtgctgatatgcagaatatcttggactttgaaaaggattaccccaaagccaaggttgtcttgctggaggaaaattaccgctcaaccaaaaccattctccaagcggccaacgaggttattaaaaataataaaaatcgccgtcctaaaaatctctggactcaaaacgctgatggggagcaaatcgtttactatcgtgccgatgatgagctggatgaggctgtatttgtagccagaaccatcgatgaacttagtcgcagtcaaaacttccttcataaggattttgcagttctctatcggactaatgcccagtcccgtacaattgaggaagccctgctcaagtctaacattccttataccatggttggcggaaccaaattctacagccgtaaggaaattcgcgatattattgcttatctcaaccttattgctaatttgagtgacaatattagttttgagcgtattatcaacgagcctaaacgtggaattggtccaggtacagttgagaaaatccgtgattttgcaaatttgcaaaatatgtctatgctggatgcttctgctaatattatgttgtctggtatcaagggtaaggcagcccaatctatctgggattttgccaatatgatgcttgatttgcgggagcagctagaccacttaagcattacagagttggttgagtccgtcctagaaaaaacaggttatgtcgatattcttaacgcccaagcgactctagaaagcaaggcacgggttgaaaatatcgaagagtttctttctgttacgaagaactttgatgacaccacggatgtgacagaagaggaaactggtctggacaaactgagtcgtttcttaaatgacttggctttgattgccgacacagattcaggtagtcaggagacatcagaagtgaccttgatgaccctgcatgctgccaaaggtctcgaatttccagttgtctttttgattgggatggaagaaaatgtctttccacttagtcgtgcgactgaagatccagatgaattagaagaagagcgccgtctagcctatgtaggtatcacgcgtgcagagaaaattctctatctgaccaatgccaactcacgcttgctttttggtcgtaccaattataaccgtccgactcgttttattaacgaaatcagttcagacttgcttgagtatcaaggtctggctcgtcctgcaaatacaagctttaaggcatcatatagcagtggtagtatttcctttggtcaaggtatgagtttggctcaggctcttcaagaccgtaaacgcggtgctgccccaaaatcaatccagtcaagcggtcttccatttggtcaatttacagctggcgcaaaaccagcatctagcgaggcaaattggtccattggtgatattgctctccacaagaaatggggagagggaaccgttctggaagtttcaggtagcggtgctaggcaggaattgaaaatcaatttcccagaagtaggtttgaaaaaacttttagccagtgtggctccaattgagaaaaaaatctaa

SEQ ID NO: 1113 - DNA, 720 bp, Streptococcus pneumoniae
ttttccatccttctcacgaataataaagtgaggaggatttttatgtacagtatttcattccaagaagattcactattaccaagagaaaggctggccaaggaaggagttgaagcgcttagtaaccaagagttgctagctattttactcaggacaggaacacgtcaagttagcgtttttgaaattgcccaaaaagtcttgaacaatctttcaagcctaacggatttgaaaaaaatgaccctgcaggaattgcagagtttgtctggtattgggcgtgttaaggccatagaattacaagctatgattgaactggggcatcgtattcacaaacacgagactcttgaaatggaaagtattctcagcagtcaaaagttggccaagaagatgcagcaggaattaggggataaaaaacaagagcacctggtggcactctatctcaatactcaaaatcaaatcatccatcagcagaccatttttatcggttctgtaactcgtagtatcgctgaaccgcgagagattcttcactatgcaatcaagcatatggcgacttctcttatcttggtccacaatcatccttcaggagcggtagcgcctagccaaaatgatgatcatgtcactaaacttgttaaagaagcctgcgaactgatgggaattgttctcttggaccatttgattgtctctcattctaattactttagttatcgtgaaaagacagatttaatc

SEQ ID NO: 1114 - DNA, 690 bp, Streptococcus pneumoniae
atgaaaaaaccagttattgggattacaggaaacgaaaaaactcatccagatgatgacatcatgatgagctacgcagcaaaaggctttgttgaaggcgttaaagatgctggagggattcccatcatcctaccgattggtgatcaagaaatggcctgccactatatcagtttgattgacaagctcatcttaacaggtgggcaaaatgtcgatccaaaattttatggcgaacccaaaaccattgatagcgatgactatcaccttcaaagagatatcttcgaactggccctcatcaaggaagctattaaacagaaaaagcccattttctctgtctgccgtggtacccaactctttaacgttgccatgggtggaactttgtaccaagatatcgaagaccattggcaggattcttctgttgagtacacaactcaacgcttggtgacagaaccagataccgttctccaagaaatctatggagaaatctctcatatcaactccttccaccaccagagcatcaaggacttagcaccaaatttaaaagttgtggctcatgatcctaaagatggtatcattgaggctgtcatgagtacggatgatgtcgcctttctcggtgtccaatggcatccagaacttctttttgaaaatcgtcccaaagataagaaactctttgactatgtcgttaatgaactttag

SEQ ID NO: 1115 - DNA, 642 bp, Streptococcus pneumoniae
gtgaaagataaacagtttgctattccaaaagctacagcaaaaagactctctctctactatcgaatttttaagagatttcatgcagaaaagattgaacgtgccaactctaagcaaattgcagaggccattgggattgattcagcgaccgtacgtcgtgatttttcctattttggtgaacttggtcgtcgtggttttggctatgatgtcaaaaaactaatgacattttttgccgatttgctcaatgacaactctattaccaatgtcatgctggttggtattggaaatatgggccatgcccttctccactaccgcttccacgaacgtaacaagatgaagattatcatggcctttgacctagacgaccatcctgaagtcggtacccaaactcctgacgggattcccatttacgggatttctcagatcaaggataaaatcaaggatgctgatgtgaagactgctatcctaactgttcccagcgtcaagtcacaagaggttgctaatctcttggttgatgctggtgtgaaaggaattctcagtttttcaccagtccatctgcatttaccaaaagacgtggtcgttcagtatgtcgatttgacaagtgaactccaaaccctcctctacttcatgcgaaaagaggattag

SEQ ID NO: 1116 - DNA, 252 bp, Streptococcus pneumoniae
gtggtatctttacaaaatcggaaagatagagccaaaatgtttgaactgacctataaggactgctatcatgtagagcgtactctcaagtatgaggatcatgaggctctcatgttgactttgtcaggatgtgtaaccttaccagatacactttatgtgacttctctgacttttaggggccaaaaagtttatcagggtctggtcggagacctctaccgttttctatctcatgcagattttttacatcaaaactaa

SEQ ID NO: 1117 - DNA, 348 bp, Streptococcus pneumoniae
atggcatttgaaaaaatcattcagttaaaaaattgtcgttacgattacactcttagcccttctgttaaaaaattcaccctcaaagataacaccttttttgaaactaaggttggtaactatgaactgactcgccttttggaaaaagtgccaaacagcggtgaaggcttccaactcaaaatcatcattaacaaggaacttacaggggctaaaatcaatatcactgacaagtttggccttcgtctagttgatattttcaaatcagaagaccaccatattcatcaggaaaaattctacttcctcatggatagcttggtagaacgtggtatctttacaaaatcggaaagatag

SEQ ID NO: 1118 - DNA, 795 bp, Streptococcus pneumoniae
ttggttcaacactttgggtttgaagcaaccattatccagccagaaaatcaagaaatcacagcccagcaaattcaaaaggctttacgtgacgatacgattttggtttctactatgtttgccaataatgagacaggaaacctacttcccatcgctgaaattggccaaatactcaagcaacaccctgctgcctatcatgttgatgcagttcaggctattggtaaaatcccaattcattcagaagaattgggcattgattttctcactgcttctgcccacaaattccatggtcctaagggaatcggttttctctacgcatctagcatggactttgattcctatctacatggcggagaccaggaacagaaaaaacgtgcaggaactgaaaatctgcctgccatcgtaggcatggttgcagccctaaaagaagacctagaaaaacaagaagaacattttcaacatgtacaaaatctagaaactgcctttctggcagagctggagggcattcagtattacttgaatagaggaaaacatcatctcccttatgttctcaatattggatttcctggtcagaaaaatgacctcttactccttcggctagatttagctggaatttcaatctctactggctcagcctgtactgcaggcgttgtccaatccagccatgttcttgaagccatgtatggcgcaaattcagaacgcttgaaggaatcccttcgcatcagtttgtcgccacaaaataccgttgaagacctacaaaccctcgcaaaaaccttaaaagaaattatcggaggttag

SEQ ID NO: 1119 - DNA, 435 bp, Streptococcus pneumoniae
ctcttgatttgcatgccgttcaggttcaaggtttctttgatattccagtggataatcttttcactgttcccctattcgcaaaacattactgcgataaaggattgcttggttcagatgttgttgtcgttagccctaaaaaattcaggtgtcaaacgtgcgcgtagcctggctgaatatcttgatgctcctatcgccattatcgactaccctcaagacgatgcaactcgtaacgaaggttatattattggtgatgttgaaggtaagacagctatcttgattgatgatattttaaatacaggacgtaccttctctgaagcttctaaaatcgttgaacgtgaaggagctacagaaatttatgctgtttctagccacggtctcttcgtcgagggagctgctgagcttcttgacaatactaatattaaagaaatcttgtga

SEQ ID NO: 1120 - DNA, 549 bp, Streptococcus pneumoniae
atgtcagatagaaaaaacatgaaacttttcgcactcaactctaaccaagagattgcacaaaaaattgcccaagctgttggtgtcccacttggaaaactatcatcacgtcaattttcagacggagaaatccaagtaaatatcgaagaaagtgtccgtggttatgatgtttacatcatccaatcaacaagtttccctgtcaacaaccacctaatggaattgttaatcatggtcgatgcttgtgtgcgtgcaagtgcccacagtatcaacgttgtccttccatattttggctatgcacgtcaagaccgcattgcttgtcctcgtgagccacttacagcaaaactagttgccaatatgctggttaaggctggagttgatcgtatcctgactcttgatttgcatgccgttcaggttcaaggtttctttgatattccagtggataatcttttcactgttcccctattcgcaaaacattactgcgataaaggattgcttggttcagatgttgttgtcgttagccctaaaaaattcaggtgtcaaacgtgcgcgtag

SEQ ID NO: 1121 - DNA, 570 bp, Streptococcus pneumoniae
atgaaacatttagaaattgaattgaaaacactattgaaaaaagatgaatacaatcgtctaaaagaccagttcacaggtgtcactcctgttcttcaaacaaattactacatcgacacgcctgattttgaactgcgagaaaagaaagtcgctatgcgcattcgaacctttgaagactgggctgagttgacactcaaagtcccgcagagtgttggaaacatggaatacaaccaaaaattgcaactaaaagatgctgagaactatctgagtaaggaagaacttcctcaagggctagtactggatgaattggcgaaacatggtatccaaagtaagaactggcaggttcttggttgtctaacaacgcttcgctatgaaatgaaaacagctattggtctcatggcactggatcagagccgatactttgatatgacagattacgaattggagcttgaagtggaaaatcatgagcaaggcaaacaggatttccgacaatttttagagaaaaatcagatttcctaccaaaaagctccttcaaaattggttcgatttgtcaaaagtatgaaaaatagctga

SEQ ID NO: 1122 - DNA, 504 bp, Streptococcus pneumoniae
atgaccttagaatgggaagaatttctagatccttacattcaagctgttggtgagttaaagattaaacttcgtggtattcgtaagcaatatcgtaagcaaaataagcattctccaattgagtttgtgaccggtcgagtcaagccaattgagagcatcaaagaaaaaatggctcgtcgtggcattacttatgcgaccttggaacacgatttgcaggatattgctggcttacgtgtgatggttcagtttgtagatgacgtcaaggaagtagtggatattttgcacaagcgtcaggatatgcgaatcatacaggagcgagattacattactcatagaaaagcatcaggctatcgttcctatcatgtggtagtagaatatacggttgataccatcaatggagctaagactattttggcagaaattcaaattcgtactttggccatgaatttctgggcaacgatagaacattctctcaactacaagtaccaaggggatttcccagtatga

SEQ ID NO: 1123 - DNA, 213 bp, Streptococcus pneumoniae
aacattctctcaactacaagtaccaaggggatttcccagtatgagattaagaagcgactggaaattacagctagaatcgcccatcagttggatgaagaaatgggtgaaattcgtgatgatatccaagaggcccaggcactttttgatcctttgagtagaaaattaaatgacggtgtagggagcagtcacggtacagatgaagaatacaggtaa

SEQ ID NO: 1124 - DNA, 789 bp, Streptococcus pneumoniae
ccaactagaaacaccgcgagaggtcaaagggtcttgtatgaattgcgagatcgtttgaagagaaatcagtttatactcaatgataccaatccggatattgtcatttccattggcggggatggtatgctcttgtcggcctttcataagtacgaaaatcagcttgacaaggtccgctttatcggtcttcatactggacatttgggcttctatacagattatcgtgattttgagttggacaagctagtgactaatttgcagctagatactggggcaagggtttcttaccctgttctgaatgtgaaggtctttcttgaaaatggtgaagttaagattttcagagcactcaacgaagccagcatccgcaggtctgatcgaaccatggtggcagatattgtaataaatggtgttccctttgaacgttttcgtggagacgggctaacagtttcgacaccgactggtagtactgcctataacaagtctcttggcggtgctgttttacaccctaccattgaagctttgcaattaacggaaattgccagccttaataatcgtgtctatcgaacactgggctcttccattattgtgcctaagaaggataagattgaacttattccaacaagaaacgattatcatactatttcggttgacaatagcgtttattctttccgtaatattgagcgtattgagtatcaaatcgaccatcataagattcactttgtcgcgactcctagccataccagtttctggaaccgtgttaaggatgcctttatcggtgaggtggatgaatga

SEQ ID NO: 1125 - DNA, 897 bp, Streptococcus pneumoniae
atgaggtttgaatttatcgcagatgaacatgtcaaggttaagaccttcttaaaaaagcacgaggtttctaagggattgctggccaagattaagtttcgaggtggagctattctggtcaataatcaaccgcaaaatgcaacgtatctattggacgttggagactacgttaccattgacattcccgctgagaaaggctttgaaaccttggaggctattgagcttccattagatattctctatgaggatgaccactttctagtcttgaataaaccctatggagtggcttctattcctagtgtcaatcactctaataccattgccaattttatcaagggttactatgtcaagcaaaattatgaaaatcagcaggttcacattgttaccagactagatagggacacttctggcttgatgctctttgccaagcacggttatgcccatgcacgattagacaagcagttgcagaagaaatctatcgagaaacgctactttgctttggttaagggagatggacatttggagccagaaggggaaattattgctccgattgcgcgtgatgaagattccattattaccagacgagtggctaaaggcggaaagtatgcccatacttcatacaagattgtagcttcttatggaaatattcacttggtctatattcacctgcacactggtcgaacccatcaaatccgagtccatttttctcatatcggttttcctttgctgggagatgatttgtatggtggtagtctggaagatggtattcaacgtcaggctctgcattgccattacctatccttttatcatccatttttagagcaagacttgcagttagaaagtcccttgccggatgatttcagtaaccttattacccagttatcaactaatactctataa

SEQ ID NO: 1126 - DNA, 975 bp, Streptococcus pneumoniae
atggaagtttttgaaagtctcaaagccaaccttgttggtaaaaatgctcgtatcgttctccctgaaggggaagagcctcgtattcttcaagcaacaaaacgcttagtaaaagaaacagaagtgattcctgttttgcttggaaatcctgaaaaaattaaaatttatcttgaaattgaaggaatcatggatggttatgaggtcatcgaccctcaacattatcctcaatttgaagaaatggtttctgccttggtggagcgtcgcaagggcaaaatgactgaagaagatgtacgcaaggttttggttgaagatgtcaactactttggtgtgatgttggtttacttgggcttggttgatggaatggtgtcaggagcgattcactcaacagcttcaacagttcgcccagctctacaaatcatcaaaactcgtccaaatgtaactcgtacttcaggagccttcctcatggttcgtggtacggaacgttacctatttggagactgtgccattaatatcaatccagatgcggaagccttggctgaaattgccatcaactcagcaatcacagctaagatgtttggcatcgaacctaaaattgccatgttgagctattctactaaaggttcagggtttggtgaaagcgttgataaggtcgttgaagcaactaaaattgctcacgacttgcgtcctgaccttgaaatcgatggtgagttgcaatttgatgcggcctttgttcccgaaactgcagctctgaaagctccgggaagtacagtagctggtcaagcaaatgtcttcatcttcccaggtatcgaggcaggaaatatcggttacaagatggctgaacgcatgggtggctttgcggctgtaggacctgttttgcaaggtttaaacaagccagttaatgatctttctcgtggatgtaatgcagatgatgtttacaagttgaccctcatcacagcagctcaagcagttcatcaatag

SEQ ID NO: 1127 - DNA, 237 bp, Streptococcus pneumoniae
aaacttcaaaaaacggatttttatcgctctgaacatcaaaaaagaaaggacgaaatttgtcctttctcaagcttagctgacttcaacccactacagttgacaaagagccaaaaaattctcttttcatactcatttaaaatcaaaaagggaatttatcgttttacggacatgtatattacagatttctataggtcgtgtatagacaggatatcatcgcttggaagttttcctttttga

SEQ ID NO: 1128 - DNA, 597 bp, Streptococcus pneumoniae
gctcaggctgaaacagtctcccagactgtttcactcccgaatgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagccgtaaactgagtgataaacgtttttatcgccctacttttcgtatgcatttaaccaataaagagattttaaacaagcttttgagctattcagaagacttgaaacaccactatcagctctataataaggaaccagagaaatttttcggacttattgaggacaatcttaagcaggttcatcctatttttcagactgtctttaaaacctttctaaaggacaaagagaaaatcgtcaacgcccttcaactaccctattcaaacgccaaattggaagcgaccaataatctcatcaaacttatcaaacgcaatgcctttggttttcgaaactttgaaaacttcaaaaaacggatttttatcgctctgaacatcaaaaaagaaaggacgaaatttgtcctttctcaagcttag

SEQ ID NO: 1129 - DNA, 327 bp, Streptococcus pneumoniae
aacagtccgggtagtgactgtttcaatcgggagatggagatgagctttattgcgcaagattttgacaagctcaatatcatcactgttcttgagggaagaacacaagctatcattcgaaatcactttcttcgctacgatagagccgtccgatgtcgcgtcaaaatcattactatggatatgtttagcccttactatggcttggctaaacagcttcgctttcaaatttctaggctcaggctgaaacagtctcccagactgtttcactcccgaatgctaaaatcgttcttgatcgctttcacattgtacaacatcttagccgtgctatga

SEQ ID NO: 1130 - DNA, 519 bp, Streptococcus pneumoniae
atggaacaattacattttatcacaaaattactagacattaaagaccctaatatccagattttagacatcatcaataaggatacacacaaggaaatcatcgccaaactggactacgacgccccatcttgccctgagtgcggaaatcaattgaagaaatatgactttcaaaaaccttctaaaattccttatcttgaaacgactggtatgcctactagaattctccttagaaagcgtcgattcaagtgctatcactgttcaaaaatgatggtcgctgaaacttctatcgtcaagaaaaatcaccaaatccctcgtatcatcaaccaaaagattgctcaaaagttaattgaaaagatttctatgactgatattgcccatcagcttttcatctcaacttcaactgttattcgtaagctcaatgattttcactttaaacatgatttttcttgtcttcctgagattatgtcttgggacgttgaaacagtccgggtagtgactgtttcaatcgggagatggagatga

SEQ ID NO: 1131 - DNA, 324 bp, Streptococcus pneumoniae
gatgaaaggaactttagaaatcttatgatgaacatgcaaaacatgatgcgtcaagcacaaaaacttcaaaaacaaatggaacaaagccaagctgaacttgctgctatgcaatttgttggcaaatctgctcaagatcttgtccaagcgaccttaactggcgataagaaagttgtcagcattgatttcaatccagctgtcgttgacccagaggaccttgagactctttctgatatgaccgttcaagccatcaactctgctcttgaacaaatcgatgaaactaccaagaaaaaactgggtgctttcgctgggaaattacctttctaa

SEQ ID NO: 1132 - DNA, 693 bp, Streptococcus pneumoniae
atgaggttattacctataagaaaaatatcacgtcagtctaaaaggttagcactttttttgacgttttgtgctggatatgtggatgcttacacttttattgttcgcgggaatacccttgtagctggacaaactggaaatgttgtctttctttcagtagaattaattaaaaataatgtttcggatgttagggacaaggttctcaccttgctagcgtttatgatgggagtctttttattaacgatttataaggaaaaattgagaattgtgaaaaaacctattctgtccttgattcccttggcaatcttatcaatcattattgcttttgtgccgcaaactgtggataatatctatctagtgccgcccttggccttctgtatgggactggtgacaactgcttttggagaagtgtcgggtattgcctataataacgcttttatgacagggaatatcaaacggaccatgctggcttttggagattatttccgaaccaagcacactccttttttgcgtgaaggattcatatttgttagcctgcttagtagttttgtccttggcgttgtcttttcagcctatttgacgattttctatcatgaaaagaccattcttggtgttcctattatgatgagcgttttttacctcagcatgctttttgcctcttggcagaaaaaagtaaaagaaaaagcttcattttag

SEQ ID NO: 1133 - DNA, 315 bp, Streptococcus pneumoniae
atgagcacatacgcaattatcaaaactggcggaaaacaagttaaagttgaagttggtcaagcagtttacgttgaaaaattgaacgttgaagctggtcaagaagttacttttaacgaagttgttcttgttggtggtgaaaacactgttgtcggaactccacttgttgctggagctactgtagttggaactgttgaaaaacaaggaaaacaaaagaaagtggttacttacaagtacaaacctaaaaaaggtagccaccgtaaacaaggtcaccgtcaaccatatacaaaagttgtcatcaacgcaatcaacgcttaa

SEQ ID NO: 1134 - DNA, 441 bp, Streptococcus pneumoniae
gtgtccagtaatttccgcactcctcagctcgccatcttcggctctctcaaagactgcctgtatcatgtgttctccttaaaattaagcgttgattgcgttgatgacaacttttgtatatggttgacggtgaccttgtttacggtggctaccttttttaggtttgtacttgtaagtaaccactttcttttgttttccttgtttttcaacagttccaactacagtagctccagcaacaagtggagttccgacaacagtgttttcaccaccaacaagaacaacttcgttaaaagtaacttcttgaccagcttcaacgttcaatttttcaacgtaaactgcttgaccaacttcaactttaacttgttttccgccagttttgataattgcgtatgtgctcattatgcacctcctatgatttttatgggtttccccgattttttgtga

SEQ ID NO: 1135 - DNA, 345 bp, Streptococcus pneumoniae
atgatacaggcagtctttgagagagccgaagatggcgagctgaggagtgcggaaattactggacacgccgagagtggcgaatacggcttagatgtcgtgtgtgcatcggtttctacgcttgccattaactttatcaattctattgagaaatttgcaggctatgaaccaatcctagaattaaacgaagatgaaggtggctatctgatggttgaaataccaaaagatcttccttcacaccagagagaaatgacccagttattctttgaatcatttttcttaggtatggcaaacttatcggagaactcttctgagttcgtccaaaccagagttatcacagaaaactaa

SEQ ID NO: 1136 - DNA, 294 bp, Streptococcus pneumoniae
atgttaaaaatgactcttaacaacttgcaacttttcgcccacaaaaaaggtggaggttctacatcaaacggacgtgattcacaagcaaaacgtcttggagctaaagcagctgacggacaaactgtaacaggtggatcaatcctttaccgtcaacgtggtacacacatctatccaggtgtaaacgttggtcgtggtggagacgatactttgttcgctaaagttgaaggcgtagtacgctttgaacgtaaaggacgcgataaaaaacaagtttctgtatacccaatcgcaaaataa

SEQ ID NO: 1137 - DNA, 165 bp, Streptococcus pneumoniae
ttgatacccatactttttaatatgtatagtggattgatactcttcgaaaatcaaattcaaaccacgtcaatttcaccttgccgtactcaagtacagcctgcggctaacttcctagtttgcactttaattttcattgagtatgaatctggaatagaacactgttaa

SEQ ID NO: 1138 - DNA, 918 bp, Streptococcus pneumoniae
atgattattactattcctataaaaaaccaaaaagatattggcacaccatctgattcagtcgttgttctcggctattttgatggcatacataaggggcatcaagaattatttcgtgttgccaacaaggctgcgagaaaggatttattacctatcgtcgttatgacctttaatgaatctccaaagatcgctttagagccttatcatccagatttgtttttgcatattttgaaccctgctgaacgtgaaagaaaattaaagcgcgaaggtgtagaagaattatatctccttgattttagtagtcaattcgctagtctcactgcacaagaattctttgcaacttatatcaaggctatgaatgccaaaattattgttgcaggttttgattatacatttggttctgacaaaaaaacagcagaagatttaaaggattactttgatggagaagttatcattgttccacctgtagaagatgagaaaggaaagattagttcaactcgtatccgtcaagctattttagatggaaatgtgaaagaagcaggaaaacttttgggggcaccgcttccatcaagaggtatggtggttcatggtaatgctcgtggtcgtacaattggttatccgacagcgaatttagtgcttttagaccgtacttatatgccagcagatggcgtttatgtcgttgatgttgagattcaaagacagaagtatcgtgctatggctagtgtcgggaaaaatgtgacctttgatggagaagaagcacgttttgaagtcaatatttttgattttaatcaagatatttatggggaaaccgtcatggtttattggcttgatcgcattcgtgatatgaccaaatttgactcagttgaccaattagtggatcagttaaaggctgatgaagaagtaactcggaattggtcttaa

SEQ ID NO: 1139 - DNA, 849 bp, Streptococcus pneumoniae
atgattaaaaaaatttaccccatttttaccattttactaggtgctgctatttatgcttttggactgacttattttgtagttccccatcatctctttgaaggaggggcgacaggtattaccctcatcacattttatctttttaaaatccctgtttccctcatgaacctgctgattaatattccccttttcatcctagcttggaagatctttggagccaaatccctctattctagtttactaggaaccttagctttgtccggctggttagctttttttgagcatattccccttcatattgatcttcaaggtgatttactaatcacagcccttatagcgggaatcctattgggaattggccttggaattatttttaatgctggaggtacaactggcggaactgatattctagctcgtattctcaacaaatacactcatatatccataggaaaactgctctttatcttagatttttgtattctcatgttgattctcctaatcttcaaggatttgagattggtttcctacacgcttttgtttgattttattgtttctcgtgttattgatttgattggtgaaggaggatatgccggcaaaggctttatgattatcacaaaacgtcctgaccaacttgctaaggcgattaatgatgacctcggaagaggtgttacttttatttctggtcaaggctactatagtaaagaaaatttgaaaatcatctactgtattgtcggaagaaatgaaattgtgaaaacgaaggaaatgattcatcgaatcgatcctcaagcctttataactattacagaagcccatgaaatcctaggagaaggcttcacctttgaaaaagaataa

SEQ ID NO: 1140 - DNA, 840 bp, Streptococcus pneumoniae
atgacaaaaattaagattgtaaccgattcatctgttactattgaacctgaactagtaaagcaattagatattacaattgttccattatctgtaatgattgataatgttgtttattctgatgcggatttgaaagaagaaggtaaatttcttcagttgatgcaagaaagtaagaatcttccgaaaacaagtcagccacctgtaggtgtctttgctgagatttttgaagacctatgcaaagatggtggccagattcttgctattcatatgtcccatgctctttcgggtacggtagaagcagcacgccaaggtgctagcctatctactgcagatgtgactgttgttgatagttccttcactgaccaagccctgaaattccaagttgttgaggctgcgaagttagctcaagaaggtaaagatatggaggcaattttatctcatgtagaagaggttaaaaaccatacagagctttatattggtgtttcaactttggaaaatcttgtcaaaggtggacgaattagccgtgtaactggcttgttgagctctcttctcaatatccgtgttgtcatgcaaatgaaagaccatgaattgcagccaatggttaaaggtcgtggaactaaaacatttaaaaaatggttagatgagttgataacatcgctttctgaacgtgctgtagcagagattggaatttcatattctggtagtgatgattgggcaaaagagatgaaagaaagcttacaagcttatgttgaaaagccaatttctgttttggaaacgggttccattattcaaactcacacgggtgagaacgcttgggctattttgatacgttaccactcctaa

SEQ ID NO: 1141 - DNA, 276 bp, Streptococcus pneumoniae
atggcaaacaaacaagatttgatcgctaaagtagcagaagctacagaattaactaagaaagactcagcagcagcagttgaagctgtatttgcagcagtagctgactatcttgcagctggtgaaaaagttcagttgatcggttttggtaactttgaagttcgtgagcgcgcagaacgtaaaggtcgcaacccacaaactggtaaagaaatgacaattgcagcttctaaagtaccagcattcaaagctggtaaagctcttaaagacgctgttaaataa

SEQ ID NO: 1142 - DNA, 1902 bp, Streptococcus pneumoniae
atgattattttacaagctaataaaattgaacgttcttttgcaggagaggttcttttcgataatatcaacctgcaggttgatgaacgagatcggattgcccttgttgggaaaaatggtgcaggtaagtctactcttttgaagattttagttggagaagaggagccaactagtggagaaatcaataagaaaaaagatatttctctgtcttacctagctcaagatagccgttttgagtctgaaaataccatctatgatgagatgcttcatgtctttgatgacttacgtcggacagataaacaactgcgtcagatggagctggagatgggtgaaaagtctggtgaggatttggataaactgatgtcagattatgaccgcttatctgaaaattttcgccaagcaggtggctttacctatgaagctgatattcgagcgattttgaatggattcaagtttgacgagtctatgtggcagatgaaaattgctgagctttctggtggtcaaaatactcgtttggctctagctaaaatgctccttgaaaagcccaatctcttggtcttggacgagccaactaaccacttggatattgaaaccatctcctggctagagaattacttggtaaactatagcggtgccctcattatcgtcagccacgaccgttatttcttggacaaggttgcgacaattacgctagatttgaccaagcattccttggatcgctatgtggggaattactctcgttttgttgagttgaaggagcaaaagctagctactgaggcaaaaaactatgaaaagcaacagaaggaaatcgctgctctggaagactttgtcaatcgcaatctagttcgtgcttcaacgactaaacgtgctcaatctcgccgtaaacaactagaaaaaatggagcgtttggacaagcctgaagctggcaagaaagcagccaacatgaccttccagtctgaaaaaacgtcgggcaatgttgttttgactgttgaaaatgcagctgttggctatgacggggaagtcttgtcacaacctatcaacctagatcttcgtaagatgaatgctgtcgctatcgttggtccaaatggtatcggcaagtcaacctttatcaagtctattgtggaccagattccttttatcaagggagaaaagcgctttggcgctaatgttgaggttggttactatgaccaaacccaaagcaagctgacaccaagtaatacggtgctggatgaactctggaatgatttcaaactgacaccagaagttgaaatccgcaaccgtcttggagccttccttttctcaggagatgatgttaaaaaatcagtcggcatgctatctggtggcgaaaaagctcgtttgcttttagctaaattgtctatggaaaacaataactttttgattctggatgagccgaccaaccacttggatattgatagtaaggaagtgctagaaaatgccttgattgactttgatggtaccttgctttttgtcagtcatgatcgttactttatcaatcgtgtggcaactcatgttttggaattgtctgagaatggttcaactctctaccttggagattacgactactatgttgagaagaaagcaacagcagaaatgagtcagactgaggaagcttcaactagcaatcaagcaaaggaagcaagtccagtcaatgactatcaggcccagaaagaaagtcaaaaagaagttcgcaaactcatgcgacaaatcgaaagtctagaagctgaaattgaagagctagaaagtcaaagccaagccatttctgaacaaatgttggaaacaaacgatgccgacaaactcatggaattacaggctgagctggacaaaatcagccatcgtcaggaagaagctatgcttgagtgggaagaattatcagatcaggtgtaa

SEQ ID NO: 1143 - DNA, 894 bp, Streptococcus pneumoniae
gtgggaagaattatcagatcaggtgtaaagatggaacatcttggaaaagtatttcgtgaatttcgaacaagtggaaattattctttaaaggaagcagcaggcgaatcctgctctacctctcagttatctcgctttgagcttggggagtctgacctggcagtctcccgtttctttgagattttggataacattcatgtaacaatcgaaaatttcatggataaggcaaggaattttcataatcatgaacatgtgtctatgatggcacagattatcccactttactattcaaacgatattgcaggttttcaaaagcttcaaagagaacaacttgaaaagtctaagagttcgacgactcccctttattttgagctgaactggattttgctacaaggtctgatttgtcaaagagatgcgagttatgatatgaagcaggatgatttggataaggtagcagattatctcttcaaaacagaagaatggaccatgtatgagttgattcttttcggtaacctctatagtttctacgatgtagactatgtcactcggattggtagagaagttatggagagggaggaattttaccaagagattagtcgccataagagattagttttgattttggccctcaattgttaccagcattgtttagagcattcttctttttataatgccaactattttgaggcttatacagagaagattattgacaaaggtattaagctttatgagcgtaatgttttccattatttaaaaggttttgccttatatcaaaaaggacagtgtaaagaaggctgtaagcagatgcaagaggccatacatatttttgatgtgttaggtcttccagagcaagtagcctattatcaggaacactacgaaaaatttgtcaaaagttaa

SEQ ID NO: 1144 - DNA, 1179 bp, Streptococcus pneumoniae
atgaatcgctatgcagtgcagttgattagccgtggggctatcaataaaatgggaaatatgctctatgattatggaaatagtgtctggttggcttctatggggactataggacagacagttttaggaatgtatcagatttctgagctcgtcacatctattctcgtcaatccctttggcggagttatttcagaccgtttttctcgtcgtaagattttaatgacggcagatcttgtttgtgggattctttgtctggctatttctttcataaggaatgatagctggatgattggcgctttgattgttgctaacattgtgcaggctattgcttttgccttttctcgcacagccaataaagctatcataactgaagtggtggagaaagatgagattgtgatctataattctcgcctagagctggttttgcaggttgtaggtgttagctctcctgttctttccttccttgttttacagtttgcaagtctccatatgacgctactgctagactcgctgacttttttcattgcttttgttctagtggctttccttccaaaagaggaagcagaagttcaagagaaaaaggcttttactgggagagatatttttgtagatatcaaggatgggttacactatatctggcatcagcaagaaattttcttccttttgctggtagcttccagcgttaatttcttttttgcagcttttgaatttctacttcccttttcgaatcagctttacgggtcagaaggagcctatgcaagtattttaactatgggggctattggttccatcattggggctcttctagctagtaaaattaaagctaatatttataatcttttgattttactggctttgacaggtgtcggagtttttatgatgggattaccacttccaacttttctttccttttctggaaatttagtttgtgaattgtttatgacgatttttaatattcacttttttactcaagtacaaaccaaggttgagagcgaatttcttggaagagtactgagtacaatttttaccttagctattctatttatgcctattgcaaaaggatttatgacagtcttgccaagtgtacatctctcttctttcctgataattggaagtggtgttatcatcttgtcttgtatatcgtttatttatgttcgaactcattttgaaaaattgatataa

SEQ ID NO: 1145 - DNA, 1968 bp, Streptococcus pneumoniae
aatggtcttatgaataaaagaatgaatgagttagtcgctttgctcaatcgctatgcgactgagtactataccagcgataatccctcggtttcagacagtgagtatgaccgcctttaccgtgagttggtcgagttagaaactgcttatccagagcaagtgctagcagacagtccgactcatcgtgttggtggcaaggttttagatggttttgaaaaatacagtcatcagtatcctctttatagtttgcaggatgctttttcacgtgaggagctagatgcttttgatgcgcgtgttcgtaaggaagtggctcatccgacctatatttgtgagctgaaaatcgatggcttatctatctcgctgacttatgaaaaggggattttggttgctggggtaacacgtggagatggttcaattggtgaaaatatcacagaaaacctcaagcgtgttaaggacatccctttgactttgccagaagaactagatatcacagttcgtggggaatgttacatgccacgcgcttcctttgaccaagttaaccaagtgcgccaagaaaatggagagcctgaatttgctaatcctcgtaatgcggcagcaggaactctgcgtcagttggatacagcagtagttgccaagcgtaatcttgcaacgtttctctatcaagaagccagcccttcaactcgtgatagccaagaaaagggtttgaagtacctagaacaactaggttttgtggtcaatcctaagcgaatcttggctgaaaacatagatgaaatctggaattttatccaagaagtaggacaggaacgggaaaatctgccttacgatattgatggagtggtaatcaaggtcaacgacctagcaagtcaagaagaacttggttttacagttaaggctccaaagtgggcagtagcctacaagttccctgccgaagaaaaagaagctcaactcttatcagttgactggacagttggccgtaccggtgttgtaactccaactgctaatctaacaccagtacaacttgccggtacgactgttagccgtgcgaccctgcacaatgtagattatattgctgaaaaagatatccgaaaagacgatacggtcattgtatataaggctggtgacatcatccctgccgttttacgtgtggtagagtccaaacgggtttctgaagaaaaactagatatccctacaaactgtccaagttgtaactctgacttgttgcactttgaagatgaagtggccctacgttgtatcaatccgcgttgccctgctcaaatcatggaaggcttgattcactttgcttctcgtgatgctatgaatattacaggccttggtccatctattgttgagaagctttttgctgctaatttagtcaaggatgtggcggatatttatcgtttgcaagaagaggatttcctccttttagagggggttaaggaaaagtccgctgctaaactgtatcaggctatccaagcatcaaaggaaaattctgccgagaagctcttatttggtttgggaattcgtcatgtcggaagcaaggctagtcagcttttacttcaatatttccattcaattgaaaatctgtatcaggcagattcagaggaagtggctagtattgaaagtctaggtggcgtgattgccaaaagtcttcagacttattttgcgacagaaggctctgaaattctgctcagagaattgaaagaaactggggtcaatctggactataaaggacagacggtagtagcggatgcggccttgtcaggtttgaccgtggtattgacaggaaaattggaacgactcaagcgctcagaagctaaaagtaaactcgaaagtctgggtgccaaagtgacaggtagtgtttctaaaaagaccgacctcgtcgtggtaggtgcagacgctggaagtaaactgcaaaaagcacaagaacttggtatccaggtcagagatgaggcatggctagaaagtttgtaa

SEQ ID NO: 1146 - DNA, 2280 bp, Streptococcus pneumoniae
atgtataactaccctatgcgcattcattaccatcgtaagaatggagaatatgacacttgctcctttgtaaaaagtcaggatcaacgaattgatttgctaacctacaaagaagattattttggagctttatttagctttgaacacccaagttcacatgttatagaaagcttgaattttgtggttcatacaggtcaaactagtaaagaatattctatccgttttaatcactatcccctattaacagaggtctggattttggaaggcgatgataggatttattactctgaaaatcctgctattgccagtcctttctataaaaatcaaaatccttttgcctttgataaggccattaacagtgctagttttgatcatcattggggttaccaaggagaattgggttgccgtgtagaggacaatcaggctcatttttccctctggtcacctacagcgacaaaagtgcaagttgtcgtttatgaatcagctgctaatgatgcacccgtttggaagacttttgagatgaaaagaggcaatagctactcttataatcataaggacaatacaatcggtgtctggagtttggatgttgaagaagatttggtaggtaagacttatcagtatcaagtccaattccctcatcaccaaacactgacacgtgatccttatacaatcgcgaccagccctgatggcaaacgttcagctattctgagccatgtagaaaagcaagttgaaaacttcgaggttaagcacggttcggaggctacttggcgcttggaaaatccatgtaaggcagttatctgtgaaatgcacattcgtgatttgactaaatcacctacatcgggtgtagatgaacatcttcgaggaactttcttgggtgctgctcaggctggaacagttaaccaatacggccagtcaactgcttttgattacatcaagaagctgggctacaattatgttcaattgcaaccaattgcagaccgtcataaagaatacgatgaggatggaaatgtaacctacaactggggttatgatccacaaaactataacgcgccagaaactagtttttcaactaatccagatgatccagctcaggtcattcgtgatttgaaggtgatggttcaagcttatcacgatgcgggtattggagtcattatggatgtagtctataaccataccttctcagttgttgatgcaccattccaaacaacagtccctgattactattatcgtatgaatccagatggtaccttccagaatggaacgggtgttggaaatgaaacagccagtgaacacgaaatgtttcgcaagtatatgattgattctcttctatactgggtgcaggaatataatattgacggcttccgttttgacttgatggggattcatgatgtcaagaccatgcagatgattcgtcaaagcttggatgaaatcgactccaacattatcctctatggagaaggatgggatatgggaacaggtcttgccccttatgataaggccaagaaggacaatgcctaccagatgccaaatattggtttctttaatgacaatcagcgcgatgctgtcaaagggggagaagtttatggtgctatcaagtcaggttttgtcagtggtgctgcgacagagccaattctagctaaagcaatcctaggaagtcgtgaattaggaagctatacacatccaaatcaggtgcttaactatgtagaagcccatgacaattacaatcttcacgatttattggcaacccttcatccagaccaaagttcagagcaaatcatgcgcaaggtcgaaactgccacagccatgaatctgctcatgcaggggatggcctttatggaaatcggtcaagaatttggtcgtaccaaactggttgcgactggtgaaaatggtgagttgacccatgatgatagagagcgtgcgatgaatagctataatgctcctgacagtgtgaaccaagtgaactggaacttgattaatgagcgtcaagacagtattgagtttatccgtcaagtcatccgattgaagacaaaaactggtgccttttcttactctagctatgatgaaatttaccatcatgtctttgtgcattctgcgattgaacatagcggctgccttatctatgaagttcacggcaaagaacacctcttggtagttgtgaatgctaaatcagaaccctatcaatttgaaaatgcaggaaatttagctatgttggtaaccaacagtcgctcaaaagaagataatgttttaaatgatattagtctagctgtcttgagtgttttataa

SEQ ID NO: 1147 - DNA, 1425 bp, Streptococcus pneumoniae
ttgacaagatatcagaatttagtaaatggaaaatggaaatcatccgaacaagaaattacgatttattcaccaatcaatcaagaagaattgggtacagttccagccatgactcagactgaagctgatgaggctatgcaagctgcgcgtgcagccctgccagcatggcgagctttatcagcaattgaacgtgcggcttatttgcataaaacagcagctattttagaacgcgataaggaaaaaattggtactatccttgccaaagaagtagcaaaagggattaaagcagcaattggagaagtagtgcgtacagcagacttgattcgttatgctgctgaggaaggtctccgtatcactggacaagcaatggaaggtggtggttttgaggcagcaagtaaaaacaaactggctgttgtccgtcgtgaaccagttggtatcgtgctagcgattgctccttttaattatccagttaatttatctgcttctaaaattgcacctgccttgattgcagggaatgttgtcatgtttaagccaccaacacaaggttccatttctggactcttgttggctaaagcatttgaagaagcagggattccggcaggtgttttcaacaccattacaggtcgtggttcagaaattggggattatatcattgagcacaaagaagtcaacttcatcaactttacaggttcaactcctattggagaacgtattggtcgtttagctggtatgcgtcctatcatgttggaacttggtgggaaagatgcagctcttgtactagaagatgcagatttggaacatgctgccaagcaaattgttgcgggagcctttagctactcaggacaacgttgcacggccattaaacgtgtcattgttctcgaaagtgtagcagataaattagctactttgcttcaggaagaagtttctaaattaacagttggtgatccatttgacaatgctgatattacacctgttattgacaatgcttcagccgacttcatttggggcttgattgaggatgcacaagaaaaagaggctcaggctcttacaccaatcaaacgtgagggcaatctcctctggccagtgctttttgaccaagttacaaaagatatgaaagtggcatgggaagagccatttggtcctgttttaccaatcattcgtgtggctagtgtagaggaagctattgcctttgccaacgaatctgaattcggccttcaatcatcagtctttacaaatgatttcaaaaaagcctttgaaattgctgaaaaacttgaagtaggtacagtccacattaataataaaacccagcgtggtccagataatttcccattccttggtgtcaaaggttctggagctggagtgcaaggaattaaatatagcattgaagcgatgacaaatgtcaaatccattgtttttgatgtgaaataa

SEQ ID NO: 1148 - DNA, 1929 bp, Streptococcus pneumoniae
atggataatagagaagcattaaaaacctttatgacgggtgaaaatttttatctccaacattatctaggagcacatagggaagaactaaatggagagtatggctataccttccgtgtttgggcacctaatgctcaggctgttcacttggttggtgattttaccaattggattgaaaatcagattccaatggtaagaaatgactttggggtctgggaagtctttaccaatatggctcaagaagggcatatttacaaatatcatgtcacacgtcaaaatggtcatcaactgatgaagattgacccttttgctgtcaggtatgaggctcgtccaggaacaggggcaatcgtaacagagcttcctgataagaaatggagggatggactttggctggcacgaagaaaacgttggggctttgctgaacgtcctgtcaatatttacgaggttcatgctggctcttggaagagaaatcctgatggcagtccttatagttttgcccaattgaaagatgaactcattccttacctagttgagatgaactatactcatattgagtttatgcccttgatgtcccacccactaggtttgagttgggggtaccagcttatgggttacttcgctttagagcatgcctatggtagaccagaggagtttcaagattttgtcgaggagtgtcatacccataatattggggttattgtggactgggtaccaggtcactttaccatcaatgatgatgccttagcctattatgatgggacaccgacttttgaataccaagaccataataaggctcataaccatggttggggtgcccttaattttgaccttggaaaaaatgaagtccagtccttcttaatttcttgcattaagcattggattgatatctatcatttggatggtattcgtgtggatgctgttagcaacatgctctatttggactatgatgatgctccatggacacctaataaagatggcggaaatctcaactatgaaggttattatttccttcaacgcttgaatgaagttattaagttagaatatccagatgtgatgatgattgcagaagaaagttcgtctgcaaccaagattacgggaatgaaagagattggtggtctaggatttgactacaaatggaacatgggctggatgaatgatatcctccgtttctacgaagaagatccgatttatcgtaaatatgactttaacctggtgactttcagctttatgtatgttttcaaggagaattatctcttgccattctcgcacgatgaagtggttcatggcaagaagagtatgatgcataagatgtggggagatcgttacaatcaattcgcaggcttgcgcaatctctatacgtaccaaatttgtcaccctggtaagaaattgctcttcatgggtagcgaatacggtcaattcctagaatggaaatctgaagaacagttggaatggtctaacctagaagacccaatgaatgctaagatgaagtatttcacttctcagctaaaccagttttacaaagatcatcgctgtctgtgggaaatcgataccagctatgatggtattgaaatcattgatgcggataatcgagaccagagtgttctttcctttattcgtaagggtaaaaagggagaaatgttagtctgtatctttaacatggtacctgttgagcggaaagattttacaatcggactacccgttgcaggaatttacgaagaagtatggaatactgagttggaagagtggggaggcgtttggaaagaacataatcaaactgttcaaacgcaagaaggactatggaaagattatgagcagaccttaacctttaccctaccggctatgggagcaagtgtatggaaaatcaaacgtcgcttgaaatctactaaaaccgtcacaaataaaaaccaaaaaggagtagaaaatgaaaaatga

SEQ ID NO: 1149 - DNA, 1143 bp, Streptococcus pneumoniae
atgaaaaatgaaatgttagctttgattcttgctggtgggcaaggaactcgtctcggtaaactcactcaaagcatcgcaaaaccagctgtgcaatttggggggcgctaccgtatcattgactttgccctatcaaactgtgccaactcagggattcataatgttggggtcgttacacagtatcaaccacttgctctcaacaaccatattgggaatggttcaagctggggactagacggtattaattcaggtgtctctattcttcaaccttattctgcaagtgaaggaaatcgttggtttgaggggactagtcacgctatttaccaaaatatcgactatatcgacagtgtcaatcctgagtatgtcttgattttgtctggggaccacatctacaaaatggactatgatgatatgctccagtctcataaggataataatgccagcttgacagtagcagttttagacgtccctcttaaagaagcaagccgttttggtatcatgaacacagatgctaacaatcgtattgttgaatttgaagaaaaaccagctcaacctaaatctacaaaagcttctatgggaatctacatttttgattggcaacgccttcgtaatatgttagtcgctgctgaaaagagcaaggttggcatgtcagactttggtaaaaatgtcattccaaattaccttgagtcaggtgaaagtgtttatgcttacgaatttagtggttattggaaagatgttggtactattgagtcactttgggaagcgaacatggagtatatttctccagaaaatgccttggatagtcgtaaccgtcaatggaagatttactcaagaaacttgatttcaccaccaaacttcctcggggcaaatgctcatgtggaagactcattagttgtagacggatgtttcgttgatggaactgttaaacattctatcctttcaacaggcgcgcaagttcgcgaaggagcggaagtccttgattcagttatcatgagtggagctatcattggtcaaggagctaagattaaacgtgccattattggtgaaggtgcgattatttctgacggtgtcgaaattgatggaacagatgaagtacaagttgtaggatataatgaagtagtgggggtagcaacagatgaagattga

SEQ ID NO: 1150 - DNA, 1140 bp, Streptococcus pneumoniae
atgaagattgataaatattctgccattttaggaaatacagttggttttcacaatatgtcgacattgacggaccaccgtccagtagcaagtttgccatttggtgggaaatatcgtttgattgacttcccactttcaagccttgctaatgcaggtgttcgtagtgtctttggtattttccagcaggataatatcagctcagtatttgaccatattcgttcaggacgcgagtggggcttatcaacccttcttagtcattactatctaggaatttacaatacccgtgtagaaagtagtacagttggaaaagaatactaccaacagcttcttacttatttgaaacgttctggctcaaaccaaacggttgccctcaactgcgatgttcttattaacattgatttgaaccaagttttccacctacatagtacaacaaaagagcctatcactgtagtttataaaaaactagctaagaaagatatttcagaagtaaatgcaatcttggatgtagatgaaacagaccatgttctttctcataaactctttgatagcaagtcaacagctgaaacgttcaatatgtctacagatatctttgtcgttgatacaccttggttgattgaacacttggaagaagaagctaaaaaagaacatccagagaaattgcgctatgttttacgggatttggctgtaaaagagggagctttcgcctacgagtacacgggctatctagccaatattcactctgttaaatcttattatcaagcgaatatcgatatgcttgaatcacaaaaattctattctcttttctcaccaaaccaaaagatttatacaaaggtcaaaaacgaagagccaacttactatgctaatacatctaaggtaagcacttctcagtttgcctctggtagtattattgaaggtcaagtagctaattctgttctatcacgtaatattcatgtccataaggatagcttggttaaagatagcctgctcttccctcgtgttgttattggagaaggggctcaggtcgaatatgctatcttggacaaaggggttgaagttgagcctggtgttgtgattcgaggaactgcagaacatccagttgtggttaagaaaggtgctaaagtaacagaggatattcattcatga

SEQ ID NO: 1151 - DNA, 1434 bp, Streptococcus pneumoniae
atgaaaattttatttgtagcagcagagggtgcacccttttcaaaaacaggtggtttgggagacgtcattggcgctcttccaaaatcactggtaaaagctgggcacgaagttgcagtgattttaccctactatgatatggtagaggctaaatttggaaatcagattgaagatgtgcttcattttgaggtgagcgttggttggcgcagacagtattgtggaattaagaaaacagtattaaatggtgtaaccttctactttattgacaatcaatattatttcttccgtggtcatgtttacggtgattttgatgacggagaacgctttgcctttttccaactggctgccattgaggctatggaaaggattgcctttattcctgatcttctccatgttcatgactaccatacagctatgattcctttcttgttgaaggaaaaataccgttggattcaagcctatgaggacattgaaacagttttaaccattcataatttagaattccaaggacaattttcagaaggaatgttgggtgatttgtttggagttggctttgaacgttacgctgatggcacccttcgatggaacaactgtctgaactggatgaaggcaggtattctctatgcgaaccgtgtttcaactgtttcacctagctatgctcatgaaattatgactagtcagtttggatgtaatttggatcagattcttaaaatggagtctggtaaagtatctggtatcgtgaatgggattgatgctgatctttataatcctcagacggatgctcttttagactatcatttcaatcaggaagatttgtctgggaaagccaaaaataaggcaaaattgcaagaaagagttggcttgcctgttagagctgacgttccactggtgggaattgtttctcgtttgacacgtcaaaaaggttttgatgtggtggtcgaaagtcttcaccatatcttgcaagaagatgttcagattgttcttttgggaactggcgatccagcctttgaaggagctttctcatggtttgctcagatttacccagacaagctatcagcaaatatcacttttgatgtcaaacttgctcaggaaatctacgctgcttgtgacctcttcctcatgccaagtcgttttgaaccgtgtggtttgtctcaaatgatggctatgcgttatggaaccttgccattggtccatgaagttggaggcttgcgagatacagtttgcgctttcaatccaatcgaaggaagcggtactggctttagctttgacaatctatctccttattggttaaattggactttccaaacagcattggacttgtatagaaaccatccagacatttggagaaacctacaaaaacaagctatggagagtgacttctcatgggatacagcctgcaagtcataccttgacttgtatcatagtttagttaattaa

SEQ ID NO: 1152 - DNA, 372 bp, Streptococcus pneumoniae
atgtctcaagtaaaaggcttgtgtgttttggatgtagatggaaccttaatcctagaagaagtgattgattttttagggagagaggcaggtcatgaggcggaaatttcgcagattacaagtcgggcaatgcgaggagagttggtctttgaaagcagtttaagaaaaagagtgtccttgttggaaggtcttcctattttggtctttgataacgtcttcaactcaattcatctatcgctaaatgtcccagagttcatctctattctccaaaagaatggcatcctagttgatctggtgtctggtggatttacaccaatagttggagagattagcaaaatcccttggtattgcctatttcactgccaaccagcttga

SEQ ID NO: 1153 - DNA, 330 bp, Streptococcus pneumoniae
ttggagagattagcaaaatcccttggtattgcctatttcactgccaaccagcttgaagtcaaagaaggtcttttaacaggaaaattagttggacaaattataagtccccaggtcaaaaaagaaactctggaaaaatggagaaagaaactaaaactttctaaagaaagaacggtggcaatcggtgatggggtcaataatctattaatgttgaagtcggcggagttaggaatcgccttttgtgccaaagaagtgctcaaaaaagaaataccacatcatgttgacaagagggattttttagaagttcttcctttgattgactgtttagaatga

SEQ ID NO: 1154 - DNA, 1116 bp, Streptococcus pneumoniae
atgaagattgtaattgcaccggattcgtttaaggaaagcttgacagctcaacaggtagctgaagcaataaaaagaggcttccaacaatcgatagcagatgtagaatgtctcctctgccctgttggtgatgggggagaaggtactgtagatgctatccgacattctcttgacctaaaagaaaaatggatccaagtgacagacccttctggacaaaaagaagccatgcgctattttcaaaaaggggaactggcactatttgaagtagctgacttggttggtcttggaaaaattccgctagagaaacgaaatccacttcaaatccaaacttgtggtattggagagttgattctccatctcatttctaaagggattaaagatatttatatcggtgttggtggcacggccagtaatgatggaggactggggattgctgctggtttaggttatcaattttatgatagggatggaaatgtcttgcctgcttccggtcaatccttattaaacttagcttctgtttcaacagaaaatcgctataaaattcctgaaggtgttcaaattcatattttagcagatgtcgtgagtcccttatgtggtcatcaaggtgcgacttacacttttggcaatcaaaaaggtctacatccgactatgtttgcagtcgtagatcaggcgatccaagatttttatgaaaaattctcacctgcaacattagaaattaaaggagcaggagcaggtggaggccttgctggtggtttgtgtgcctttgctcaggcaagtatcgtgtctggaattgatacctgcttggacttaatcaactttgataagaaagtttcagatgctgacttggttgttgttggagaaggaagacttgatagtcaaagctttgctgggaaagcgcctataggtgttgcaaaaagaacccctgttggagttcctgttattgctatttgcggtagtcttgctgaagatttacctcccctaccatttgaaaatatccaagctgtcttttctattttggagaaaagtgaacctttagaagatagtttgaaaaatgccagtctctatctggagcgcacggctgccaatattgggcacttattaaatatgtgcaagatttag

SEQ ID NO: 1155 - DNA, 447 bp, Streptococcus pneumoniae
atgacagatttatcaaaacaattacttgaaaaagctcatggtgggttaaaaataaatccggatgagcaaagacgctatcttggtacttttgaggaaagagttcttggatatgtagatattgacacagcaaatagccctcagttagaaaaaggctttttatttattttagaaaaccttcaggaaaaagcagagccactatttgtgaagatttcaccaactatcgaatttgataagcaagttttctacttaaaagaagcaaaagaaactgatagtcaagccaccatagtatctgaagagcatattacttctccttttggcctggttattcatagcaatgcaccagttcaagtagaagaaaaagaccttcgacttgcttttccaaaactttgggaagttaaaaaggaagaaccagccaaaacatccttatggaagaaatggtttagctaa

SEQ ID NO: 1156 - DNA, 1305 bp, Streptococcus pneumoniae
atgtcaattattactgatgtttacgctcgcgaagtcctagactcacgcggtaacccaacacttgaagtagaagtttacactgaatcaggtgctttcggacgtggtatggttccatcaggagcttctactggtgaacacgaagcagttgaacttcgcgacggtgacaaatctcgttacggtggtcttggtacacaaaaagctgttgacaacgtaaacaacatcattgctgaagctatcattggctacgatgtacgtgatcaacaagctattgaccgtgctatgatcgcacttgacggtactcctaacaaaggtaaattgggtgcgaatgcaatcctcggtgtgtctatcgctgtagctcgtgctgctgctgactaccttgaaatcccactttacagctaccttggtggattcaacactaaagttcttccaactccaatgatgaacatcatcaacggtggttctcactctgacgctccaatcgctttccaagagttcatgatcttgccagttggtgcgccaacatttaaagaagcccttcgttacggtgctgaaatcttccacgcccttaagaaaatccttaaatcacgtggtttggaaactgccgtaggtgacgaaggtggattcgctcctcgtttcgaaggaactgaagatggtgttgaaactatccttgctgcgattgaagctgctggatatgtaccaggtaaagacgtatttattggatttgactgtgcttcatcagaattctacgataaagaacgtaaagtttacgactacactaaatttgaaggtgaaggtgctgctgttcgtacatctgcagaacaaatcgactaccttgaagaattggttaacaaatacccaatcatcactattgaagatggtatggatgaaaacgactgggatggttggaaagctcttactgaacgtcttggtaagaaagtacaacttgttggtgacgacttcttcgtaacaaacactgactaccttgcacgtggtatccaagaaggtgctgctaactcaatccttatcaaagttaaccaaatcggtactcttactgaaacttttgaagctatcgaaatggctaaagaagctggttacactgctgttgtatcacaccgttcaggtgaaactgaagattcaacaatcgctgatattgcagttgcaactaacgcaggacaaatcaagactggttcactttcacgtacagaccgcatcgctaaatacaaccaattgcttcgtatcgaagaccaacttggtgaagtagctgaatatcgtggattgaaatcattctacaaccttaaaaaataa

SEQ ID NO: 1157 - DNA, 468 bp, Streptococcus pneumoniae
tttaaggattttcttaagggcgtggaagatttcagcaccgtaacgaagggcttctttaaatgttggcgcaccaactggcaagatcatgaactcttggaaagcgattggagcgtcagagtgagaaccaccgttgatgatgttcatcattggagttggaagaactttagtgttgaatccaccaaggtagctgtaaagtgggatttcaaggtagtcagcagcagcacgagctacagcgatagacacaccgaggattgcattcgcacccaatttacctttgttaggagtaccgtcaagtgcgatcatagcacggtcaatagcttgttgatcacgtacatcgtagccaatgatagcttcagcaatgatgttgtttacgttgtcaacagctttttgtgtaccaagaccaccgtaacgagatttgtcaccgtcgcgaagttcaactgcttcgtgttcaccagtagaagctcctga

SEQ ID NO: 1158 - DNA, 132 bp, Streptococcus pneumoniae
ttgtatttagcgatgcggtctgtacgtgaaagtgaaccagtcttgatttgtcctgcgttagttgcaactgcaatatcagcgattgttgaatcttcagtttcacctgaacggtgtgatacaacagcagtgtaa

SEQ ID NO: 1159 - DNA, 507 bp, Streptococcus pneumoniae
gtgaagagtttgggtataaacttttacctcttcctccctactcacctgagtacaatcctattgagaaaacatgggctcatatcaaaaagcacctcaaaagggtattaccaagttgcaataccttttatgaggctcttttgtcttgttcttgtttcaattgactatataaattgtctaagcgaaacaaccgataagaattggcacaaaagcgaccgtgtttttgttaccaatacaggaaaaacagttcatagttctatcttgagcaagtctctccagcgagcaaacgaacgccttaaaaaaccaattcccaaacatctgtcccctcacatcttcagacacaccactattagcatcttatcagaaaataaaattcctttaaaaacaatcacggacagggttggtcattccgactctgaagtcactacttccatctacacccacgtcacaaagaacatgaaagatgaagcaatcaatgtactggataaagttatgaaaaagattttttaa

SEQ ID NO: 1160 - DNA, 339 bp, Streptococcus pneumoniae
ttggttgcaggtctaacaaatggtgagttaatcgctccaatgacttacgaagagacgatgacgagcgacttttttgaagcttggtttcagaaatttctcttaccaacattaaacacaccatcggttattattatggataatgcaagattccatagaatggggaagctagaactcttgtgtgaagagtttgggtataaacttttacctcttcctccctactcacctgagtacaatcctattgagaaaacatgggctcatatcaaaaagcacctcaaaagggtattaccaagttgcaataccttttatgaggctcttttgtcttgttcttgtttcaattga

SEQ ID NO: 1161 - DNA, 348 bp, Streptococcus pneumoniae
atgtggtataatcttcttatggcatattcaatagattttcgtaaaaaagttctctcttattgtgagcgaacaggtagtataacagaagcatcacacgttttccaaatctcacgtaataccatttatggctggttaaagctaaaaaagaaaacaggagagctaaaccaccaagtaaaaggaacaaaaccaagaaaagttgatagagatagacttaaaaactatcttactgacaatccagacgcttatttgactgaaatagcttctgaatttggctgtcatccaactaccatccactatgcgctcaaagctatgggctacactcgaaaaaaagaaccacacctactatga

SEQ ID NO: 1162 - DNA, 3276 bp, Streptococcus pneumoniae
atgaaattactttatactgatattcggacttctttgacagaaattctaacaagagaggcagaagagctagttgcagctggcaagcgggtcttctacattgcccccaactctctttcttttgaaaaggaacgcgccgtgctagaatacttgtcccagcaggcttctttttcgattaccgtcacgcgctttgctcaaatggctcgctatctggtcttgaatgatttaccagctaaaactactcttgatgatatcggtcttgggttggccttttacaaatgccttgccgaactcgatcccaaggacttgcgtgtttatggcgctattaagcaggatcctcaattgatccagcagttaattgagctttaccatgagatgaccaaatctcagatgagttttttggacttggagaatttaacagatgaggataagagggcggatttactcttgatttttgagaaagtaacagcctatcttaatcaaggtcagttagcccagggaagtcagttgtcccatttgattgaggctattgagaatgacaaggtaagtagtgattttaatcaaatcgccttggtcattgacggctttactcgtttttctgctgaggaagagcgggttgtggacttacttcacggcaaaggtgttgagattgttatcggggcttatgctagtaagaaagcctataccagtccttttagcgagggcaatctctaccaagccagcgtaaaatttctccatcatctggcttctaaataccaaacgcctgctcaggactgttctcaaactcatgagaagatggatagttttgacaaggcctctcgtttgttggagtcttcttatgacttttcagaactcgctttggatgtcgatgagaaagaccgtgaaaatttacaaatctggtcttgtttgacgcaaaaggaggagttggagctagtagcccgtagtattcgtcagaaattacatgagaactcagacctgagctacaagcattttcgtattctcttgggggatgtagcttcttaccagttatctctcaaaaccatttttgaccagtatcagattcctttttatcttggtagaagcgaagccatggctcatcatcccttgactcagtttgtcgagtctattttagctttaaaacgttaccgttttcgtcaggaggatttgatcaatcttcttagaactgatttgtatactgacctcagtcagtctgatattgatgcttttgagcaatatatccgctatcttggtatcaatggcttgccagcctttcagcaaaccttcaccaaatcccaccatggaaaatttaatcttgagcgtttgaatgtcctccgcctgagaattttagcacctcttgaaaccctctttgccagccgaaaacaaaaggctgaaaacctcctacaaaaatggagtgtctttctaaaagaaggagctgtgactaagcagttacaagatttgacaaccactttggaagctgtagaacaggaaagacaaaccgaagtttggaaggctttctgccatgttttagaacaatttgcgactgtttttgctggttcacaggttagtctggaagacttcctagccttgctccattctggaatgagtttgtcccaataccgtaccattccagcaacagtggacactgttctggtgcagagttacgatttgattgcaccattgactgctgactttgtctatgctattggactaactcaggacaatttaccaaaaatttctcaaaacaccagtcttctgacagatgaagaaaggcaaaacctaaaccaaacgaccgaagaaggcgttcaattactgattgccagcagtgaaaatctcaagaaaaatcgctacactatgctttccttggtcaattctgctcgtaagcagttgttcttgtcggctccaagcctttttaacgaaagtgaaagtaaggaatctgcctatcttcaagagttgatccattttggatttaggcggagagagaagaggatgaatcacaaaggactgtctaaggaggatatggggtcctatcacagtcttttgtctagtctggttgcctatcaccagcagggtgagatgagcgatactgagcaagatttgacttttgtcaaggttctgtcgcgtgtcataggtaaaaaactagatctgcaaggtctggaaaatccagctatcccaaccagtccaagcagcaagaccttaaccaaggacaccttgcaagctctctatcctgccaaacaggagttttacctgtctacgtcgggtttgacagagttctatctcaatgaatacagttatttcctacgctacgttttaggcttgcaggaggaattacgtttgcgtcctgatgcccgtagtcacgggaatttcttgcatcgtatctttgaacgcgccttacagttgcctaatgaagattcctttgaccaacgtctagaacaagctattcaagaaaccagtcaagaacgcgaatttgaagctatttatcaagaaagtttggaagcccagtttaccaaggaagttttgcttgatgttgcacggacgactggacatattctccgacacaatccagccatcgaaaccatcaaagaagaagcaaattttggtggaaaagaccaagcctttattcaattagacaatggacgcagtgtctttgtacgaggcaaggtggaccggattgaccgtttgaaagctaatggagcgataggagtagtagactacaaatccagtctgactcagttccagtttcctcatttctttaatgggctcaattctcagttaccaacctatcttgctgccctaaaaagagaaggggagcagaactttttcggcgccatgtacttggaaatggctgaacctatccaatctctgatggcggtaaaaagtctggcaggagcagtggtagaagccagcaaatctatgaaataccaagggctcttcttggaaaaagaaagcagttatttaggcgaattttataacaaaaacaaggctaatcaactgacagatgaggaatttcagctcctactggactacaatgcctatctttacaagaaagctgctgagaagattttagcaggccggttcgccatcaatccttatactgaaaatggcagaagcattgccccatacgtccagcaacatcaggctattacaggctttgaagccaattaccatctgggccaagcccgtttcctagaaaagttggacctagctgatggcaagcgtctggtcggagaaaaactcaagcaagcttggtttgaaaaaataagagaggagttaaatcgatga

SEQ ID NO: 1163 - DNA, 3651 bp, Streptococcus pneumoniae
atgaagcttattccctttttaagtgaggaggagattcaaaaactgcaagaagcagaagcaaattcgagcaaggaacagaagaaaactgccgaacaaatcgaagctatctacacttctggtcagaatatcctggtctcagcatcggctggttctggaaagacctttgtcatggtagagcgcattctggaccaattggcgcgtggtgtcgaaatttctcaactctttatctcaacctttaccgtcaaggctgcaactgaacttaaagaacgtttagagaaaaaaatcagcaagaaaatccaagaaacagatgatgtcgacctcaaacaacacttgggtcgccagttggcagacctacccaacgctgccatcggaaccatggactctttcacacaaaaattccttggcaaacatggttatctgcttgatattgcacctaatttccgtattttacaaaaccaaagcgagcaacttcttctcgaaaacgaagtctttcatgaggtctttgaagcgcattaccaaggtaaacagaaagagacctttagtcatttgctgaaaaactttgctgggcgtggcaaggacgaacggggtctgcggcagcaagtctataaaatctatgacttcctccaatccaccagtaatcctcaaaagtggctgagtgaatctttcctcaaaggctttgagaaagctgattttaccagtgaaaaagaaaaactgactgagcaaatcaaacaagccctttgggatttggaaagctttttccgttaccatctggataacgatgccaaggagtttgcaaaggctgcctatttagaaaatgttcagttaattctggatgaaattggctccctaaatcaggagttcgatagtcaggcttatcaggcagtacttgcgcgtgttgtcgccatctctaaggagaaaaacggtcgtgctctgactaatgccagccgtaaggctgatttgaagcccctggctgatgcctacaacgaagagagaaagacccagtttactaaactaggacaattatcagaccagatagcgattctcgactatcaagaacgttatcatggagacacttggaaactagctaaaaccttccaatctttcatgagcgattttgtagaggcttatcgtcagagaaaacgacaggaaaatgcctttgaattcgctgatatcagccattacaccattgagattttagaaaatttcccacaagttcgtgagtcttatcaggagcgcttccatgaagtcatggtcgatgagtatcaggataccaaccatattcaagaacggatgctggaattgttgtctaatggccacaatcgctttatggtgggagatatcaagcaatccatctatcgtttccgtcaggcagacccgcagattttcaatgagaaattccaacgctatgcgcaaaatcctcaagaaggcaagctcattctcctcaaggaaaatttccgtagtagttcagaagtgctgtcagcaaccaatgatgtctttgaacgtctcatggaccaagaggtcggcgaaatcaactatgataacaagcaccagcttgtttttgccaataccaaactgactcccaatccagacaacaaggcagaatttctcctctacgacaaggacgatacaggtgaggaagaagagagtcaaacagaaacgaaactaacaggcgaaatgcgcttagttatcaaggagattctgaaacttcatcaagaaaaaggtgttgcctttaaggaaattgcccttctgacctccagccgcagtcgtaatgaccagattctcctcgccctgtctgagtacgggattcctgtcaaaactgacggagagcaaaacaattatctccaatccctagaagtgcaagtcatgctagacactcttcgtgtcattcacaatcccctgcaagactacgccttggttgcccttatgaagtctccaatgtttggttttgatgaggatgagctagcacgtttgtcccttcagaaagcagaggataaagtccacgaaaatctctatgagaaactggtcaatgcacaaaaaatggcaagtagtcaaaaaggcttgattcacacagctctagctgaaaaactaaagcaattcatggatatcctagcttcttggcgcttgtatgccaaaacccactctctctatgacttgatttggaagatttacaacgaccgtttttattatgactatgttggggctttgccgaatggtcctgctaggcaggccaatctctatgccctagcactgcgtgctgatcaatttgaaaagagcaatttcaaaggtttgtcgcgttttattcgtatgattgaccaagtcttagaagcccagcacgatttggcaagcgtggccgtcgcaccgccaaaagatgcagtagagctcatgaccatccacaagagtaaagggctggagtttccttacgtctttatcctcaatatggatcaagatttcaacaagcaagactctatgtcagaagtcattctcagtcgtcagaatggtcttggtgtcaaatatattgccaagatggagacaggggcagtagaagaccactatcctaaaaccatcaaactctccattcctagtctgacctataggcagaacgaagaggaattacagctagcaagctattctgagcagatgcgtttgctgtatgttgctatgacgcgggctgagaaaaagctctatcttgtcggcaagggttctcgtgaaaagctggaatccaaggaatacccagcagccaaaaatgggaaactaaatagcaatactagactgcaagcacggaatttccaagattggctttgggctatcagtaaagtgtttactaaggacaagctcaactttagttatcgttttattggcgaagatcagttgaccagagaagctatcggagagttggaaaccaagagtcctctccaagatagctcccaagcagacaatcgtcagtcagataccatcaaagaagctctggaaatgctgaaggaggtggaagtttataatactcttcaccgcgcagctattgaacttcctagtgttcaaaccccaagtcaaatcaagaaattctacgaaccagttatggatatggaaggtgtcgagattgctggtcaaggtcagtcagtaggcaagaaaatcagcttcgatttgccagatttttcaaccaaagaaaaggtaactggagctgagattggtagcgctactcacgaactcatgcagagaattgacctcagccagcaactaacccttgctagcctaacagaaacactcaaacaagttcaaactagccaagctgtcagagacaagatcaatcttgataaaattcttgctttctttgacacagtactcggtcaggaaattcttgctaataccgaccatctctatcgcgagcaacctttctccatgctcaaacgagaccaaaagagtcaggaagactttgttgtccgtggtatccttgatggctatctgctttacgaaaacaaaattgttctgttcgactacaagacagaccgctatgatgaaccaagtcaactcgtagaccgctatcgtggtcagttagctctatacgaagaggctttatcacgagcctattcgattgaaaatattgaaaaatacttgattttactcggtaaagacgaggttcaagttgtaaaagtataa

SEQ ID NO: 1164 - DNA, 237 bp, Streptococcus pneumoniae
tactcaataaaaatcaaagagcaaactagaaagctagccgcagtcagctcaaaacactgttttgaggttgtggatagaactgacgaagtcagctcaaaacactgttttgaggttgtggatagaactgacgaagtcagtaaccatatatacagcaaggcgaagctgacgtggtttgaagagattttcaaagagtataagttatacttttacaacttgaacctcgtctttaccgagtaa

SEQ ID NO: 1165 - DNA, 192 bp, Streptococcus pneumoniae
ttgaaaatctcttcaaaccacgtcagcttcgccttgctgtatatatggttactgacttcgtcagttctatccacaacctcaaaacagtgttttgagctgacttcgtcagttctatccacaacctcaaaacagtgttttgagctgactgcggctagctttctagtttgctctttgatttttattgagtattag

SEQ ID NO: 1166 - DNA, 1179 bp, Streptococcus pneumoniae
atgacacttccagttagaaaatccctgcacgatgcagttttacaggcttcgaaagcggatacttgggaacaagcgaccaaggaatggaatgaagtttcctttatttttaacggtatcggccgtagcaattgtgtctgtggaaatgccatcaaatacgcttatgaactctttaacggtgtcacaggccaacgcctctttccaattggtagcgactgtgttcgtcattttcatcgattgccccttgaccagcaattggaagaggaagaaaaactgctcagaaaggttgaaaatctaaccagaaaagctcagaaaaaggaaaaaatcaaggtcaataaaagtgactttgacgagcgacttctaaaatggctctgggaaaaaggtgttttcaaacccaatcgtggcaatcaatttgcgcctgagagagactaccagcttttcctagaagtctttcagggaggaagttggaccaaggcggaaccaaagaaaaaggctcggatggaagaagtccttgaaaagtgtatcaaaccctttttacttgggaaatcggatgaccaactctaccttgtcaagctaggcaaggagaaaattgactacgaacaagaactccgtatccaggcagagaaagaacgcaagaagagggataaaatcgccaagcaatatgcagacaatctggttctagccatgggacccgcagagcgtgcttatcaagattactttggctttacagagaccctgactcaagaagaacgcaagtgggaaaaaattctttttggtaaaaatagagcagaacgggctatcaaggccaaacaataccaaaaagagctggaaaaagaccaacgaattgccagtcaggatccaattgaaagaaaacagaaacagacttggctcctcaattcctattttcgtgagcttcctgaagaaaaagctcgattttctaggctcttattagaatatcgaaaaaatggtgaagtacccttttcaactgaatacctgtcagatcatctcatcgactttttctataaaatgaaagcctttgaatttgaaatcgcaccagaacaagtccgagattttctaaaaaaaagcctgcaggaagactatcgctcatcagcacaaggaagctggatagaaggaattctcctcaactgcctcaaaccatttttagaacgattagtgatatga

SEQ ID NO: 1167 - DNA, 333 bp, Streptococcus pneumoniae
atgaaaaacgctcttgtttttcaccaaaatacttttccattattcctccttgaaataaaatttatatatgttacaaagacctttattatattagtgtattatctattatctatagaaaaggcagtataccttaattatactcttaatttacaaaaaagtcttaaaattgagatgcgctttcatactttgttttatattatttgggggtacaataacacctaccatgaaatttacacggtaggtgttactcatatcactaatcgttctaaaaatggtttgaggcagttgaggagaattccttctatccagcttccttgtgctgatgagcgatag

SEQ ID NO: 1168 - DNA, 5898 bp, Streptococcus pneumoniae
atggaaaagtattttggtgaaaaacaagagcgtttttcatttagaaaattatcagtaggacttgtatctgcaacgatttcaagtttattttttatgtctgtattagctagttcatctgtggatgctcaagaaactgcgggagttcactataaatatgtggcagattcagagctatcatcagaagaaaagaagcagcttgtctatgatattccgacatacgtggagaatgatgatgaaacttattatcttgtttataagttaaattctcaaaatcaactggcggaattaccaaatactggaagcaagaatgagaggcaagccctagttgctggtgctagcttagctgctctgggaattttaatttttgctgtttccaagaaaaaggttaagaataaaacggtattacatttagtattggttgcgggaataggaaatggtgtcttagtttcagtccatgctttagaaaatcatcttttgctaaattacaatacggactatgaattgacctctggagaaaaattacctcttcctaaagagatttcaggttacacttatattggatatatcaaagagggaaaaacgacttctgattttgaagtaagtaatcaagaaaaatcagcagccactcctacaaaacaacaaaaggtggattataatgttacaccaaattttgtagaccatccatcaacagtacaagctattcaggaacaaacacctgtttcttcaactaagccgacagaagttcaagtagttgaaaaacctttctctactgaattaatcaatccaagaaaagaagagaaacaatcttcagattctcaagaacaattagccgaacataagaatctagaaacgaagaaagaggagaagatttctccaaaagaaaagactggggtaaatacattaaatccacaggatgaagttttatcaggtcaattgaacaaacctgaactcttatatcgtgaggaaactatagagataaaaatagattttcaagaagaaattcaagaaaatcctgatttagttgaaggaattgtaagagtaaaacaagaaggtaaattaggtaagaaagttgaaatcgtcagaatattctctgtaaacaaggaagaagtttcgcgagaaattgtttcaacttcaacgactgcgcctattccaagaatagtcgaaaaaggtactaaaaaaactcaagttataaaggaacaacctgagactggtgtagaacataaggacgtacagtctggagctattgttgaacccgcaattcagcctgagttgcccgaagctgtagtaagtgacaaaggcgtaccagaagttcaaccagcgttgtccaaagcagttataaccgacaaaggtgagactgaggttcaaccagagtcgccagatactgtggtaagtgataaaggtgaacctgaacaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcgaaaatactggggaagagtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagagaaaaaactcgaattaagaaatgtttctgatattgagttgtatagtcagacgaatggaacctacagacaacatgtttcattggatggaattccagagaatacggatacttactttgtcaaggtaaaatcttcagcatttaaagatgtctatataccagtagcttcaataactgaagagaaaagaaatgggcagtcagtttataaaatcacagccaaagctgagaaactccagcaagaactagaaaataaatatgtcgacaatttcaccttctacctcgataagaaggctaaagaggaaaatacaaactttacttcctttagcaacctggtcaaagctataaaccaaaatccctctggaacctatcatttagcggccagcctgaatgctaacgaagtggagcttagtactgatgataaatcctatatcaagggaacctttactggtcagttgattggtgaaaaagatggtaagcattatgctatttacaacttgaaaaagcctctttttgaaaacttgagtggtgctacagtagaaaaactgagtctaaaaaatgttgctatttcagggaaaaatgatattggttcactggcaaatgaagctacgaatggcacaaagattaaacaagttcatgttgatggtgttctggctggagaacgtggtgtcggtggtttgttggctaaggcagaccaatcaagcatcgcagagagcagtttcaagggaagaattgtcaatacctatgaaacgactgattcctacaatattggcggtctggtcggtcatttaacaggaaaaaatgcgtctattgctaaatccaaagcgacagtaaccatttcgtcaaacaccaataggtcagatcagactgtcggtggtcttgcaggtctagtagaccgagacgcacagatccaagatagctatgctgaaggtgatatcaacaatgtcaagcactttggtagagtcgctggagtggcaggcaatttgtgggatcgaacttctggtgatgttaggcatgctggaagtttgaccaatgttctcagcgatgttaatgtaacaaacggaaatgccatcactggataccactatacaggaatgaaggtagctaatacatttagtagtaaggctaatagagttttcaatgtcactttagagaaggatgaggtcgtcagcaaggaatcctttgaagaaagaggaacaatgctagatgcttctcaaattgtaagcaaaaaagcagaaataagtcctctcactctaccaacggtggaacccctctcaacaagtggcaagaaagacagtgatttttctaagatagcccattatcaagctaaccgtgctttggtttataagaacattgaaaaattgttacctttttataataagtcaaccatcgtgaaatacggaaacctggttaaggagaacagtctcttataccaaaaagaactcttatctgcagttatgatgaaggatgaccaagtaatcacagatattgtttccaacaaacagactgcaaacaaactattacttcactataatgaccattcatctgagaaatttgatctcaagtaccagactgattttgccaatctagcagaatataatctaggtaatacgggacttctctacactcctaaccaattcttatatgatcgagactctattgttaaggaagtcttgcctgagttgcagaagcttgattaccagtcagatgctatcagaaagacacttggtatttctccagcagttaagttaaccgagctctatttagaagagcagttctccaaaacaaaacaaaatctgggaggcagcttgaaaaaacttttgtcagcagatgccggtctagctagcgataactcagtcaccagaggctatcttgtagataaaatcaagaataataaggaagccttgctactcggtttaacttatttagaacgttggtataactttaactatggtcaagtgaatgtcaaagacctagttatgtatcatccagacttctttggtaaaggaaatacttccccactagatactctgattgagttaggtaaatctggctttaacaatcttcttgccaagaacaatgtcgatacttatggtatcagtctagccagccatcatggaacgacagatttgtttagcgcacttgaaacttaccgaaaagtctttttaccaaacactagcaacaatgactggtttaaaaaacagaccaaagctttcattgtcgaagaaaaatccactattgcagaggtcaaagccaagcaaaagcaagcaggaactaagtactctatcggtgtttatgaccgaattactagtaatacttggaagtaccggaatatggtcttgcctctccttaccttgccagaaagatctgtatttgtcatctcaaccttgtctagtctaggatttggtgcttacgatcgctaccgtaatagtgaacataaagcaggcaaggacctcaataatttcgttgaagaaaatgcgagtgaaactgccaaacgtcagcgagatcactacgattattggtatcgcattttagataatgagggacgtgaaaaactatatcgtacgattctcctttatgatgcctataagtttggtgatgacacaacatctggaaaagctacagtggaggctaagtttgatagctccaatccagccatgaagaatttctttggtccagttggtaataaggttgttcataatcatcacggtgcctacgcaacaggagatggtgtctactatatgtcttaccgcatgctcgacaaggatggagccattacctatacccatgagatgacccatgattcggatcaagatatttaccttggcggctatggtcgaagaagtggtcttggtcctgagttctttgctaaaggtttattacaagcgccagaccatccatatgatgcgaccattaccattaccattaactctatcttgaaacattcaaaatcagatagcttagaaggatcgcgtctgcaagtcttggatccgacagaaagattccaaaactcagcagatcttcaaaactatgttcacaacatgtttgacctcatctatatgttggaatatctagaagggcaatcgattgttaagaaactgaatgtttctcagaaaatggaagctctcagaaaaatcgagaatcaatatctaacagatcctgctgatggaaatgaggtttacgctactaacgtagtcaaagaattgacagaagaagaggcccgaaacctgaatagttttgatagtttgattgacaataatattctttcagctcgtgagtataaggctggtacatatgagagaaatggctactttactataaaactctttgcaccaatcttttcagcattgagcagtgagaaaggtactcctggagatcttatgggacgaaggatagcttatgaactcttagctgctaaaggatttaaagatggtatggtaccatatatttccaaccaatatgaaggaattgctaaacaaaatggtcagacaatcaacctttacggtaaaaagcaaggattagtgacagataagcttgttttggaaaagatattctctggcaagtatccatcttggacagcctttaaaaaagctatgtatcaagagcgtattgctcagtttgatcatttgactaaagttatttttaaagatccgacaaaaccatggccaagctatggcacaaagactatcaataatgtggatgaattgcaagccctcatggaccaagctgttctcaaggatgctgaaggtccacgttggagtaattataatccagaaatcgacagtgccgttcataagttgaagagagcaatctttaaagcctatcttgaccaaacaaatgattttagaagttcaatttttgagaataaaaaatag

SEQ ID NO: 1169 - DNA, 228 bp, Streptococcus pneumoniae
aaaggtgatgaagaacaaaccaagattcaagcaggaattcctactgataatgaagtaagttatgctcttatttatcagcaggaaactcttcctgcaacaggttcatcaacttctgcgcttacagctttaggcctattagctgttggtagtttagttcttttggttcggaacagttttttgctccctctgaaaagtcatcatttgatggcttttttctatatagggtaa

SEQ ID NO: 1170 - DNA, 852 bp, Streptococcus pneumoniae
atggctactattcaatggtttcctggtcacatgtctaaagctcgtcgacaggtgcaggagaatttaaaatttgttgattttgtgacgattttagtagatgcacgcttgcctctatctagtcaaaatcctatgttgaccaagattgttggtgataaaccaaaactcttgattttaaacaaggccgacttggctgatccagcaatgaccaaggaatggcgtcagtattttgaatcacaaggaatccagacgctagctatcaactccaaagagcaagtgactgtaaaagttgtaacagatgcggccaagaagctcatggctgataagattgctcgccagaaagaacgtgggattcagattgaaaccttgcgtactatgattatcgggattccaaacgctggtaaatcaactctgatgaaccgtttggctggtaaaaagattgctgttgttggaaacaagccaggggtcacaaaaggtcaacaatggcttaaaaccaataaagacctggaaatcttggatacaccggggattctctggcctaagtttgaggatgaaactgttgcacttaagttggcattgactggagctatcaaggatcagttgcttcctatggatgaggttaccatttttggtatcaattatttcaaagaacattatccagaaaagctggctgaacgcttcaaacaaatgaaaattgaagaagaaccgtctgtgattattatggatatgacccgcgccctcggtttccgtgatgactatgaccgtttttacagtctcttcgtgaaggaagttcgtgatggcaaactcggtaactataccttagatacattggaagacctcgatggcaacgattaa

SEQ ID NO: 1171 - DNA, 780 bp, Streptococcus pneumoniae
atggcaacgattaaagaaatcaaagaactccttgtgacagtcaaggagttagaaagccctatttttttagatcttgaaaaggataatcgctcaggagttcaaaaagaaatcagcaagcgtaaaagagccattcaagctgaattagatgaaaatttgcgcttggaatccatgctttcttatgaaaaagaactttataagcaaggattgaccttaattgcaggtattgatgaggttggtcgtggtcctcttgctggtcctgtagtcgctgcggccgttattttacctaaaaattgtaagattaaaggtctcaacgacagcaagaaaattcctaaaaagaaacatctggagattttccaagccgttcaagaccaagccttgtcgattggaattggtatcatagataatcaggtcatcgaccaagtcaatatctatgaagcaaccaaactagccatgcaagaagcaatctcccagctcagccctcaaccagagcatcttttgattgatgccatgaaactggacttgcccatttcacaaacctccattatcaaaggagatgccaactccctctctatcgcagcagcatctatagtagccaaggtaacacgtgatgaattgatgaaagaatacgatcagcagttccctggctatgatttcgctactaatgcaggatatggcacagctaaacatctggaaggcctcacaaaactaggagttaccccaattcatcgaaccagctttgaacccgttaaatcactggttttaggtaaaaaagaaagttaa

SEQ ID NO: 1172 - DNA, 1551 bp, Streptococcus pneumoniae
atggaggaacagtcggaaatagtccgttctaagaaagaattcgcctttgcatctagcactatactatcccaagttggtcgaggaatcattgtcggcctcatcgttggaattatcgtcggatcctttcgtttcttaattgaaaagggattccacctgatacaaggagtttatcaagatcaagggtacttagtgcgcaatctttttgtactggttttgttttatatactcatctgttggctcagtgccaaactaacacggtcagaaaaagatattaaaggctcaggaattcctcaagtcgaagccgaactgaaaggcctcatgtccctcaactggtggggcattctttggaaaaaatatgtgctaggtattcttgctattgccagtggactcatgctgggtcgagaaggacccagtattcaacttggagcagttggtggtaaaggaattgccaagtggctcaaatccagtccagtagaggaacgttccttgattgccagtggagctgcagcaggtttagccgcagcctttaatgctcctattgcagcacttctctttgttgtagaagaagtctatcaccatttttcgcgctttttctgggtctcaactctagcagccagcatcgtagcaaactttgtgtctctactcatgttcggtttgacaccagtattggatatgccagataacattcctcccatgaccctagatcagtattggatatatctcgtcatgggaattttccttggattttcaggttttctctatgagaaagctgtattaaacgttggaagagtttatgacttgattggtcaaaaaatccatttggatagggcttattatcccatcttggcttttatccttatcataccagtcggaatcttcttacctcaaatccttggtggcggaaatcagcttgtcctttctttaactgaacaaaattttagttttcaagttttattagcttactttttgatccgctttatttggagtatgattagctatggaagtggactgccaggaggaattttcctccccattttagctcttggttctttgcttggtgccttagttggtgttatctgtgtcaatcttggacttgtcagtcaagagcaattccctatatttgtcattctaggaatgagtggctattttggatccatatcaaaagctcccttaaccgctatgatcctcgtaactgagatggtaggagatattcgcaacctcatgccacttggtcttgtcactcttgtttcttatattatcatggatttgctcaaaggtacgccagtctatgaagccatgctggaaaaaatgcttccagaagaagtatctagcgaaggagaagttacacttatcgaaataccagtttctgataaaattgctgggaaacaagttcatgaactcaacttaccacacaacgtcctcatcacaactcaagtccataatggcaagagccaaacagttaacggctcaaccagaatgtatctgggtgatatgattcacctggttattccaaaaagtgaaattggaaaagtcaaagatttgttgttgtag

SEQ ID NO: 1173 - DNA, 1071 bp, Streptococcus pneumoniae
atgaaacgtgagattttactggaacgaatcgacaaactaaaacaactcatgccctggtatgttctggaatactaccaatctaagctggctgtgccctacagttttacaaccctgtacgaataccttaaggaatatgaccgatttttcagctgggttttggagtctggtatttcaaacgctgataaaatatccgatattcctttatcagttttggaaaatatgtctaagaaagacatggaatcctttatcctttatctacgtgaacgtcccttgctgaatgctaatacaacaaaacaaggtgtttcacagacaactatcaatcgaaccttatcagcactttctagtctttacaagtatctaaccgaggaggttgaaaacgatcagggggaaccttatttctatcgtaatgtaatgaaaaaagtttcaaccaagaaaaagaaagaaacccttgctgccagagctgaaaatatcaagcaaaaactctttctaggtgatgaaacagaaggttttctaacttatatcgatcaagagcacccacaacagctttcaaatcgagctctctcatcattcaacaaaaataaagaacgagatttagccattattgcccttctcttggcatctggtgttcgcttatctgaagctgttaatctagatctaagagatctcaatctaaaaatgatggttattaatgttactcgaaaaggtggcaaacgtgactcagtcaatgtcgctgcttttgctaaaccttatttagagaattatctggccattcggaatcaacgctataaaacggaaaaaacagatacagccctttttttaactctctacagaggtgttcctaatcgtatcgatgcttctagcgttgagaaaatggttgctaaatactcagaggattttaaagtacgtgtaacaccccataaactgcgccatacgctagcaactaggctctatgatgcgactaaatcacaagttttagtcagtcaccaactaggacatgccagcacacaagtcactgacctctatacccatattgttaatgatgaacaaaagaatgctctagatagtttatga

SEQ ID NO: 1174 - DNA, 990 bp, Streptococcus pneumoniae
atgaaatacattatcaatcattcaaatgacactgcttttaatattgccttggaagaatacgcctttaaacaccttttggatgaggatcaaatcttcctactttggattaacaagccatctatcattgttggtcgtcaccagaacactatcgaagaaatcaaccgtgattatgttcgcgaaaatggtattgaggtagttcgccgtattagtggtggtggagctgtttaccacgatttaaataacctcaactacacgatcatctccaaagaagatgaaaataaggcatttgacttcaagagcttctcaactccggttatcaataccctggctcaactcggggttaaagctgagttcacaggtcgtaatgaccttgagattgatggtaagaagttctgtggcaatgcccaagcctatatcaacggccgtatcatgcaccacggttgcttgctctttgacgttgatttgtcagtcctcgcaaatgcccttaaggtttcaaaagataaatttgaatcaaaaggtgtgaaatccgtccgtgcccgtgtaactaatattatcaatgaattaccaaaaaaaatcacagtcgaaaaattccgtgatttactcttggaatacatgaaaaaagagtacccagagatgactgaatacgtcttttcagaagaagaattggccgaaatcaatcacatcaaggatactaagtttggaacttgggactggaactatggtaaatcacctgaatttaacgtccgtcgtggaaccaaattcactagtggtaaggttgaagtctttgctaacgttactgaatcaaaaatccaagacatcaagatttatggtgacttctttggtattgaagacgttgctgcagtagaagatgtccttcgtggggtgaaatacgaacgcgaagatgttcttaaggcgctaaaaaccattgatatcacacgctacttcgctggtattagccgtgaagaaatcgctgaagcggtagttggataa

SEQ ID NO: 1175 - DNA, 1704 bp, Streptococcus pneumoniae
atggccttagaagtaattatgccaaaagccggcgtggatatgacagaaggacaaatcgtccaatggaataaaaaagtcggagaatttgtaaaagaaggagaaatccttttggaaatcatgactgataaagtcagcatggaattggaagccgaagaagatgggtacttgattgccattctcaaaggagatggtgaaactgtccctgtaacggaagttatcggttaccttggtgaagaaagggaaaacatcccaacagctggagcagcatcgccagaagctagccctgtacctgtagcaagtacctcaaacgatgatggtaatagcgatgatgcttttgatatcgttgtgattggtggaggtcctgctggttatgttgcagccattaaagctgcccaactcggcggtaaggttgcccttgttgagaaatctgaacttggtggaacctgcttaaaccgtggatgtattccaaccaagacctaccttcataacgctgaaattattgaaaatatcggtcatgctgcaaatcgtggtatcgtgattgaaaatcctaacttcactgttgatatggaaaaacttttagaaactaaatctaaagttgttaatactcttgttggtggtgttgcaggacttcttcgtagctacggagttactgttcataaaggaattggtacaatcactaaagacaagaacgtcttggtaaatggttctgaattgcttgaaaccaagaaaatcattcttgctggtggttcaaaagtcagcaagatcaacgtccctggtatggaatctccacttgtcatgactagtgatgacattcttgaaatgaacgaagtgccagaaagccttgttatcatcggtggtggagttgtcggtatcgaactcggtcaggccttcatgacatttggttcaaaagtgactgttatcgaaatgatggaccgtatagttccagctatggatgcggaagtttctaagaaccttcgcttgatccttgagcgtaaaggaatgaccatcttgactggtactaaactgcaagaaatcattgaggaaaatggtcaacttcgtatcaaggttgaaggaaaagacgatatcatcgcaagcaaagctcttctttcaattggtcgtatgccagaccttgaaggtattggagaggttgagtttgaattggatcgtggttgtatcaaggtcaacgaatacatggaaacttcagttccaggcatttatgcaccaggtgacatcaacggtactaagatgttggctcacgcagctttccgcatgggtgaagttgccgctgaaaatgcccttaaaggaaatcatgcagttgccaaattgaatttgactcctgcagccatctacactctccctgaagtagcagcagtaggtttgacagaagaacaagcccgtgagaaatacgatgttgccatcggtaagtttaactttgctgctaacggtcgtgctattgcatctgacgcagctcaaggtttcgtaaaagttatcgctgataagaaatgcggagaaatccttggtgtacacattattggtcctgcagccgcagaattaataaacgaagcatcaagcatcatcgaaatggaaatcactgttgaggaaatgctgaagaccatccacgggcacccaacttactctgaagtgatgtacgaagcgtttgcagatgttctaggaatggccatccattcacctaagaaaaaataa

SEQ ID NO: 1176 - DNA, 1128 bp, Streptococcus pneumoniae
ttggcttcatcgaagccatcgtcgatttcctatttttcagtcgcttttgacgccctttgtatcataaatagaattggagaggtcatggctgatgacaagctaagagcgactcctgcagctagaaagttagcagatgatttagggataaacctctacgacgtttctggctcaggtgcaaacggtcgtgtccacaaagaagacgtggaaacttataaagacacaaacgtggttcgcatttcgccacttgcaaaacgaattgccctcgaacataacattgcttggcaggaaatccaaggaaccggtcatcgtggtaaaatcatgaagaaggatgttttggccctgcttcctgaaaatatcgaaaacgatagcatcaaatctcctgctcagattgaaaaagtggaagaagtccctgataacgtaacaccatatggtgaaatcgagcgtattccaatgacaccaatgcgtaaggttattgcccaacgcatggttgaatcttacttgactgcgccaaccttcaccctcaactatgaagttgatatgactgaaatgttggctcttcgtaagagggttcttgagccaatcatggaagcaactgggaagaagactactgtaacagaccttctttcacttgcagttgttaagtctcttatgaaacatccatacatcaacgcttcattgacagaagatggcaagactattatcactcacaactatgtcaatcttgccatggcagttgggatggataatggattgatgacacctgttgtttacaatgctgagaagatgagtctttcagaactggttgtagcctttaaggatgttattggccgtaccttggatggtaaattggctccaagtgagttacaaaattcaacattcacaatcagtaatttgggaatgtttggtgttcagtcctttggcccgattattaaccaacccaactcagctatccttggtgtcagttcgacaatcgagaagccagttgtcgtcaatggtgaaattgtgattcgcccaatcatgagtttaggattaaccattgaccaccgtgtcgtagatggtatggctggtgctaagtttatgaaggacttgaaagagttgattgaaaccccaatctcaatgttgatttaa

SEQ ID NO: 1177 - DNA, 993 bp, Streptococcus pneumoniae
atggaaacaaaaacaatgtccttccgtgacaccattatccttgctatgtctgaggaaatgcgtcgcgatgaaaatgtgttcttgatgggagaagacgtcggtgtcttcggaggagacttcggtacttctgttggaatgcttgaagaatttggtccagaacgtgtccgtgactgtccgatttctgaagctgccatctctggagcagcagcaggagcagccatgacaggacttcgtccaatcgtcgatatgaccttcatggacttctctgttattgccatggacaatatcgtcaaccaagctgctaaaacacgttacatgtttggtggtaaaggtcaggttccaatgactgttcgttgtgcagctggtaacggagttggctctgccgcccagcactcacaatctctagagtcttggtttactcacattccaggacttaaggttgtggcacctggaacacctgcggacatgaaaggcctgcttaagtcttctatccgtgataacaacccagttattatacttgagtacaagtcagaatttaaccaaaaaggggaagtgccagttgatccagactacacaattccacttggggttggtgaaatcaaacgccaaggaacggatgtaacagttgttacttatggaaaaatgcttcgccgtgtggttcaagctgctgaagaattagcagaagaaggaatttcagttgaaattgttgacccacgtacccttgttccgcttgataaggatatcatcataaactcagtgaagaagactggtaaggttgttctggtcaacgatgcccacaaaacaagtggctatatcggtgaaatttcagctattatttcagaatcagaagcatttgactatctagatgcaccaattcgccgttgtgcaggagaagatgtgccgatgccttatgcacaaaacctagaaaatgcaatgattccaacagttgaaagtatcaaagatgcaatccgaaaaacttataacaaagaatag

SEQ ID NO: 1178 - DNA, 438 bp, Streptococcus pneumoniae
gtgctgggcggcagagccaactccgttaccagctgcacaacgaacagtcattggaacctgacctttaccaccaaacatgtaacgtgttttagcagcttggttgacgatattgtccatggcaataacagagaagtccatgaaggtcatatcgacgattggacgaagtcctgtcatggctgctcctgctgctgctccagagatggcagcttcagaaatcggacagtcacggacacgttctggaccaaattcttcaagcattccaacagaagtaccgaagtctcctccgaagacaccgacgtcttctcccatcaagaacacattttcatcgcgacgcatttcctcagacatagcaaggataatggtgtcacggaaggacattgtttttgtttccattttatctctttctccttagtctgcgtaaatatcttcaaaggctga

SEQ ID NO: 1179 - DNA, 312 bp, Streptococcus pneumoniae
ttgacgatattgtccatggcaataacagagaagtccatgaaggtcatatcgacgattggacgaagtcctgtcatggctgctcctgctgctgctccagagatggcagcttcagaaatcggacagtcacggacacgttctggaccaaattcttcaagcattccaacagaagtaccgaagtctcctccgaagacaccgacgtcttctcccatcaagaacacattttcatcgcgacgcatttcctcagacatagcaaggataatggtgtcacggaaggacattgtttttgtttccattttatctctttctccttag

SEQ ID NO: 1180 - DNA, 969 bp, Streptococcus pneumoniae
atgtcaactttagataaaaatcttttgctagaaatgttccgtaagatggaagaaatccgtcgcatggacttaaaaattgcacaattagtaaagaaagggaaagtgccaggaatgacgcacttttctgttggtgaagaggcagctaacgtgggggctatgttagctctcaatccagatgatctgattacctcaaaccaccgtggacacgggcaagctattgctaaagggattgacctcaacggaatgatggctgaaatccttggtaaatacactggaacctgtaaagggaaaggtggatctatgcatatcgctgaccttgatgctgggaaccttggtgccaatggtatcgtaggtggtggtatggggatcgctgtcggtgcagccctcagtcagcaaatgcaaaataccggtaaaatcgttgtttgcttctttggagatggtgcgaccaatgaaggtgttttccacgaagcagtgaacatggcttctatctggaacctgccagtcattttctattgcattaacaacggttacggtatctctgcggatatcaagaaaatgaccaatatagaacatatccatcaacgtagcgccgcttatggaattcctggaatgttcatcgaagacggtaacaatgtcatcgatgtctatgaaggatttcagaaagctgtagaccatgttcgcagtggcaatggtccagtcttgattgaaagtgtaacttatcgctggcttggtcactcatcatctgaccctggtaaatatcgtacgcgtgaagaagtggaattgtggaaacaaaaagatccaatcgaaaacctccgcaattaccttattgaaaataacattgcaagtgccgaagaattggaagaaatccaagcgcaagtaaaggaagcagtagaagcttctgttaaatttgcagaggaaagcccattcccatcgcttgaatcagcctttgaagatatttacgcagactaa

SEQ ID NO: 1181 - DNA, 1362 bp, Streptococcus pneumoniae
atgtataagacaaagtgtttacgagagaagttagtattatttttaaaaattttcttcccaatcctgatctaccaatttgccaattattctgcctcttttgttgatactgcaatgacaggtcaatacaacactatggacttggctggtgtatctatggcaaccagtatctggaatcctttctttacatttctaacagggattgtgtcagccttggtgcctatcattggtcaccatcttggtcgaggcaaaaaggaagaagttgcgtctgatttttaccaatttatttatttggccttgggcctatctgtggtcttgctggggatggtacttttcttggcaccaacaatcttgaatcatattgggttagaagcagcagtagcggcagtagcggttcgctatctttggtttttatctatcgggattatccccttgttgctctttagcgtcattcgttccttgctggattcgctgggcttgaccaaactgtccatgtacctcatgcttttgttactccctctcaatagcggatttaactatctcttgatttacggtgcctttggtgttccagaactgggaggggctggtgctggtttaggaacatccttggcctactgggtcttgcttgggatttctgttctggttttatttaaacaggagaagctcaaagccttacaccttgagaaacgaattccacttaatatggataaaattaaggaaggagttcgtttaggtctgcctattgggggaactgtcttcgcggaagtggctgtcttttcagtggttggcttgattatggctaagttttcgtccttgattatagctagtcaccagtcagctatgaacttttcaagtcttatgtacgcctttcctatgagtatctcatcggctatggctattgtcgtttcctatgaagtgggagccaagcgatttgatgatgcgaaaacctatattggtctaggaagatggactgccctcatttttgcggccttcaccttaaccttcctttacatttttaggggaaatgtggccagtctttatggtaacgacccaaaatttatcgatttgacagcgcgttttttaacttatagtcttttcttccagttagcagatacctttgcggcgccgcttcagggaattttgcgggggtataaggatacagttattcctttttaccttggtttgcttggttattggggcgtagcaatccctgtggctacgctatttgattccctaacagattttggagcttattcttactggatcggcttgattattagtttgattgtgagcggggcgctctaccgttggcgtttaactgtgattatgaagagatttgaatctttagcaaaatccaaacgctaa

SEQ ID NO: 1182 - DNA, 261 bp, Streptococcus pneumoniae
atgaattattttcgaaaacgtagggagagacaagcgaaatctaatagtggaatttactgtcccgcagctaatcgttccaaaattcaatatgaaactaaagaaaaagctgaccatgcggttcaatatgataacggaggtttagttagaagctattattgtcgtacatgtgcgtgttggcatactacttcaaaatctaataaacctccgctaagtttgaaaaactatggtctgaaactctttggtttagataaatcagaatag

SEQ ID NO: 1183 - DNA, 1269 bp, Streptococcus pneumoniae
atgctactaatcaaaaatggtcgtgtaatggatcctaagtctggtttggatcaagtttgtgatgtcttagttcaagatgggaaaattatcaaaattgcgcctgagatcacggaagaaggagcagaaacgattgatgctactggtcttgtggttgctcctggtttggtcgatattcatgtgcatttccgtgaacctggtcaaacacataaagaagacattcatactggtgccctggcagccgctgcaggtggttttactactgtcgtcatgatggctaataccagtccaaccatttcagacgtggagactttgcaagcagttctccagtcagctgccaaagagaagattaatgtcaagacagttgcgaccattactaaaaactttaatggtaaaaacttgactgactttaaggcgctcttagaagctggtgcggttggtttctctgatgacggtattccgcttgagagcagtaagattgtcaaggaagccatggaggaagccaaaaaactcaatacctttatcagccttcatgaggaagatccaggtttgaacggtgttcttggctttaatgaaaatattgctagagaacatttccatatctgcggtgctactggggtggctgagtacgctatgatggcgcgtgatgtcatgattgcctatgcaactaaagcccatgttcacatccagcatttgtctaaggaagaaagtgttaaagtagtggagtttgctcaggggttaggtgcagaagtcacagcagaagtagcgccacagcatttctctaagacagaagcacttcttttaacacaaggtagcaatgctaagatgaatccaccgcttcgtttggaatcagaccgtcgtgccgttatcgaaggtctcaaatcaggtgtcatcacagttattgcgactgaccacgcgcctcatcatgtagatgaaaaaaatgttgaggatattaccaaagcgccatctggtatgactggcttagaaacatccctgtctctcggcttgacctatttagtagaagctggtgagttgagcttgatggaattacttgaaaaaatgacatacaacccagccaagctttacaactttgaagcaggttacttggctgagaatggtccagcagatatcactatttttgatgccaaggctgaccgccttgtggactcccattttgcttccaaagcagctaattcaccattcatcggtgaaaccttaaaagggcaggttaaatataccatctgtaagggacaaatcgtctatcaagcttga

SEQ ID NO: 1184 - DNA, 465 bp, Streptococcus pneumoniae
atgcctcagttagcgacgatttgctacattgataatgggaaagaactgctcatgctccatcgtaataagaaacccaatgatgtccatgaagggaaatggattggtgtgggtggtaagctagagagaggagagacgccccaggaatgcgcggcgcgtgaaatccttgaagaaacagggctcaaagccaagccagttctaaaaggtgtcatcacttttcctgaatttacaccagatttagactggtacacctatgtttttaaggtgacggagtttgagggcgacttgattgactgcaatgaggggatgctagaatgggttccctatgatgaggttttgagcaagccgacttgggaaggtgaccacacctttgttgagtggcttttagaggataaacccttcttttcagccaagtttgtttatgatggggataaattgttggatacccaagttgatttctatgaataa

SEQ ID NO: 1185 - DNA, 666 bp, Streptococcus pneumoniae
atgaaggagtcagctatggaacactcgtcttggcatgctttgattaaggcgcaattacctgagggttatttcgggaaaatcaatcagtttatggagcaggtctattctcaggggattatttatccacccaaggaaaaggtttttcaggctctcttgacaacactgcttgaagaagttaaggtggtaattctagggcaagacccctatcacggaccaggtcaagcgcagggcttgagtttttctgtacctgactctatcccagctccaccatccttgcaaaatatcttgaaagaattgtcagatgatatcggagttaagaaatctcatgatttgacagcttgggctgagcaaggagtcttgcttcttaatgcttgtttgactgttcctgctggacaggccaatggtcatgctggtcaaatctgggagccttttactgatgctgtgattcaggtggtcaatcatctagatagaccagtcgtttttgtactctggggagcttatgcacgtaagaagaaggccttagttaccaatcctcatcacttgattatcgaatcagcccatccaagtcctttgtcggtttatagaggattttggggttccaagcccttttccaaggccaatgcattcttaaaagagacaggacaagagccaatcgcattggcttag

SEQ ID NO: 1186 - DNA, 603 bp, Streptococcus pneumoniae
atgtctgaagttgattttaatgaagctgttaattatgaatttacatctgacacttgtcaattagcaaatagtatttatcaatctctttttaagttttttgataagaaaaatttctctggcgatttaatttttacttggaaatctccatcattagtcaaagaaggggattatattgggaaaagggattcacaagtagataatcttagagtaataggaaatatatttccgaattatcttactaatcgaaaatatagcctcaatatgaatcgtaatggctgtatgggagattttcctcatgacttttttgatatatacctagatcatgtagcaaaatatgcctacgaacaaaaagttaataatattaaagagtattatcctttaaaaagagcgattttacaccaagagaatgcattgtattttcgatttttttctaattttgacgactttttagaaaaaaattatttaaagactatatggcaagtttctaaagaaactcctttttctgaaatggattttaatatgtttaaaaatatttcagaaaagataatcttcgaaagaggtagtaaaatgcttaatgatttaaaaagtaattataaaaaatag

SEQ ID NO: 1187 - DNA, 714 bp, Streptococcus pneumoniae
ttgttctacaaatttctactcttcgacctcgaccacactcttcttgattttgatgctgctgagaatgtggctttgacccaacttctaaaagaagaaggagttgcggatattcaggcttataaagattattacgttcctatgaacaaggctctctggaaagacttggagctgaagaaaatcagtaaacaagagctggttaacacgcgcttttctcgtttatttgctcattttggacaggaaaaagacggtagttttcttgcccagcgttaccaattttacctcgcccagcagggacaaacactatcgggcgctcatgatctcttggacagcctcattgagcgtgattataacttgtatgctgcgacaaatggcattactgccattcagacaggacgtttggctcaatctggtctagcaccttatttcaatcaagtctttatctcagaacagttgcaaactcaaaagccggatgctcttttttatgaaaagattggccagcaaattgctggatttagtaaagaaaagacgctgatgattggagattctctaaccgccgacattcaaggtggcaataatgcggggattgacactatctggtataatcctcatcacctcgaaaatcacacacaagcccagccgacttacgaagtctattcttaccaagacttgctggattgtttagataaaaatattcttgaaaagatcacattttaa

SEQ ID NO: 1188 - DNA, 228 bp, Streptococcus pneumoniae
ttgatggaaagtattggtcttgttatcgtttcacattccaaacacattgcagaaggtgttgttgaactaattagtaaagtagctaaagatgttccgattacttatgtaggaggaaccgagggcggaggaattggaacgagttttgatcaagtagatagggttgtttccgaaaatccagcagatactttacttgccttttttgacctaggttctgctataaaatgttaa

SEQ ID NO: 1189 - DNA, 2556 bp, Streptococcus pneumoniae
gtgcatcaaatatccttaagaaaaaaggaaagaatgaaaatcaataaaaaatatctagctgggtcagtagcaacacttgttttaagtgtctgtgcttatgaactaggtttgcatcaagctcaaactgtaaaagaaaataatcgtgtttcctatatagatggaaaacaagcgacgcaaaaaacggagaatttgactcctgatgaggttagcaagcgtgaaggaatcaacgccgaacaaatcgtcatcaagattacggatcaaggttatgtgacctctcatggagaccattatcattactataatggcaaggtcccttatgatgccatcatcagtgaagagctcctcatgaaagatccgaattatcagttgaaggattcagacattgtcaatgaaatcaagggtggttatgtcattaaggtaaacggtaaatactatgtttaccttaaggatgcagctcatgcggataatgtccgtacaaaagaagaaatcaatcggcaaaaacaagaacatagtcagcatcgtgaaggagggacttcagcaaacgatggtgcggtagcctttgcacgttcacagggacgctacaccacagatgatggttatatcttcaatgcatctgatatcatcgaagatacgggcgatgcctatatcgttcctcatggagatcattaccattacattcctaagaatgagttatcagctagcgagttggctgctgcagaagccttcctatctggtcgggaaaatctgtcaaatttaagaacctatcgccgacaaaatagcgataacactccaagaacaaactgggtaccttctgtaagcaatccaggaactacaaatactaacacaagcaacaacagcaacactaacagtcaagcaagtcaaagtaatgacattgatagtctcttgaaacagctctacaaactgcctttgagtcaacgccatgtagaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaagaaccaagtccacaaccgactccagaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaagaatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtctcaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccacaaagcgagaaaccagagtctccaaaaccaacagaggaaccagaagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaagtaa

SEQ ID NO: 1190 - DNA, 2490 bp, Streptococcus pneumoniae
ttgcaactagaaatatcaaatagaaagagagtttcgatgaaaattaataagaaataccttgttggttctgcggcagctttgattttaagtgtttgttcttacgagttgggactgtatcaagctagaacggttaaggaaaataatcgtgtttcctatatagatggaaaacaagcgacgcaaaaaacggagaatttgactcctgatgaggttagcaagcgtgaaggaatcaatgctgagcaaatcgtcatcaagataacagaccaaggctatgtcacttcacatggcgaccactatcattattacaatggtaaggttccttatgatgcgattttcagtgaagaattactcatgaaagatccaaactataagctaaaagatgaggatattgttaatgaggtcaagggtggatatgttatcaaggtagatggaaaatactatgtttaccttaaggatgctgcccacgcggataacgtccgtacaaaagaggaaatcaatcgacaaaaacaagaacatagtcaacatcgtgaaggtgggactccaagaaacgatggtgctgttgcctttgcacgttcgcaaggacgctatactacagatgatggttatatctttaatgcttctgatatcatagaggatactggtgatgcttatatcgttcctcatggagatcattaccattacattcctaagaatgagttatcagctagcgagttggctgctgcagaagccttcctatctggtcggggaaatctgtcaaattcaagaacctatcgccgacaaaatagcgataacacttcaagaacaaactgggtaccttctgtaagcaatccaggaactacaaatactaacacaagcaacaacagcaacactaacagtcaagcaagtcaaagtaatgaggatgttgatagccttctgaaacaactttatgccttgccactcagcaaacgacacgtagaatctgatggccttgtctttgatccagcacaaatcacaagtcgaacagctagaggtgttgcagtgccacacggagatcattaccacttcatcccttactctcaaatgtctgaattggaagaacgaatcgctcgtattattccccttcgttatcgttcaaaccattgggtaccggattcaagactagaacaaccaagtctacaaccgactccggaacctagtccaggcccgcaacctgcaccaaatcttaaaatagactcaaattcttctttggttagtcagctggtacgaaaagttggggaaggatatgtattcgaagaaaagggcatctctcgttatgtctttgcgaaagatttaccatctgaaactgttaaaaatcttgaaagcaagttatcaaaacaagagagtgtttcacacactttaactgctaaaaaagaaaatgttgctcctcgtgaccaagaattttatgataaagcatataatctgttaactgaggctcataaagccttgtttgaaaataagggtcgtaattctgatttccaagccttagacaaattattagaacgcttgaatgatgaatcgactaataaagaaaaattggtagatgatttattggcattcctagcaccaattacccatccagagcgacttggcaagccaaattctcaaattgagtatactgaagacgaagttcgtattgctcaattagctgataagtatacaacgtcagatggttacatttttgatgaacatgatataatcagtgatgaaggagatgcatatgtaacgcctcatatgggccatagtcactggattggaaaagacagcctttctgataaggaaaaagttgcagctcaagcctatactaaagaaaaaggtatcctacctccatctccagacgcagatgttaaagcaaatccaactggagatagtgcagcagctatttacaatcgtgtgaaaggggaaaaacgaattccactcgttcgacttccatatatggttgagcatacagttgaggttaaaaacggtaatttgattattcctcataaggatcattaccataatattaaatttgcttggtttgatgatcacacatacaaagctccaaatggctataccttggaagatttgtttgcgacgattaagtactacgtagaacaccctgacgaacgtccacattctaatgatggatggggcaatgccagtgagcatgtgttaggcaagaaagaccacagtgaagatccaaataagaacttcagagcggatgaagagccagtagaggaaacacctgctgagccagaagtccctcaagtagagactgaaaaagtagaagcccaactcaaagaagcagaagttttgcttgcgaaagtaacggattctagtctgaaagccaatgcaacagaaactctagctggtttacgaaataatttgactcttcaaattatggataacaatagtatcatggcagaagcagaaaaattacttgcgttgttaaaaggaagtaatccttcattgttatgtaaggtcaaacttatctaa

SEQ ID NO: 1191 - DNA, 1140 bp, Streptococcus pneumoniae
atgacagaaatgcttaaaggaatcgcagcatctgacggtgttgcagttgcaaaagcatatctactcgttcagccggatttgtcatttgagactattacagtcgaagatacaaacgcagaagaagctcgccttgatgccgctctacaggcatcacaagacgagctttctgttattcgcgagaaagcagtaggtacgctcggtgaagaagcagctcaagtttttgatgctcacttaatggttcttgctgacccagaaatgatcagccaaatcaaggaaactatccgtgcgaagaaagtgaatgcagaagcaggtctgaaagaagttacagatatgtttatcactatctttgaaggcatggaagacaacccatacatgcaagaacgcgcagcggatatccgcgatgtgacaaaacgtgtattggcaaaccttcttggtaaaaaattgccaaacccagcttctatcaatgaagaagtgattgtgattgcacatgacttgacaccatctgatacagctcaattggacaaaaactttgtaaaagcttttgtaaccaacatcggtggacgtacaagccactcagctatcatggcacgtacacttgaaattgcagctgtattaggtacaaacaacatcactgaaatcgttaaagacggtgacatccttgctgttaacgggatcactggtgaggttattatcaacccaactgatgaacaagcggcagaatttaaagcagctggtgaagcttatgcgaaacaaaaagctgaatgggcgctcttgaaagatgctcaaacagtgactgctgacggtaaacacttcgagttggctgctaatatcggtactccaaaagacgttgaaggtgttaacaacaacggtgcagaagctgttggactttaccgtacagagttcttgtacatggattctcaagacttcccaactgaagatgagcagtatgaagcatacaaggctgttcttgaaggaatgaacggtaaacctgttgtcgttcgtacaatggatatcggtggagataaggaacttccttacttcgatatgcctcacgaaatgaacccattccttggattccgtgctcttcgtatctctatctctgagactggagatgctatgttccgcacacaaatccgtgct

SEQ ID NO: 1192 - DNA, 138 bp, Streptococcus pneumoniae
tcagcaccttggccaacaccaagactcataacacccataattgatttaaggttaactgatttacctttgtactcaagagtgatatctgaagcaaatttgctagcagtttgtaccaacaatgttgctggacgtgcgtga

SEQ ID NO: 1193 - DNA, 264 bp, Streptococcus pneumoniae
atggcttctaaagatttccacgtagtggcagaaacaggtattcacgcacgtccagcaacattgttggtacaaactgctagcaaatttgcttcagatatcactcttgagtacaaaggtaaatcagttaaccttaaatcaattatgggtgttatgagtcttggtgttggccaaggtgctgacgtaactatctcagctgaaggtgcagatgcagatgacgctatcgctgcaatctcagaaacaatggaaaaagaaggattggcataa

SEQ ID NO: 1194 - DNA, 219 bp, Streptococcus pneumoniae
atggtaaccgtttattctaaaaacaattgtgtccaatgtaaaatgaccaagcgtttcttggacagtaataatgtctcttatcgtgaaatcaatcttgatgagcaacctgagtacgtcgatcaagttaaagagctcggttttagcgcagctcctgttatccaaacaccaactgaagtcttttcaggtttccaaccaggaaaactgaaacaattagcataa

SEQ ID NO: 1195 - DNA, 2160 bp, Streptococcus pneumoniae
atgggattaaaacatcttgaagacgtgacttacttccgtcttaataacgaaattaaccgtcctgttaatggacaaatcatgcttcataaagataaggaagccttggatgctttctttaaagaaaatgtagttccaaacactatggtttttgattcaatcaaagacaaaatcaattacctcattgaacacaactacatcgaaacagcctttatcaagaaataccgtccagagttcttggaagaattggctcaatttatcaaagaccaaaacttccaattcaagtcattcatggcagcttataaattttacaatcaatatgccttaaagactaatgacggtgaatactatcttgaaaatatggaagaccgtgtcttcttcaacgccctttatttcgctgatgggaatgaagctgttgcaatcgatattgccaatgaaatcatccaccaacgctaccaacctgctactccttccttcttgaatgctggacgtgctcgtcgtggggagttggtatcttgtttcctaatccaagtgacggatgatatgaactctatcggacgttctatcaactcagctcttcaactttcacgtattggtggtggtgtgggaattaccctcagcaaccttcgtgaagctggtgcacctatcaaaggctatgaaggagctgcttcaggtgtcgttcctgttatgaagctttttgaagacagcttctcttactccaaccaattggggcaacgtcaaggtgctggtgttgtctacctcaacgtctttcacccagatatcatcgctttcctttcaactaagaaagaaaacgctgatgaaaaagtacgtgtcaagactctgtcacttggtgttgtagtacctgataaattctacgaattggctcgtaaaaatgaagaaatgtacctcttcagcccttactctgtagaaaaagaatacggtgtgccattcaattacatcgacattactgaaaaatacgatgaattggtcgcaaatccaaatattcgcaagacaaaaatcaaggcgcgggatttggaaactgaaatctctaaattgcaacaagagtctggctatccttatgtagtcaacatcgatacggctaaccgtgcaaatcctgttgatggaaagattatcatgagtaacttgtgctctgagattcttcaagttcaagaaccaagcttgatcaacgatgctcaagaattccttcaaatgggaacagatgtttcatgtaacctgggttcaaccaacgtggttaacatgatgacttcacctgattttggtcgttctatccgtgctatggttcgtgcccttactttcgttacagatagttcacatatcgtagctgtaccaacgattgaccatggaaatagccaagcccacacctttggtctcggtgccatgggactgcacagctaccttgcccaacaactcattgaatatggttcacctgagtctgttgaatttacaagcatctactttatgcttatgaactactggaccttggtagagtcaaacaatattgcgcgtgaacgtggtattaccttccacaactttgaaaaatcagactatgctaacggaagttactttgacaagtatgtaactggtgaatttgttccaacatcagaccgtgttaaagaactcttcaaaaatgtttttatccctggtgttgctgattgggctgaacttcgcgacaaggttcaagaagatggtctttaccaccaaaatcgccttgctgtagcgccaaatggttctatcagctatatcaacgacgtttctgcttctatccacccgattacgcaacgtatcgaagaacgccaagagaagaaaattggtaaaatctactaccctgctgctggcttgtctacagaaaccattccttactacacttctgcctacgatatggatatgcgtaaagtcatcgatgtttacgctgctgcgactgaacacgtggatcaaggactttcactcaccctcttcatgcgtagtgacattccaaaaggcctttacgaatggaagagggaaaataaacaaacgacacgtgacttgtccatccttcgtaactatgcctttaacaagggaatcaagtctatctactacgtccgtacctttacagatgacggtggagaagtcggcgccaaccaatgtgaaagctgtgtgatttag

SEQ ID NO: 1196 - DNA, 189 bp, Streptococcus pneumoniae
tttgtcgatgacatcttcgatggcattccagttaatggctttgtagtaagtttccatttaaaatctctttctgtgtttagtattgcgaactcacaattatttctactttaccataattctataggagtatcgcacaaaaagtcggaagcccgacttttaaaatgttacataaattatgttatgacatag

SEQ ID NO: 1197 - DNA, 963 bp, Streptococcus pneumoniae
atggaaacttactacaaagccattaactggaatgccatcgaagatgtcatcgacaaatcaacttgggaaaaactgacggagcaattttggctcgatacacgtattcccttatcaaacgacttggatgactggagaaagctatctaacaaagagaaagacttggtcggaaaagtttttggtggtttaacccttcttgacactatgcaatctgaaactggggttcaagcccttcgcgcagacatccgtacaccacatgaggaagctgttttcaataacatccaatttatggaatctgtccacgctaaatcttactcatcaatcttttctaccttgaatactaaggctgagattgaagaaattttcgaatggaccaataccaatccttacctacaaaagaaggctgagattgtcaacgaaatctacctaaacggcagcccacttgaaaagaaagttgccagcgtcttcctcgaaaccttcctcttctactctggtttcttcactcccctctactatctcggtaacaacaaactagccaacgttgcagaaatcattaaattgattattcgtgacgagtctgttcacggaacctacattggttacaaattccaacttggtttcaatgaattgcctgaagaagagcaagaaaaactcaaagaatggatgtacgacctactctatactctttatgaaaatgaagaaggctacacagagagtctttatgacggtgttggttggactgaagaggttaaaaccttccttcgctacaatgccaataaagctctcatgaacatgggacaagatccacttttcccagattcagctgaagatgtcaacccaatcgttatgaacggtatttcaacaggaacttccaaccatgacttcttctctcaagtcggaaatggttaccttcttggcgaagttgaagccatgcaagacgatgactataactacggtttagactaa

SEQ ID NO: 1198 - DNA, 762 bp, Streptococcus pneumoniae
atgctcaaacaagaaaaattaaccaaaattttagagatagtaaatagtaaaggaaccataacagttaaacagattatggacgaaatagccgtttcagatatgactgcaaggcgctatttacaggaattagctgataaagatttgctgattcgtgtgcatggtggagctgaaaaacttcgaaccaactcccttttgactaatgagcgatcaaatattgaaaaacaagccctccaaacggcagaaaaacaagaaatagcccattttgcaggcagtctagtagaagaaagagaaactattttcattggaccaggaacaacattagagttttttgcgcgtgagttgcctattgacaatatccgcgtcgtaaccaacagtctacctgtttttctgattttaagcgaacgaaaattaacagatttgattttaataggtggaaattatcgcgatattacaggtgcttttgttggtacattgaccctacaaaatctctctaatctccaattttctaaagctttcgttagctgtaatggtattcaaaacggagctctagctacttttagcgaggaagagggagaggctcaacgcatcgctttaaataattctaataaaaaatatttactcgcagatcatagtaagttcaataagtttgatttttatactttttataatatatcaaatcttgatactattgtttcagattctaaactaagtgattcaatcctttttaagctatctaaacacattaaagtcatcaagccttaa

SEQ ID NO: 1199 - DNA, 252 bp, Streptococcus pneumoniae
atgttcaaagattttatccaatctatttatgaaaaagtttatattataaatttcgaaaaatgctctcaaataccgtgtttgacgagtgaagaattgaaaagtcttggaaaatggtatgtctcgactggtaaagaatggatttgtcattcagatgctgatctggaagaatttaaaaatctatttttaaattttatcaatcctgaagaatgggatactatctcctttgattcagattttatgccgtttcaataa

SEQ ID NO: 1200 - DNA, 1416 bp, Streptococcus pneumoniae
gtgaaaaaaatgacaaaaacacttccaaaagactttattttcggtggcgcaacagctgcttatcaagcagaaggtgctacacatactgatggaaaaggaccagttgcttgggataaatatcttgaggataactactggtacactgccgaaccagctagtgatttttacaatcgatatccagttgacctcaagctagcagaagagtatggtgtcaatggtattcgaatttctattgcttggtcacgtattttcccgactggttacggccaagtaaatgctaaaggtgttgagttttatcataatttatttgcagagtgtcacaaacgtcatgttgagccttttgtaactcttcatcactttgacactccagaagctctccactcaaatggagacttcttaaaccgtgaaaatatcgaacattttgtagactacgctgccttctgttttgaagaatttccagaagtaaactattggacaacctttaatgaaattggaccaatcggtgatggtcaatatttggttgggaaattccctccaggtatccagtacgaccttgccaaagtctttcaatcacaccacaatatgatggtgtctcatgcacgcgcggtaaaattgtacaaagagaaaggctataaaggggaaattggtgttgttcacgccctgcctactaaatatcctctagatcctgaaaatccagcagatgttcgtgcagctgagttggaagatatcatccacaataaattcatcttagacgcaacttatctaggtcgctattcagctgaaaccatggaaggtgtcaaccatatcttattagtcaatggtggtagtttggatcttcgtgaagaagattttacagcattagaagctgcaaaagacttgaatgatttcctaggaatcaactactatatgagtgactggatggaagcctttgatggagaaactgaaattatccataatggtaaaggtgaaaaaggaagctctaagtatcaaatcaaaggtgttggtcgtcgtgtagctcctgactatgtaccacgcacggattgggattggattatctaccctcaaggtttgtatgaccaaatcatgcgcgtgaagaaagattatcctaactataagaaaatctacatcactgaaaatggtcttggatataaagatgagttcgttgataacactgtttacgatgatggtcgtattgattacgtgaaacaacacttggagatcttgtctgatgcgattgcagatggagctaatgtaaaaggttacttcatttggtcattaatggatgtcttctcatggtcaaacggttatgagaaacgttatggtctcttctacgtagattttgaaactcaagaacgttatcctaagaaatcagctcactggtacaagaaagtagcggaaactcagattatagactag

SEQ ID NO: 1201 - DNA, 1695 bp, Streptococcus pneumoniae
atggataagttaataatttttattgagaaaggaaagcctttctttgaaaaattatcgagaaatatatacttaagagcgataaaagatggttttatttccagtatgccagcagtattattctcaagtatttttatactaatagctgctgtgcccaatatttttgggtttaaatggtctgatgaacagttagcttttattttgaaaccttacaactactcaatgggaattttagctctcttagtagctgggacaactgcaaaatcgttaacagattcagttaatacacgtagtatggagaaaaccaaccaaatcaactacatgtcaacttttttagcagctgttgttggattgttaatactggcagctgatccaattgaaggtggatttgctaatggtcttttaggtactagaggattacttactgcatttttggcagcttttattacagtaaatatctataaagtatgtattaaaaataatgtaaccattagacttcctgaagaggttccaccaaatattgcacaagtttttaaagatgttattccgtttgccttatctgttctttcaatatatggattggatttaattgttagaaatatttttggtacaaatgtagcagaatctgttggtaaaatattagcccctctattttcagctactgatggttatatcggtttagctattgtatttggtgcttatgctttcttttggtttgttggaattcatgggccatctgttgtagaacctttaattgtagctatcagttatgcaaatatagaagctaatgttcagcttgtgcaagctggtatgcacgcagataaaattttaaatccagttactcaaacttttgttgtaacaatgggtggtactggtgcaacactagtagttccatttatgtttatgtggttatgtaaatcaaaaagaaatagaattgtcggacgtgcgtctgtagttcctactttctttggcgtaaatgaaccaatcctatttggtgctccaattgttttaaatcctatcttctttattccgtttgttactgctcctattatcaatgtttggattatgaaattttttgtagatgttctacaaatgaatagtttcagtattattttaccttggacaacacctgctccaattggtattgttatgggaacggcgctggctccattgtcattcgtcttggctataactttaatcattatcgacactttaatctattatccatttgttaaagtttatgaccatcaaattttagaagaagaacggaaaggaaactcttcatctgaattgaaagaaaaagttgctgcaaacttcaacactgtaaaagcggatgctattcttgaaaaagcgggtgtcgatgcagcacaaaataccatcactgaagaaacaaatgtcctcgttctctgtgctggtggaggtacaagtggactccttgcaaatgctttgaataaggcagcagcagaatacaatgtccctgtgaaagcaacagcaggcggctatggtgctcaccgtgaaatgttgccagagtttgatttggttatccttgctcctcaagttgcttcaaactttgaagatatgaaggcagaaacagataagctcggtattaaacttgctaagacagaaggcgctcaatacatcaaattaactcgtgatggaaaaggtgccctagcattcgtacaagagcaattcgattaa

SEQ ID NO: 1202 - DNA, 318 bp, Streptococcus pneumoniae
atgaatagagaagaagtaacattgttaggttttgaaatcgtagcctatgctggcgatgctcgttcaaaactattggaagccttgaaggctgctgaagctggtgattttgaaaaagcggacgctctggtagaggaagctggtagctgtattgcagaggctcaccacgcgcaaacaagtctattgactaaggaagcttctggtgaggacttagcgtatagtgtgaccatgatgcatggtcaagatcacttgatgacaactatcttgttaaaagacctaatgcaccatttaattgaactttacaagagaggagttaaataa

SEQ ID NO: 1203 - DNA, 837 bp, Streptococcus pneumoniae
atgtatcgaattctaaatccaatgaatcacaatgtctcgcttgtcagaaatgataagggagaagaggtgattgtaattggtaaggggattgcattcggaaagaagaagggggatttgattgctgaaaatcaggttgagaaaatctttcggatgaagaccgaagagtccagagaaaactttatggctcttctcaaagatgttccgcttgattttatcacagtgacctatgaaatcattgataagctatcaaagaaatatcattatccgattcaagagtatctctatgtaaccttgacagatcatatttactgttcttatcaagctctaactcaaggaaggtacaaggatagtaatctgccagatatttccgctaagtatcctgtcgcttttcaaatcgcaaatgaagcttttgaaatttaccgtcagaagctagcagatcattttcctgaggacgaaattattcggattgcttatcatttcattaatgctgaaggtgaaaatgaagtggaacttgtggagtcgattgataagaggaaagaaattctcaggaatgttgaagaagttttaacggactatgcaattcaacgaactaaaaagaataaccatttctatgatcgctttatgatccatttgaattatttcttggattatttagacagatctagagatgataaccaatcacttctggatatggaagatcatattaaacaatcctatccaaaagccttcgagattggttccaagatctatgatgtgattacgcaacatacgggtcttgatttgtataaaagtgaacgagtttatctagttctacatatccaacgtttattgtcataa

SEQ ID NO: 1204 - DNA, 810 bp, Streptococcus pneumoniae
atggaattgactaaatacccttcatctatgcttcttgaccctgagtatggacttccagcaactaaagctcttgatgaaaaagctggtcttctccttgcttatgaaaaaacaggttatgacacaacaagcacaaaacgcttgccagactgcttggatgtttggtctgcaaaacgtattaaagaagaaggtgcagatgcagttaaattcttgctttactatgatgtagatagctcagacgaactcaatcaagaaaaacaagcctacatcgaacgcatcggttctgagtgtgtggctgaagatatcccattcttccttgaaatccttgcttacgatgaaaaaattgcggatgcaggttctgtagaatacgcgaaagtaaaaccacacaaagttatcggcgctatgaaagtcttttcagacccacgctttaacattgatgtcttgaaagttgaagttcctgttaacattaaatatgttgaaggcttcgctgaaggtgaagtagtttatacacgtgaagaagcagcagccttcttcaaagcgcaagatgaagcaacgaacttgccatacatctacttgagtgctggtgtatcagctaaactcttccaagatactcttgtatttgctcatgaatcaggtgcaaactttaacggagttctttgtggccgtgctacatgggcagggtcagttgaagcttacatcaaagatggtgaagcagcagctcgcgaatggcttcgcacaactggatttgaaaacattgatgagctcaataaagttcttcaaacaacagcgacttcatggaaagaacgtgtgtaa

SEQ ID NO: 1205 - DNA, 810 bp, Streptococcus pneumoniae
aatgttacccgagtactttcagaatttggtgattctgttcttgctactggtttagtgggtggcaaacttggtgagtttttggttgaacatatcgatgatcaagtaaagaaagatttcttttctattcagggagaaactcgtaactgtatcgctattctccacggtgacaaccaaacagaagttcttgaaaaaggtcctgaagtattggaacaggaaggtcaagactttttggaacatttcaaaaaactcttggagtcagttgaagtagtagccatctcaggtagtctgccagctggccttccagttgattactatgcgagcttggtagagcttgctaatcaagctggcaagctagtagtcttggactgctctggtgcagcacttcaggcggttcttgaatcaccccataaaccgacagtaatcaaacccaataatgaggaattgtctcagcttctaggaagagaagtttctgaggatttggaggaattaaaagaagtccttcaagaatctttgtttacagggattgaatggattatcgtttcacttggtgccaacggtacttttgccaaacatggtgacactttctacaaggtagatattcctagaattcaggtggtaaatcctgttggatctggagactctactgtggcaggaatttcttcaggacttcttcacaaagaatcggatgcaggattactcatcaaggcaaatgtccttggtatgctcaatgctcaagaaaaaatgactggtcatgtcaacatggccaactatcaagctctatatgatcaattaatagtaaaagaggtataa

SEQ ID NO: 1206 - DNA, 489 bp, Streptococcus pneumoniae
atggatgggttcattgtgactgttaaaatcataggtcacctcttagtcgtggtattctccgcgatcccatttttcaaggaattctgtaaagaagtttgcgtctgtttgttgagcattgtgactttcaaggtgttcaattttcgcaatcaatttcttgttttcttcagatggtttgtattcagcatgaatgaaagcttcgatgatatcacacataagcaattcaccagtaatcttaccaccaaagccgataacgttagcgttcaattgctctttagcataaagggctgttgtcatatcacgaaccaaggcagaacgaacacctggaactttatttacagcgttgttgataccaacaccagtaccacagatacataccccaagatcagcttggccgctagttacagcttcccctacttttttaccaaagattgggtagtgagtccgtgtatggtcatatgtaccaaagtcaatgacttcatatccttttga

SEQ ID NO: 1207 - DNA, 516 bp, Streptococcus pneumoniae
atgagaattgcaattggatgcgaccacatcgtaacagatgaaaaaatggcggtttcagaatttttgaaatcaaaaggatatgaagtcattgactttggtacatatgaccatacacggactcactacccaatctttggtaaaaaagtaggggaagctgtaactagcggccaagctgatcttggggtatgtatctgtggtactggtgttggtatcaacaacgctgtaaataaagttccaggtgttcgttctgccttggttcgtgatatgacaacagccctttatgctaaagagcaattgaacgctaacgttatcggctttggtggtaagattactggtgaattgcttatgtgtgatatcatcgaagctttcattcatgctgaatacaaaccatctgaagaaaacaagaaattgattgcgaaaattgaacaccttgaaagtcacaatgctcaacaaacagacgcaaacttctttacagaattccttgaaaaatgggatcgcggagaataccacgactaa

SEQ ID NO: 1208 - DNA, 426 bp, Streptococcus pneumoniae
atgtctattgttatcggtgcagatgctgcaggtttgagattgaaagaagttgtgaaagacttcttagaaaaagaaaacttccaccttgtggatgttacagctgaaggtcaagactttgttgatgtgactctcgctgttgctgcagaagtaaacaaagaagaacaaaaccttggtatcgtgattgatgcttatggagctggtccatttatggttgcaactaagatcaaaggaatggttgctgcagaagtatctgacgaacgttcagcttatatgactcgtggccacaacaactcacgtatgatcactatgggggcacaacttgttggtgatgaattggctaaaaacatcgctaaaggatttgttaatggtaaatacgacggtggacgtcatcaaatccgggttgacatgttgaacaaaatgggctaa

SEQ ID NO: 1209 - DNA, 291 bp, Streptococcus pneumoniae
acatattgtatactcctttttattttttctatgctggattccagcagtgtattggctgtctttaaaaaacagtcaattagtcctcacaaacataatatactactattgtttgaagaagtcaatagtttgtgtttgtttttgttatttattttttacttttttataaaacttctatctcaaaccctaattcttcaacctgattggcttctaagagacaaacattcttcttatcttctaaatgatctccttcttcaaggaatgttgacaagccagaccatggttcaaaggtaa

SEQ ID NO: 1210 - DNA, 477 bp, Streptococcus pneumoniae
atgccttactttattggtggacatccaggatttaattgtcctctacttgatgatggagtctatgaagattattatctagagtctgagaaagaagagacttgctctgttccacgtcctttcccagaaacaggtatgttggatttccaagatagaagtccatggctagagggacaaaaagaaatagatcttagttatgatcttttcagcacagatgcagtgactttggatgaattgcaatctcgaacaattgcccttcgttctcttaaacatgataagggattgaaagtgcattttgcagaatttccaaacctcatcatctggtcaactttgaacaagggacctttcattacctttgaaccatggtctggcttgtcaacattccttgaagaaggagatcatttagaagataagaagaatgtttgtctcttagaagccaatcaggttgaagaattagggtttgagatagaagttttataa

SEQ ID NO: 1211 - DNA, 621 bp, Streptococcus pneumoniae
  unsure (116): n at each above location is unknown.
gtgcgagaatatcgaacttatgaacaaattgcggctgattttggtattcacgaaagcaactttatccgtcggagccaatgggttgaagtaactcttgttcaaagtggtgttacgtntcaagcactcctctcagctctgaggacacggtatgatatgatgcgacggaagtacaaatcaatcgccataaaaaaagaattagcgaatgattctggtaaaaagaaatgccacgctatgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaaggactcatgaagatatatcctcaagtacaaactccacgtaaatccagcaaactcaagtcgctaatagctgaagataaagcctataaccatgcgctatctaaggagagaagcaaggttgagaacatctttgccaaagtaaaaacgtttaaaatgttttcaacaacctatcgaaatcatcgtaaacgcttcggattacgaatgaatttgagtgctggtattatcaatcatgaactaggattctag

SEQ ID NO: 1212 - DNA, 321 bp, Streptococcus pneumoniae
ttgacaatattatacttcctgcgaaacaaaatatggtatagtagttctatgaatgatgaagcaagtaaacaactaactgatgcacgatttaagcgtcttgttggtgttcagcgtaccacttttgaagagatgttagctgtattaaaaacagcttatcaacttaaacacgcaaaaggtggacgaaaacctaaattaagcctagaagaccttcttatggccactcttcatatgtgcgagaatatcgaacttatgaacaaattgcggctgattttggtattcacgaaagcaactttatccgtcggagccaatgggttgaagtaa

SEQ ID NO: 1213 - DNA, 303 bp, Streptococcus pneumoniae
atgattaaaattcttgctgcctgcggtgcaggtgttaactcaagtcaccaaattaaaagtgctctagaagaagaactttcaaaccgtggttatgatgttcactgtgatgcagtcatggtgaaagatgtaaacgaagaccttatgaaaggttacgatatctttacaccaatcgctgcaacagaccttggttttgaaccaggtatcccagttatcgaagctggtccaatcttattctgtatcccagcaatgagcgttccagtatttgacaatattatacttcctgcgaaacaaaatatggtatag

SEQ ID NO: 1214 - DNA, 444 bp, Streptococcus pneumoniae
gtgttttgcttagaagcggataatcaagaacaactctttgatcaggtagcaagcttgttggaagaacgagaaattgtcactcctacttatcgtgaagccttgatcacgcgtgaaaagtcatttccaactggtttagatatggaatttctaggaaaggacttgccaaatgtagcgattcctcacacagatattgttcacaatctggctgaaaaagttgtggtcgttcgattagagaaaccggtgactttccataatatgattgcgccaggtaaggaagtagaagtatccttgctcttctttatcatcaataattcaagttcaagtcaaacaaatattctggctcagttgatggactttttcacaggaaatggtcatcttgaagacctatcaaaaatttctgaaccagaaaaactttatgcttacattgctgaagcaaccgcttaa

SEQ ID NO: 1215 - DNA, 1293 bp, Streptococcus pneumoniae
atgaaaagcgacaaaaccatcattagaaagattcatatggaacaattacattttatcacaaaactgctcgatattaaagacccaaacatcaagattctagatatcatcaatatggatacccacaaagaaattatcgctaagctggattatgaggctccatcttgccctgattgtggaagtctaatgaagaaatatgactttcaaaaaccgtctaagatcccttacctcgaaacaactggtatgccttctagaattctccttagaaaacgccgtttcaagtgctatcactgttcaaaaatgatggttgctgagactcccctggtaaagaaaaatcaccaaatccctcgtatcatcaaccaaaaaattgctcaaaagttaattgaaaaaatttctatgactgatattgcccatcagctggccatttcaacttcaactgtcattcgcaagctcaatgactttcactttgagcatgatttttctcggcttccaaagattatgtcttgggatgagtatgccttcactaagggaaagatgagtttcattgcgcaagattttgataatcttaatattatcactgttcttgaaggcagaacacaagctgtcatccgaaatcactttcttcgctacgatagagccgttcgttgtcaagtgaaaatcattacgatggatatgtttagtccttactatgacttggctaaacagctttttccgtgtgctaaaatcgttctagatcgtttccatattatccaacatctcagccgtgccatgagtcgttttcgtgttcaaattatgaatcagtttgaacgaaaatctcatgaatacaaggctatcaaacgttactggaaactcatccaacaggatagtcgtaaattgagcgataaacgtttttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacactctgaagcaggttcatcctatttttcagactgtctttaaaacctttctaaagaacaaagaaaaaatcgtcaacgctcttcaattaccttattccaacgcaaaattggaagcgaccaataatctcatcaaacttatcaaacgaaacgcctttggatttcggaactttgaaaacttcaaaaaaaggatttttatcgctctgaacatcaaaaaagaaaggacgaattttgtcctttctcgagcttag

SEQ ID NO: 1216 - DNA, 189 bp, Streptococcus pneumoniae
ttggctcagatttccatccttcattttgatttcctatctattgacaagcatagtcacactgtctttaatactcttcgaaaatctcttcaaaccacgttagctctatctgcaacctcaaaacagtgttttgagcaacttgcggctagcttcctagtttgctctttgattttcattgagtataaggtatga

SEQ ID NO: 1217 - DNA, 1251 bp, Streptococcus pneumoniae
atgttaagttcaaaagatataatcaaggctcacaaggtcttgaacggtgtggttgtgaatactccactggattacgatcattatttatcggagaagtatggtgctaagatttatttgaaaaaagaaaatgcccagcgtgttcgctcctttaaaattcgtggtgcctattatgccatttcccagctcagcaaggaagaacgtgaacgtggggtagtctgcgcttctgcgggaaatcatgcgcagggagtagcctatacttgtaatgaaatgaaaattcctgctactatctttatgcccattactacgccacaacaaaagattggtcaggttcgcttttttggtggggattttgtaactattaaactagttggagatacctttgatgcctcagccaaagcagctcaagaatttacagtctctgaaaatcgtacctttattgatccttttgatgatgctcatgttcaagcaggtcaaggaacagttgcttatgagattttagaagaagctcgaaaagaatcgattgattttgatgctgtcttggttcctgttggtggtggcggtctcattgccggggtttctacctatatcaaggaaacaagtccagagattgaggttatcggagtagaggcgaatggagcgcgttccatgaaagctgcctttgaggctggaggtccagtaaaactcaaggaaattgataaatttgctgatgggattgctgtgcaaaaggtaggtcagttgacctatgaagcaactcgtcaacatattaaaactttggtaggtgtcgatgagggattgatttctgaaaccttgattgacctttactctaagcaagggatagtcgcagaacctgctggagcggctagtatcgcctctttagaggttttagctgaatatattaaggggaaaaccatttgttgtatcatttctggaggaaataatgatatcaaccgtatgccagaaatggaagagcgtgccttgatttatgatggtatcaaacattactttgtggtcaatttcccacaacgtccaggagctttgcgtgagtttgtaaatgatatcctggggccaaatgatgatatcacacgttttgagtatatcaaacgagctagcaagggaacaggcccagtattaattgggatcgctttagcagataagcatgattatgcaggtttgattcgtagaatggaaggttttgatccagcttatattaacttaaatggtaatgaaacgctttataatatgcttgtctga

SEQ ID NO: 1218 - DNA, 357 bp, Streptococcus pneumoniae
atgaatattaccaatttgttttctatcaagacaggatgtgatgaaactgataggcaactgcaaaaactattttttcagttggatttacaattgggagaattgacagatcaactaagaaaattagattctaattttgttcctcgtagtcaatttgtagacacgttggatttgaatgatgtagaatataaagaaattttaaactattttatcttccatcgtaatgatagtgaagaaagtttggtagaatggttatatgattggatttccacaaatcgttatgaacttcctaaagagttttcgattcgtatggctcataaataccatgaaagtgttactgaagttttcggagatgaataa

SEQ ID NO: 1219 - DNA, 234 bp, Streptococcus pneumoniae
aaaacattaacaaatatagttggtaaatcattaggacctaaatcagctgttagattcggagaagctttatcctatattgaaggtcctcttcgcagaataaatgagacgatagatggcggtttatatcaaatagagcaaatgattgcatctggattgaaagaatcgggtttaaatgactggactgcgaaaactttagcttcagctattcgtgggatattagatgtacttatttag

SEQ ID NO: 1220 - DNA, 267 bp, Streptococcus pneumoniae
ttgtataatgtaattacaccgtcggtaatagtgctagcagaccaaaataaagcagattggtcgtatgatgaaaatactgtaattaacatttatgatgatgctaattttgaagatggtaggttgcatatgacctttgaacaattcttcaaattggcacaaatagctagagaagaaggtcttgaaattcattctccgtttgagagagctggtgcgactaaatctgctcgttatatagcgaaatggattttgagaaataaaaaacattaa

SEQ ID NO: 1221 - DNA, 1023 bp, Streptococcus pneumoniae
atgacagttcaaatggaatatgaaaaagatgttaaagtagcagcacttgacggtaaaaaaatcgccgttatcggttatggttcacaagggcatgcgcatgctcaaaacttgcgtgattcaggtcgtgacgttattatcggtgtacgtccaggtaaatcttttgataaagcaaaagaagatggatttgatacttacacagtagcagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgacgatgatgcattcaaaatctataactaa

SEQ ID NO: 1222 - DNA, 501 bp, Streptococcus pneumoniae
atgagatgttgggggtgcagttccatgcgtagaatgttaacagcaaaactacaaaatcgttcaggagtcctcaatcgctttacaggtgtcctatctcgtcgtcaggttaatattgaaagcatctctgttggagcaacagaagatccgaatgtatcgcgtatcactattattattgatgttgcttctcatgatgaagtggagcaaatcatcaaacagctcaatcgtcagattgatgtgattcgcattcgagatattacagacaagcctcatttggagcgcgaggtgattttggttaagatgtcagcgccagctgagaagagagctgagattttagcgattattcaacctttccgtgcaacagtggtagacgtagcgccaagctcgattaccattcagatgacgggaaatgcagaaaagagcgaagccctattgcgagtcattcgcccatacggtattcgcaatattgctcgaacgggtgcaactggatttacccgcgattaa

SEQ ID NO: 1223 - DNA, 1701 bp, Streptococcus pneumoniae
atggagaaaatcagtttagaatctcctaagacggggtcggacctagttttggaaacacttcgtgatttaggagttgataccatctttggttatcctggtggtgcggttttgcctttttatgatgcgatatataattttaaaggcattcgccacattctagggcgccatgagcaaggttgtttgcatgaagctgaaggttatgccaaatcaactggaaagttgggtgttgccgtcgtcactagtggaccaggagcaacaaatgccattacagggattgcggatgctatgagcgatagcgttccccttttggtctttacaggtcaggtggcgcgagcagggattgggaaggatgcctttcaggaggcagacatcgtaggaattaccatgccaatcactaagtacaattaccaagttcgtgagacagctgatattccgcgtatcattacggaagctgtccatatcgcaactacaggccgtccagggccagttgtaattgacctaccaaaagacatatctgctttagaaacagacttcatttattcaccagaagtgaatttaccaagttatcagccgactcttgagccgaatgatatgcaaatcaagaaaatcttgaagcaattgtccaaggctaaaaagccagtcttgttagctggtggtggaattagttatgctgaggctgctacggaactaaatgaatttgcagaacgctatcaaattccagtggtaaccagtcttttgggacaaggaacgattgcaacgagtcacccactctttcttggaatgggaggcatgcacgggtcattcgcagcaaatattgccatgacggaagcggactttatgattagtattggttctcgtttcgatgaccgtttgacggggaatcctaagactttcgctaagaatgctaaggttgcccacattgatattgacccagctgagattggcaagattatcagtgcagacattcctgtagttggagatgctaagaaggccttgcaaatgttgctagcagaaccaacagttcacaacaatactgaaaagtggattgagaaagtcactaaagacaagaatcgtgttcgttcttatgacaagaaagagcgtgtggttcaaccgcaagcagttattgaacgaattggtgaattgacgaatggagatgccattgtggtaacagacgttggtcaacaccaaatgtggacagctcagtattatccctaccaaaatgaacgtcagttagtgacttcaggtggtttgggaacaatgggctttggaattccagcagcaatcggtgctaaaattgctaacccagataaggaagtagtcttgtttgttggggatggtggtttccaaatgaccaaccaggagttggctattttgaatatttacaaggtgccaatcaaggtggttatgctgaacaatcattcactcggaatggttcgccagtggcaggaatccttctatgaaggcagaacatcagagtcggtctttgatacccttcctgatttccaattgatggcgcaggcttatggtattaaaaactataagtttgacaatcctgagaccttggctcaagaccttgaagtcatcactgaggatgttcctatgctaattgaggtagatatttctcgtaaggaacaggtgttaccaatggtaccggctggtaagagtaatcatgagatgttgggggtgcagttccatgcgtag

SEQ ID NO: 1224 - DNA, 2037 bp, Streptococcus pneumoniae
atgactgtaaaaattaatacaaaagatggtcaaatcgaactaacagatgaagtgattgcaaccgtcgtaggtggagcagcaactgagatttttggtgtggtcggtatggctagtaaaaatgccctcaaagataatttccaagccctgctaggtaaggaaaattattctaaaggtgtcgtcgtaaaggcagccgaagatggcagtattgcagttgatgtatataccgtgttaagctacggaacaaagattagtgaagtgtcaaaaaacattcaagagcgtgttgcctttagctgtggaaaaccagcttggaattactgctcagactgtaaatgtctacattcaaaatatcaaagttgtaggagaataaccgtgtcaaaaattactactagcttatttcaagaaatggtgcaggctgcatcaactcgcttgaataagcaagctgaatatgtcaattcattaaacgtctttccagttccagatggagatactgggacaaatatgggaatgaccattgaaaatggtgctaaagaagttgcagacaagccagcttctacagttggagaagtagcgagcattcttgccaaagggcttttgatgggtgcgcgtgggaactcaggagtgattacgtctcagcttttccgtggattttcccaagctatcaaggataaagacgagttaacaggtcaagacttggctctggccttccaatcaggtgtggaagttgcctataaggcagtgatgaaacctgttgaaggaacgattttaacagtttctcgtggagctgctatcggtgctaagaaaaaagctgagcaaacagatgacgctgttgaagtcatgcgcgcagccttggaaggtgctaaaacagctctagctaaaacaccagacatgcttccagtattgaaagaagttggcgttgtggactcaggtggtcaaggattggtcttcatctacgaaggtttcctttcagcccttactggcgaatatattgcatctgaggactttgtagcgactcctgccaacatgagtgagatgatcaatgtagagcatcataagtctgtagctggtcacgtagcgactgaggacatcacgtttggttactgtactgaaatcatggtagctcttaagcaaggtccaacctatgctaaagattttgactacgatgaattccgtaactacttggatgagcttggggattctctcctcgttgttaacgatgatgaaattgtcaaagtccatgttcatacagaagatccaggacttgttatgcaagaaggtctcaaatatggtagcttggtcaaggtaaaagttgacaatatgcgtaatcaacacgaagcacaggttgagaaagaagctactcaagttatcaagtcggctgaagaaaaagagtatgctttgattgctgtggtggctggtaaaggtctagcagatatcttctgttctcaaggcgtggattatgttatcgaaggcggtcaaaccatgaacccttcaacagaagactttatcaaggctgttgaacaggtcaatgcccgtaacatcatcttcttgccaaacaacaagaacatcttcatggcagctcaatctgcggcagaagttttggagcaaccagcagtagtggtagaggctcgcactcttcctcaaggtatgacaagtcttcttgcctttgatccaagcaagtccattgaagaaaaccaagagcgtatgacagctgctcttagcgatgttgttagcggaagcgtcacaacagccgtgcgtgatacaacgatcgatggcttagaaatccatgaaaacgataatctaggtatggtggatggaaaaattcttgtgtcaaaccctgatatgcaccaaacattgactgaaaccttgaaacatatgttggatgaagacagtgaaatcgtaaccttctatgtcggtgaagacggaagcgaagaacttgccaatgaaatcgctcaagaaatcgtagaagaattcgaagacgttgaagtcgagattcaccaaggtcaacaacctgtttacccatacctatttagtgtggaataa

SEQ ID NO: 1225 - DNA, 189 bp, Streptococcus pneumoniae
atggctaaagtatgttactttacaggtcgtaagactgtatcaggaaacaaccgttcacacgcgatgaaccaaacaaaacgtgccgtaaaaccaaaccttcaaaaagttactgttcttatcgatggtaaacctaaaaaagtttgggcttcagctcgtgctttgaaatcaggtaaagttgaacgcgtttaa

SEQ ID NO: 1226 - DNA, 246 bp, Streptococcus pneumoniae
gggactatcatatgcggcttttttaggtattttattccaaagtatgtaagcgagtctcgtgtactgtatttggattcagatattgttgtaagaaaatcgatagatgagctgtgggatttggacttgacggctatacccttagctgcagttagagatgatttttatacacataattttaattctggtgttctgttaatcaacgatggcatgtggagagcagaaaatgtcacgcaagacctgatttaa

SEQ ID NO: 1227 - DNA, 198 bp, Streptococcus pneumoniae
gtgaaagaagagaaaaaagcgattgtcttaggtgcagataatgcttatatggataaagttgaaacaacaataaaatctctttgtgttcatcattataatcttaagttttatgtttttaatgatgaccttccgcgagaatggttccaattgatggaaaaaagactagagactttgaatagtgagattgtgaatgtttag

SEQ ID NO: 1228 - DNA, 1545 bp, Streptococcus pneumoniae
atgaatattcaagaagaaattaagaaacgtcgtacctttgccattatctcccacccggacgcggggaaaacaaccatcactgagcagttactctactttgggggtgagattcgtgaggctggtacggtaaaagggaagaaaacagggacttttgctaaatctgactggatggatatcgagaagcaacgtgggatttctgttacttcatctgttatgcaatttgactacgacggcaagcgcgtgaatatcttagacacgccagggcacgaggacttctcagaagatacctatcgtaccttgatggcggtggatgctgcggtcatggtcgtggactctgccaaggggatcgaggctcaaaccaagaaattgtttgaggttgtgaaacatcgtggcattccagtctttacctttatgaacaagctggaccgtgacggtcgtgagcctttggaactcttgcaagaattggaagaaatcttgggcattgctagctaccctatgaactggcctatcgggatggggaaagcctttgagggcttgtatgacctctataaccaacgtttagaactttataaaggggatgagcgttttgctagcctagaagatggagacaaactttttggtagcaatcctttctacgagcaagtcaaggatgacattgagcttttaaatgaagctgggaatgagttttcagaggaagctattctggctggagaattgacgcctgtctttttcggttcagccctgacaaactttggtgtgcagaccttccttgaaatcttcctcaagtttgctccagaaccacatggtcacaagaaaacagatggtgacattgtggatccttatgacaaggatttctcaggctttgtctttaaaatccaagccaacatggatcctcgtcaccgtgaccgtattgcctttgtccgtatcgtatcaggcgaatttgagcgcggcatgagtgtcaatctccctcgtactggtaagggggctaaactatctaatgttacccagtttatggcggagagtcgtgagaatgtgaccaatgccgtggcaggtgatattatcggggtttacgataccggtacttatcaggttggggataccttgacggttggaaaaaacaagtttgaatttgaaccattgccaacctttactcctgaaattttcatgaaagtttctgctaagaatgttatgaagcaaaaatccttccacaaggggattgagcaattggtgcaagaaggagccgttcagctttataagaattaccaaacaggtgagtacatgctgggagctgttggtcaactccagtttgaagtctttaaacaccgtatggaaggcgaatacaatgcggaagtggtcatgagcccaatgggtaaaaagaccgttcgttggatcaagcctgaggacttggatgaacggatgtcgtcaagtcgcaatatcttagccaaagaccgttttgaccaaccagtctttctctttgaaaatgactttgccctccgctggtttgcggacaagtatccagacgtagagttagaggagaagatgtga

SEQ ID NO: 1229 - DNA, 303 bp, Streptococcus pneumoniae
atgaaaattacgcaagaagaggtaacacacgttgccaatctttcaaaattaagattctctgaagaagaaactgctgcctttgcgaccaccttgtctaagattgttgacatggttgaattgctgggcgaagttgacacaactggtgtcgcacctactacgactatggctgaccgcaagactgtactccgccctgatgtggccgaagaaggaacaaaccgtgatcgcttgtttaaaaacgtacctgaaaaagacaactactatatcagggtgccagctatcctagacgatggaggagatgcctaa

SEQ ID NO: 1230 - DNA, 1467 bp, Streptococcus pneumoniae
atgacttttaacaataaaactattgaagagttgcacaatctccttgtctctaaggaaatttctgcaacagaattgacccaagcaacacttgaaaatatcaagtctcgtgaggaagctctcaattcatttgtcaccatcgctgaggagcaagctcttgttcaagctaaagccattgatgaagctggaattgatgctgacaatgtcctttcaggaattccacttgctgttaaggataacatctctacagacggtattctcacaactgctgcctcaaaaatgctctacaactatgagccaatctttgatgcgacagctgttgccaatgcaaaaaccaagggcatgattgtcgttggaaagaccaacatggacgaatttgctatgggtggttcaggtgaaacttcatactacggagcaactaaaaacgcttgggaccacagcaaggttcctggtgggtcatcaagtggttctgccgcagctgtagcctcaggacaagttcgcttgtcacttggttctgatactggtggttccatccgccaacctgctgccttcaacggaatcgttggtctcaaaccaacctacggaacagtttcacgtttcggtctcattgcctttggtagctcattagaccagattggatcttttgctcctactgttaaggaaaatgccctcttgctcaacgctattgccagcgaagatgctaaagactctacttctgctcctgtccgcatcgccgactttacttcaaaaatcggccaagacatcaagggtatgaaaatcgctttgcctaaggaatacctcggtgaaggaattaacccagaggttaaggaaaccattctaaatgccgctaaacactttgaaaaattgggtgctattgtcgaagaagtcagccttcctcactctaaatacggagttgccgtatactacatcatcgcttcatcagaagcttcatcaaacttgcaacgcttcgacggtatccgttacggctatcgcgcagaagatgcaaccaaccttgatgaaatctatgtaaacagccgaagccaaggttttggtgaagaagtgaagcgccgtatcatgctgggtactttcagtctttcatcaggttactacgatgcctactacaagaaggctggacaggtccgtacacttatcattcaagatttcgaaaaagtcttcgcggattacgatttgattttgggtccaactgctccaagtgttgcctatgacttggattctctcaaccatgacccagttgccatgtacttagccgacctattgaccatacctgtaaacttggcaggactgcctggaatttcgattcctgctggattctctcaaggtctacctgtcggactccaattgattggtcccaagtactctgaggaaaccatttaccaagctgctgctgcttttgaagcaacaacagactaccacaaacaacaacccgtgatttttggaggtgacaactaa

SEQ ID NO: 1231 - DNA, 639 bp, Streptococcus pneumoniae
atgaactttgaaacagtcatcggacttgaagtccacgtagagctcaacaccaattcaaaaatcttctcacctacttctgcccacttcggaaatgatcaaaatgccaacactaacgtgattgactggtctttcccaggagttctgccagttctcaataaaggggttgttgatgccggtatcaaggctgctcttgccctcaacatggacatccacaaaaaaatgcactttgaccgcaagaactacttctaccctgataatcccaaagcctaccaaatttctcagtttgatgagccaatcggttataacggctggattgaagtcgagctagaagacggtacgaccaagaaaattggtatcgaacgcgcccacttagaggaagacgctggtaaaaacacccacggtacagacggctactcttacgttgaccttaaccgccaaggggtacctttgattgagattgtatctgaagccgatatgcgttcgccagaggaggcctatgcttatctgacagcactcaaggaagttatccagtatgctggcatttctgacgttaagatggaggaaggttcgatgcgtgtggatgccaacatctccctcgtccttatggtcaagagaaattcggtaccaagactgaattga

SEQ ID NO: 1232 - DNA, 807 bp, Streptococcus pneumoniae
ttgaagaacctcaactccttctcaaacgttcgcaaggggcttgaatacgaagtccaacgccaggctgaaattcttcgctcaggtggtcaaatccgccaagaaacacgccgttacgatgaagctaacaaaacaaccatcctcatgcgtgtcaaggaaggggctgctgactaccgctacttcccagaaccagacctacccctctttgaaatttctgacgagtggattgaggaaatgcggactgagttgccagagtttccaaaagaacgtcgtgcgcgttatgtatctgaccttggtttatcagactacgatgctagtcagttgactgctaataaagtcacttctgacttctttgaaaaagctgttgccctaggtggtgatgccaaacaagtctctaactggctccaaggggaagtcgctcagttcttgaatgctgaaggtaaaacactggaacaaatcgaattgacaccagaaaacttggttgaaatgattaccatcatcgaagacggtactatttcatctaagattgccaagaaagtctttgtccatctagctaaaaatggcggtggcgcgcgtgaatacgtggaaaaagcaggtatggttcaaatttcagatccagctatcttgatcccaatcatccaccaagtctttgccgataacgaagctgctgttgccgacttcaagtcaggcaaacgtaacgccgacaaggcctttacaggattccttatgaaggcaaccaaaggccaagccaacccacaagttgcccttaaactacttgcacaggaattggcgaagttgaaagaaaactag

SEQ ID NO: 1233 - DNA, 1044 bp, Streptococcus pneumoniae
atggctacaatgaaggcagctcgctggcatgcagcgaaagatgttcgtattcaagaaatagaagttcctgaagtacttccgcaccaagtaaaagttgcagttaagttcacaggaatttgtggtactgacctccatgaatttttagatggacctatctttatcccaacagatgagcacgtctattctggtcaaaaagcaccggtaacactgggacatgaattttctggtgaaatcatagaagtcggaagcgatgttacccgtgttaaagttggtgatcgtgttgctgtggaaccaattctagctaaaaataacttagttggtgattataatttggatccaaaccttaattttgtcggtttggctgcagacggtggatttgccaaatattgtgttttagacggtgacttagtacatgtcattccagatagcttgagctatgagcaagctgctcttactgaacccgctgctgttgcagtctatgctgttcgtcaatcttctttgaaggctggcgatacagctgttgtctttggtttaggcccgattggtctattaattgtagaagctcttcgtgcagctggtgcttctaagatttatgctgttgaactatcacctgaacgtcaagcaaaagctgaagagttaggagctatcgttgtccgtccggaagaaggtgaaacagctgttgaagctattcatcgtttaacaaacggtggtgtagatgtttcttatgaagtaacgggtgtgccagtagttttaggacaagccttagctgccgtacataaagcaggtgagtgcatggtggtctctatctgggaacgagaagcaaatattaatccgaatgaatttgcaatccaagaaaagacactaaaaggaatcatcgcttatcgtcatatcttccctaaagtattagaattgatggaacaaggctacttctctgctgaaaaattagttactaagaaaattaaattggaaaatatcgtcgaagaaggctttatcgaattaactcaagataagtcacaaattaaaattttggtagaaccagaataa

SEQ ID NO: 1234 - DNA, 201 bp, Streptococcus pneumoniae
tactcttcgaaaatctcttcaaaccacgtcagcgtcacattaccgtatatatggttactgacttcgtcagttctatccacaacctcaaaacagtgttttgagcagcctgcggctagcttcctagtttgctctttgatttccattgagtatgagaagaaatatagtggatactctttaacattaaccactccacctgactag

SEQ ID NO: 1235 - DNA, 561 bp, Streptococcus pneumoniae
atgattgaagcaagtaaattaaaagctggtatgacctttgaaacagctgacggcaaattgattcgcgttttggaagctagtcaccacaaaccaggtaaaggaaacacgatcatgcgtatgaaattgcgtgatgtccgtactggttctacatttgacacaagctaccgtccagaggaaaaatttgaacaagctattatcgagactgtcccagctcaatacttgtacaaaatggatgacacagcatacttcatgaatacagaaacttacgaccagtacgaaatccctgtagtcaatgttgaaaacgaattgctttacatccttgaaaactctgatgtgaaaatccaattctacggaactgaagtgatcggtgtcaccgttcctactactgttgagttgacagttgctgaaactcaaccatctatcaaaggtgctactgttacaggttctggtaaaccagcaacgatggaaactggacttgtcgtaaacgttccagacttcatcgaagcaggacaaaaactcgttatcaacactgcagaaggaacttacgtttctcgtgcctaa

SEQ ID NO: 1236 - DNA, 390 bp, Streptococcus pneumoniae
atgggaattgaagaacaacttggcgaaatcgttatcgccccacgtgtacttgaaaaaatcattgctatcgctactgcaaaggtagagggtgttcactctttttcaaacagatcagtgtctgataccctttcaaaactttcactcggccgtggcatttatcttaaaaacgtggacgaagaactcacagcagatatctatctctaccttgagtacggagtaaaagttcctaaggtagcggttgctatccagaaagctgtcaaagatgccgtccgtaatatggctgatgtagaactcgctgctatcaatattcacgttgcaggtatcgtcccagataaaacaccaaaaccagaattgaaagatctatttgacgaggacttcctcaatgactag

SEQ ID NO: 1237 - DNA, 423 bp, Streptococcus pneumoniae
atgactagtccactattagaatctagacgccaactccgtaaatgcgcttttcaagctctcatgagccttgagttcggtacggatgtcgaaactgcttgtcgtttcgcctatactcatgatcgtgaatatacggatgtacaacttccagcctttttgatagacctcgtttctggtgttcaagctaaaaaggaagaactagataagcaaatcactcagcatttaaaagcaggttggaccattgaacgcttaacgctcgtggagagaaacctccttcgcttgggagtctttgaaatcacttcatttgacactcctcagctggttgctgttaatgaagctatcgagcttgcaaaggacttctccgatcaaaaatctgcccgttttatcaatggactgctcagccagtttgtaacagaagaacaataa

SEQ ID NO: 1238 - DNA, 570 bp, Streptococcus pneumoniae; identical to SEQ ID NO: 4

SEQ ID NO: 1239 - DNA, 783 bp, Streptococcus pneumoniae
atggaacaattacattttatcacaaaattactagacattaaagaccctaatatccagattttagacatcatcaataaggatacacacaaggaaatcatcgccaaactggactatgaagctccatcttgtcctgagtgcggaagtcaaatgaagaaatattactttcaaaaaccttctaaaattccttatcttgaaacaactggtatgcctactagaattctccttagaaagcgtcgtttcaagtgctatcattgttctaaaattatggttgctgaaacttctatcgtcaagaagaatcatcaaatccctcgtatcatcaaccaaaagattgctcaaaagttaattgaaaagatttctatgactgatattgcccatcagctttccatctcaacttcaactgtcattcgtaagctcaatgattttcactttaaacatgatttttcttgtctttctgagattatgtcttgggatgagtatgcttttacaaagggaaagatgagcttcattgcgcaagattttaacaagctcaatatcatcactgttcttgagggtagaacacaagctatcattcgaaatcactttcttcgctacgatagagttgtccgatgtcgcgtcaaaattattactatggatatgtttagtccttactatgacttggctaaacagcttcgctttcaaatttctaggctcaggctgaaacagtctcccagactgtttcactcccgaatgctaaaatcgtgttggatcgctttcacattgtacaacatcttagccgtgctatga

SEQ ID NO: 1240 - DNA, 834 bp, Streptococcus pneumoniae
ttggaagtacggcttccgaacagggtaatctttcaaaaaagtacgatgagaaacacaaagaaactaagacaatttggaatatttttgcttattattttactatctacctatttaccacaaacaattagattgtatgtgacgatcattttagggttaggagctgatgtctattctcttattttaacaatgggattagtgggaagtttccttctattaatttggaggttaaaaaagaaaaagatgctctttatctttgagaaaaagagctggaactggtcatttgtcttctacttatttgcaacttatgtggtttatcagattctcggtaatttttgggcacgctatgctcatttgattaatcataggaatattcatgatgagtattttaccgtggttctttcaaatggacaaccaacctttttatcgactatcttatcttttgtcctgcctgtaatcatcgatcctgtttttgaggagactcttgatagagggtattttatgaataccttctttcctaagtcaaagtactatttagatgtcatcttatcaggccttatctttgggcttagtcatttgatactatctcacagagatccaattagtttattatattatagtttgattggtttcttttttgcccttgtttatcgttctaccgacaatctgagattaacgattctctgccatagttttttaactttctcaatcatgcaaaacctatctggatttttgtttacaattatatctattatcatttttttagatagtgggaggcaaagaaaaaagtgtttgatatctatcaaacactttttctttttattgttggctctataa

SEQ ID NO: 1241 - DNA, 252 bp, Streptococcus pneumoniae
ttgactttcctgatagagttgttcacatcttatttcaaatcactatattttaagaaggtacttgcaatgacaggtacagaaacatttacagttatttcaactgaggacttggagcaaacttcaggtggtcttgctgtttgggaagatggatatagtagatggttatattatagagaatttgctccttatatgaggcaaggggcacttaattcttatatagatgcttggaagtacggcttccgaacagggtaa

SEQ ID NO: 1242 - DNA, 768 bp, Streptococcus pneumoniae
atgaatattgcaaaaatagtcagagaagcgcgtgagcagagtcgcttgacaaccttggactttgcgacaggcatttttgatgaatttatccaattacatggtgaccgttcttttcgtgatgatggtgcagttgttggtggtattggttggcttggagaccaagctgtaacagtggttggtatccaaaaaggcaagagtttgcaagacaacctcaaacggaattttggccaaccacatccagaaggctaccgaaaggcactgcggttgatgaaacaggctgagaaatttggccgtccagttgtgacctttatcaatacagcaggtgcttatcctggtgtcggagcggaagaacgtggtcaaggggaagctattgctcgcaatctcatggaaatgagtgacctgaaagttcctattatcgccattattatcggtgaaggtggttcaggcggggctctggctctagctgtcgcggaccgtgtctggatgctggaaaattctatctatgccattctcagtccagaaggctttgcttccattttatggaaggacggtactcgcgccatggaagcagcagaactgatgaaaatcacttcgcatgaactgttagaaatggacgtggtggataaggtgatttctgaagtaggactttctagtaaagaactgattaagagtgtcaaaaaagaactccaaacggagctggctagactttcacaaaaaccgctagaagagttgctggaagaacgctatcaacgatttagaaaatactaa

SEQ ID NO: 1243 - DNA, 864 bp, Streptococcus pneumoniae
atggctctatttagtaaaaaagataagtatattcgaatcaatcccaatcgttcggttagggaaaaacctcaagctaagccagaggttccagatgaattattttcccagtgtccaggctgtaagcataccatctatcagaaggatctgggaagtgaacgtatctgtccgcactgtagctatacctttcgtatttctgcccaagaacgcttggctttgacgattgatatgggaaccttcaaagaattgtttacagggattgaaagcaaggatcccttgcatttccctggttaccaaaagaaactggcatctatgcgtgaaaaaacaggtctgcatgaagccgttgtgacaggaactgctcttattaaaggtcagactgtggctcttgggattatggattctaactttatcatggcttctatgggtacggttgtaggtgaaaaaatcactcgtttgtttgagtatgcgactgtcgaaaaattgccagttgtcctattcacagcctctggtggagcccgtatgcaggaaggaatcatgagtctcatgcagatggctaagatctctgcggcggttaaacgccattcaaatgctggtctcttttacctgaccattttgacagatccaacgactggtggtgtgacagcttctttcgctatggaaggcgatatcattctggctgaaccacagagcttggttggttttgctggacgtcgtgtgattgaaaatacggttcgtgaaagcttgcctgaggatttccaaaaggcagaattcctattagaacatggctttgtggatgctattgtcaaaagaagagacttaccagatacgattgctagcctagtcagattgcatggagggagtcctaga

SEQ ID NO: 1244 - DNA, 1368 bp, Streptococcus pneumoniae
atgtttcgaaaaattttaattgccaatcgtggtgaaattgcggttcgtattatccgtgcggcacgtgaattggggattgcgacggtagcggtttattcaactgctgataaggaagctcttcatacgctgttggcagatgaagcagtttgtattggtcctggcaaggcaacagagtcttatctcaatattaatgcagttctatcagctgcagtcttgactgaggcagaagctattcaccctggttttggatttctcagtgaaaattccaaatttgcgaccatgtgtgaagaagtaggtatcaagtttatcggtccatctggtcatgttatggatatgatgggggataagatcaatgcgcgtgctcagatgattaaagcaggtgtgcctgttataccaggttcagatggagaagtgcataactctgaagaagctttgattgttgctgaaaaaattggctatcctgttatgctcaaggcttcagcaggtggaggtggtaaagggattcgtaaggttgaaaaaccagatgacctcgtttctgcctttgaaactgcctctagtgaggccaaggccaattatggcaatggtgccatgtacatagaacgggttatctatccagctcggcacattgaggttcaaatcctaggtgatgagcatggacatgtgattcacttgggtgaacgggattgttctcttcaaaggaataaccaaaaggttttggaagaaagtccctcgattgcaatcggaaaaacgctgcgtcatgaaataggtgctgctgctgttcgagcggcagagtttgttggctatgagaatgcaggaaccattgaatttcttcttgatgaagcaagtagcaatttctatttcatggagatgaatactcgtgttcaggtagaacatccagtaacagagtttgtttcaggtgttgatatcgttaaggaacagatttgcattgcggcaggtcagcctttgtctgttaagcaagaagatattgtcctacgcggtcatgccatcgagtgtcgtatcaatgcagaaaacccagcctttaactttgctccaagtccaggtaagattactaatctctatctgccaagtggtggagttggcttgcgcgtggattcagcagtttatccaggttataccattccgccttattatgatagtatgattgccaaaatcatagtacacggcgaaaatcgttttgacgccttgatgaaaatgcaacgtgccctctatgaattagaaattgaaggagtgcagaccaatgcagatttccagcttgacctcatttcagatcgcaatgtcattgctggggattatgatacttccttcttgatggaaaccttcttacctaaatatcaagaaaaagaataa

SEQ ID NO: 1245 - DNA, 423 bp, Streptococcus pneumoniae
atgatcgatattcaaggaatcaaagaagcccttccccaccgttatcctatgcttctagtggaccgtgtcttggaggtgagcgaggataccattgttgctatcaaaaatgtgaccatcaacgagcctttctttaacggccactttcctcaatacccagttatgccaggtgttctgattatggaagccttggcgcaaactgccggtgtgttggagttatcaaaacctgaaaataaaggaaaactggtcttttacgctggtatggataaggttaagttcaagaagcaagttgtaccaggcgaccaattggttatgacagcgacttttgtaaaacgtcgtggcaccatagctgtggttgaagcaaaggctgaagtggatggcaagcttgcagccagtggtacccttacttttgcaattgggaactaa

SEQ ID NO: 1246 - DNA, 486 bp, Streptococcus pneumoniae
atgaatttaaacgatattaaagacttgatgactcaatttgaccagtcaagtttgagagaattttcttataaaaatgggacggatgagttgcagtttagcaagaatgaagcgagacctgtgcctgaagttgcaactcaagtcgctccagcacccgttctagcaacaccgagtccagtagctcctacatctgctccagcagagactgtagcagaagaagttccagctccagctgaagcaagtgtggctagtgagggaaatcttgtagagagtccacttgttggagtggtttacttggctgctggaccagataaacctgccttcgttacagttggtgatagtgtcaaaaaaggtcaaacattggtaattatcgaagccatgaaagtcatgaatgaaatcccagctcctaaggatggtgtggtaacggaaattctcgtctctaacgaagaaatggttgagtttggtaaaggattggtacgtatcaaatga

SEQ ID NO: 1247 - DNA, 279 bp, Streptococcus pneumoniae
ctgttcttggtaaggaagtacctgtatcatcaaccaagtcttttacaggacatttgctgggggctgcggcgtgcagtagaagctatcgtcaccatcgaagctatgcgtcataactttgtaccaatgacagctgggacaagtgaagtatcagattatatcgaagctaatgtcgtttatggacaaggcttggagaaagaaattccatacgctatttcaaatacttttggttttggaggccacaatgcagttcttgctttcaaacgttgggagaatagataa

SEQ ID NO: 1248 - DNA, 1080 bp, Streptococcus pneumoniae
gtgaaaagaatgaaactaaatcgagtagtggtaacaggttatggagtaacatctccaatcggaaatacaccagaagaattttggaatagtttagcaactgggaaaatcggcattggtggcattacaaaatttgatcatagtgactttgatgtgcataatgcggcagaaatccaagattttccgttcgataaatactttgtaaaaaaagataccaaccgttttgataactattctttatatgccttgtatgcagcccaagaggctgtaaatcatgccaatcttgatgtagaggctcttaatagggatcgttttggtgttatcgttgcatctggtattggtggaatcaaggaaattgaagatcaggtacttcgccttcatgaaaaaggacccaaacgtgtcaaaccaatgactcttccaaaagctttaccaaatatggcttctgggaatgtagccatgcgttttggtgcaaacggtgtttgtaaatctatcaatactgcctgctcttcatcaaatgatgcgattggggatgccttccgctccattaagtttggtttccaagatgtgatgttggtgggaggaacagaagcttctatcacaccttttgccatcgctggtttccaagccttaacagctctctctactacagaggatccaactcgtgcttcgatcccatttgataaggatcgcaatgggtttgttatgggtgaaggttcagggatgttggttctagaaagtcttgaacacgctgaaaaacgtggagctactatcctggctgaagtggttggttacggaaatacttgtgatgcctaccacatgacttctccacatccagaaggtcagggagctatcaaggccatcaaactagccttggaagaagctgagatttctccagagcaagtagcctatgtcaatgctcacggaacgtcaactcctgccaatgaaaaaggagaaagtggtgctatcgtagctgttcttggtaaggaagtacctgtatcatcaaccaagtcttttacaggacatttgctgggggctgcggcgtgcagtagaagctatcgtcaccatcgaagctatgcgtcataa

SEQ ID NO: 1249 - DNA, 732 bp, Streptococcus pneumoniae
atgaaactagaacataaaaatatctttattacaggttcgagtcgtggaattggtcttgccatcgcccacaagtttgctcaagcaggagccaacattgtcttaaacagtcgtggggcaatctcagaagaattgctcgctgagttttcaaactatggtatcaaggtggttcccatttcaggagatgtatcagattttgcagacgctaagcgtatgattgatcaagctattgcagaactgggttcagtagatgttttggtcaacaatgcagggattacccaagatactcttatgctcaagatgacagaagcagattttgaaaaagtgctcaaggtcaatctgactggtgcctttaatatgacacaatcagtcttgaaaccgatgatgaaagccagagaaggtgctatcattaatatgtctagtgttgttggtttgatggggaatattggtcaagctaactatgctgcttctaaggctggcttgattggctttaccaagtctgtggcacgcgaggtcgctagtcggaatatacgagtcaatgtgattgctccaggaatgattgagtctgatatgaccgctatcttatcagataagattaaggaagctacactagctcagattccgatgaaagaatttgggcaggcagagcaggttgcagatttgacagtatttttagcaggccaagattatctaactggtcaagtggttgccattgatggtggcttaagtatgtag

SEQ ID NO: 1250 - DNA, 222 bp, Streptococcus pneumoniae
ttccccatcaaaccaacaacactagacatattaatgatagcaccttctctggctttcatcatcggtttcaagactgattgtgtcatattaaaggcaccagtcagattgaccttgagcactttttcaaaatctgcttctgtcatcttgagcataagagtatcttgggtaatccctgcattgttgaccaaaacatctactgaacccagttctgcaatagcttga

SEQ ID NO: 1251 - DNA, 921 bp, Streptococcus pneumoniae
atgactaaaacagcctttttatttgctggtcaaggtgcccagtatctagggatgggacgggatttctatgatcagtatccgattgttaaagaaacgattgatcgagcgagtcaggtgctcggttatgatttgcgttatctcatcgatacggaagaggacaaactcaatcagacccgctatacgcaaccagccattctagcgacttcggttgctatctaccgtttattgcaagaaaagggctatcagcctgatatggtcgctggtttgtctcttggagaatactctgccttggtggcaagcggcgccttggattttgaagatgcggttgccttggtagctaagcgtggagcctatatggaagaagcggctcctgctgactctggcaagatggtagcagttctcaatacgccagtagaggtcattgaagaagcctgtcaaaaagcttctgaacttggagtggttactccagccaactataacacacctgcacaaatcgtcattgctggagaagtggttgcagttgatcgagcggttgaacttttgcaagaagcaggtgccaaacgcttgattcctcttaaggtgtcaggtccctttcacaccgctctccttgagccagctagccagaaactagctgaaactctagctcaggtaagtttttcagattttacttgtcccctagtcggcaatacagaagctgctgtgatgcaaaaagaggacattgctcagctcttgacgcgtcaggtcaaggaacccgttcgtttctatgaaagtattggggtcatgcaagaagcaggcataagcaactttatcgagattggaccggggaaagtcttgtcaggttttgttaaaaaaattgatcaaactgctcacttagctcatgtggaagatcaagcgagtttagtagcacttttagaaaaatag

SEQ ID NO: 1252 - DNA, 975 bp, Streptococcus pneumoniae
atgaaaacgcgtattacagaattattgaagattgattatcctattttccaaggagggatggcctgggttgctgatggtgatttggcaggggctgtttccaaggctggaggattaggaattatcggtgggggaaatgccccgaaagaagttgtcaaggccaatattgataaaatcaaatcattgactgataaaccctttggggtcaacatcatgctcttatctccctttgtggaagatatcgtggatctcgttattgaagaaggtgttaaagttgtcacaacaggagcaggaaatccaagcaagtatatggaacgtttccatgaagctgggataatcgttattcctgttgttcctagtgtcgctttagctaaacgcatggaaaaaatcggtgcagacgctgttattgcagaaggaatggaagctggggggcatatcggtaaattaacaaccatgaccttggtgcgacaggtagccacagctatatctattcctgttattgctgcaggaggaattgcggatggtgaaggtgctgcggctggctttatgctaggtgcagaggctgtacaggtggggacacggtttgtagttgcaaaagagtcgaatgcccatccaaactacaaggagaaaattttaaaagcaagggatattgacactacgatttcagctcagcactttggtcatgctgttcgtgctattaaaaatcagttgactagagattttgaactggctgaaaaagatgcctttaagcaggaagatcctgatttagaaatctttgaacaaatgggagcaggtgccctagccaaagcagttgttcacggtgatgtggagggtggctctgtcatggcaggtcaaatcgcagggcttgtttctaaagaagaaacagctgaagaaatcctaaaagatttgtattacggagccgctaagaaaattcaagaagaagcctctcgctggacaggagttgtaagaaatgactaa

SEQ ID NO: 1253 - DNA, 225 bp, Streptococcus pneumoniae
atggcagtatttgaaaaagtacaagaaattatcgttgaagaacttggaaaagacgcatcagaagtaacacttgaatcaacttttgatgatttggacgcagattcattggacttgttccaagtaatctcagaaatcgaagatgcttttgatatccaaatcgaagcagaaaatgacttgaaaacagttggtgacttggttgcttacgttgaagagcaagcaaaataa

SEQ ID NO: 1254 - DNA, 567 bp, Streptococcus pneumoniae
ttggtaagtgaaacccttttaaagccagtcgattggtcggatcgatcaacagctgtgttgtttggagatggtgctgctggtgtcttgttagaagctagcgagcaagagcatttcttagctgagagtctcaatagcgatggaagtcgcagcgagtgtttaacttatgggcattcaggtttgcattctccattttcagatcaagaaagtgcagattcatttttgaagatggatggacgcacagtctttgattttgccattcgagatgtagccaagtctatcaagcagactattgatgaatctcctatagaggtgacagacttggattatctgctacttcatcaagccaatgaccgtattttggataagatggctagaaaaattggtgttgaccgagccaaacttccagccaatatgatggaatatggcaataccagtgcagccagtatcccgattttactttcagagtgtgtagaacaaggtctcatccctttagatggtagccagactgttcttctatcaggcttcggtggaggcttgacctggggcacgctcattcttacaatttag

SEQ ID NO: 1255 - DNA, 399 bp, Streptococcus pneumoniae
atggcttttgcaaaaataagtcaggttgctcattatgtgccagagcaagtggttacaaatcacgacttggctcagattatggataccaatgatgagtggatttcaagtcgaacgggaatacgacaaaggcatatttcaagaacagaatctaccagtgatttggctacagaggttgctaagaaactgatggcaaaagctggaataacaggagaagaactggattttatcatcctagctaccattactccagattcgatgatgccctctacagctgctcgtgttcaagctaatattggtgctaataaaacctttgcttttgacttaaccgcggcttgcaagggatttgtatttgctctttcaactgctgaaaagtttatcgcttctggtcgctttcaaaaa

SEQ ID NO: 1256 - DNA, 198 bp, Streptococcus pneumoniae
ttgcaaaagccattatttcaaatcctccaaaaattggtaaagattagtcaaacctttacccatgacagcaatttcttcctcgctcatgccatcaataattttttctaccatggccttgtggaagcgtttatgcagtctatgaatcaagcgacccttctttgtcaaatgcagatgcaccacacgacgatcctgttctga

SEQ ID NO: 1257 - DNA, 435 bp, Streptococcus pneumoniae
atggactaccaacgaatcaatgaatatttaacatctatatttaacaatgtccttgtaattgaggaagtgaacttgagaggtagtcgttttaaggatatctccatcaaagaaatgcatacgattgatgtcatcggtaaggctccagacgtgactccaagtcaagtgtcaaaagagttgatggtaactcttggaactgttacgacaagtttgaacaatttagagcgtaagggctacattgagcgagttcggtcagaacaggatcgtcgtgtggtgcatctgcatttgacaaagaagggtcgcttgattcatagactgcataaacgcttccacaaggccatggtagaaaaaattattgatggcatgagcgaggaagaaattgctgtcatgggtaaaggtttgactaatctttaccaatttttggaggatttgaaataa

SEQ ID NO: 1258 - DNA, 198 bp, Streptococcus pneumoniae
ctcaaacagaggatttcaaagaaggagtgcgagctcattcggagagaagaagacctaaatttacaggaaaataaaaaatacttgcatcattctttgaattttgatataattctttctgtcaaatgttttgattgtaaaagttttttgaagaaggagggatatgaaaaatggactaccaacgaatcaatgaatatttaa

SEQ ID NO: 1259 - DNA, 258 bp, Streptococcus pneumoniae
aaaggagccctgatggaacacattatttatcagcttgaagaggacttggcaatccttaccttgaaccgtcctgaggtcgcaaatggttttcatattcccatgtgtgaggagattttagaagctctgactttggcagaagaaaatccagctgtgcattttatcttaatcaatgccaatggaaaggtcttctcagttgggggagatttggtagagatgaagcgggcagtggatgaggatgatattccatcattgacaaaa

SEQ ID NO: 1260 - DNA, 228 bp, Streptococcus pneumoniae
atgaaaaccatttgcgacctcaggacggttcaaggtaaggattgccaagtcctcttcaagctgataaataatgtgttccatcagggctcctttttattttataagcagtttatactcttcgaaaatctctttaaaccgcgtcagcttccatctgcaacctcaaaacagtattttgagctgacttcggctagcttcctagtttgctctttgattttcattgagtgttaa

SEQ ID NO: 1261 - DNA, 1365 bp, Streptococcus pneumoniae
atgaaagttgttaaatttggaggtagttctcttgcctctgctagtcaattagaaaaagttttaaacatcgtcaaaagcgattcagagcgtcgttttgtagtcgtttctgcgcctggtaaacgcaatgctgaagatactaaggttacggatgccctgattaaatactaccgcgactatgttgcgggtaacgatattagcaagagccaaagctggattatcgaccgctatgctgctatggttagtgaattgggactaaaaccagctgtgctagaaaaaatttctaaaagcattcacaccttggccactcttcctattgaagaaaatgaatttctctacgatactttcctagcagccggtgaaaataacaatgccaaattgattgctgcctactttaaccaaaatggtatcgatgcacgctatatgcaccctagagaagctgggattgtggtcacaagtgaacctggtcacgctcgcatcattccatcaagttatgacaagattgaagaattgacaaacaccaatgaagtccttgtcattcctggtttctttggtgtcactaaggaaaatcaaatctgtactttctcacgtggaggatctgatattacaggttctatcattgctgctggtgtcaaagctgacctctatgaaaactttacggacgttgatggtatctttgcagcccaccctggtattatccaccaaccacactcgattcctgagttgacctaccgtgaaatgcgcgagttggcctatgcaggcttctcagtccttcatgacgaggctcttcttcctgcctaccgtggaaaaattcctctggttatcaagaataccaacaaccctgaccatccaggtactcgtatcgttctaaaacacagtaatgatgaatttccagttgtgggaattgctggtgactcaggctttgtcagcattaatatgtcgaaatacctcatgaaccgtgagattggatttggccgcaaggttctgcaaatcctggaagaacttaacatcggttgggaacatatgccaacaggtatcgacgatctttctatcattctccgttctcgccaactaactcccatcaaggaagaagaaatcctgcgtcagttggttcaaaaggctaaagtagatcatgcagaaatcgaacacgacctttctatcattatgattgttggtgaaaaaatgaagagccacatcggagtgactgctactgcgacacgcgctctatctgaaaacaaaatcaacatccagatgatgtctcaaggttctagtgaagtttctattatgtttgttgtcaataaagaccaagagaaagcagcaattaaagccctctacaatgccttttttggagaaagtaaggaagactaa

SEQ ID NO: 1262 - DNA, 372 bp, Streptococcus pneumoniae
atggcccaatcacttaacaaaacagtactcctcagtacgacaggcacttcctacctctctatcgctgggaaagttgggaaattccttgtcggagatcaggctttggaattttacccagatgtcaatgtcgaacaatttatccagattccttggagccatatcaatcagattggagccaatgtcactggatgcaaaatcagccgccacttcgaagtctttacagacaaaggaaaattcctctttgcttcaaaagactcaggtgccattctcaaaattgcacgcgacaaattgggcaatgacaaggtcgtcaaacttccgaccctgattcagacaattagccaaaaatttaaaaatctatttgcaaaaaaatag

SEQ ID NO: 1263 - DNA, 1125 bp, Streptococcus pneumoniae
  unsure (1023): n at each above location is unknown.
atgttagatatcaaacgtattcgtacagattttgaagctgtcgcagaaaaattagctacacgtggtgtagatgctgctgtcttgaatgaaatgaaagaaatcgatgctaaacgtcgtaacatcttggtcaaggttgaaactctcaaagcagaacgtaacacagtttctgctgagattgcccaagctaagcgcaacaaggaaaatacagatgacaagattgctgccatgcaaaatctatctgctgaggttaaagccttggatgctgaattggcagaaatcgatgctaaattgacagaatttacaacgactcttccaaatatcccagctgacagcgttcctgttggggctgacgaagacgacaatgtggaagttcgccgttggggtactccacgcgagtttgacttcgaacctaaagctcactgggatctcggtgaagaccttggtatccttgactgggaacgcggtggtaaggtaacaggcgctcgcttcctcttctataaaggcctcggtgctcgtttggaacgtgctatctacaactttatgttggatgaacatggaaaagaaggctatactgaagtcatcacaccttacatagtcaaccatgattctatgtttggtactggtcagtatccaaaatttaaggaagatacttttgaactcagcgataccaactttgtcttgattccaactgctgaagttcctctggcaaactactaccgtgatgaaatcttagacggcaaagatcttccaatctacttcactgctatgagtccgtcattccgttctgaggctggttctgccggtcgtgatacgcgtggcttgatccgtttgcaccaattccacaaggttgaaatggtcaaatttgccaaaccagaagaatcttacgaagaattggaaaaaatgacagccaacgctgaaaacattcttcaaaaactcaaccttccataccgtgtcgttgctctctctactggagatatgggcttctcagctgcgaagacttacgacttggaagtgtggattccncgacaaaacaattacgtgaaatctcaagctgttcaaacacagaagatttccaagcccgtcgtgcccaaatccgttaccgtgatgaagcagatggcaaggtga

SEQ ID NO: 1264 - DNA, 273 bp, Streptococcus pneumoniae
  unsure (106): n at each above location is unknown.
aaacattcttcaaaaactcaaccttccataccgtgtcgttgctctctctactggagatatgggcttctcagctgcgaagacttacgacttggaagtgtggattccncgacaaaacaattacgtgaaatctcaagctgttcaaacacagaagatttccaagcccgtcgtgcccaaatccgttaccgtgatgaagcagatggcaaggtgaaactccctccataccttgaacggttctggacttgcagttggacgtacagtggctgcaattcttga

SEQ ID NO: 1265 - DNA, 912 bp, Streptococcus pneumoniae
ttggaggttaggatgaaaaaactccccttagtattttcaggttgtttgctaggtttggcaggagctggaaatcttattttagatacgttgccggttctatcccatctttttagtctgactggtttggttttatggatttactttctaattctgcatctctttaattggaaagaaaccaagcaagaattgaccaagccccctcttttgtcaggaatggcaacctttcctatggctgggatgattttatcgacctatgtctttcgcgtattctcttatcttcctttggtagcacaagggatttggtggttttcatttctcttggatttgaccttgattgctggttttaccatcaagtttgcttgtccagggcggagggttcatgccactccaagttggacggttctctatgtggggatagcagtggctgccttgacctatcctctggtaggtattatcgaaattgcctatgcgaccttgagttttggttttctcttgaccttctatctctatccccttatttatagcgatttaaagaaacatccactcccactagccttgcttggacaagaaggaatctactgtgctcctttctctctactcttggcttctctagttcgagtaggaggaaccagcctgccgacttggggcttgattgtcatgattttggcttctcaatccttctttttctttgttttaactcgtatgcccaacattttaaaacaaggctttcaaccagccttctcagccctcaccttcccaaccattatcacagcgacctcgctcaagatggctcagggaattttgaaacttccatttctggattacctggtattggctgaaaccattatatgcctaactattttattctttgtactaggtgcttatctgatttggttacgaaaaaaggtctag

SEQ ID NO: 1266 - DNA, 207 bp, Streptococcus pneumoniae
aaggggatagagatagaaggtcaagagaaaaccaaaactcaaggtcgcataggcaatttcgataatacctaccagaggataggtcaaggcagccactgctatccccacatagagaaccgtccaacttggagtggcatgaaccctccgccctggacaagcaaacttgatggtaaaaccagcaatcaaggtcaaatccaagagaaatga

SEQ ID NO: 1267 - DNA, 549 bp, Streptococcus pneumoniae
atgacaacatttactatccatacagtagagtcagcaccagcagaagtgaaagaaattcttgaaacagtagaaaaagacaacaatggctatattcccaacctaatcggtctcttggccaatgccccgactgttttagaagcctaccaaattgtctcatctatccaccgtcgcaacagcctgacacccgttgagcgtgaagtggtgcaaatcacggcagccgtgaccaatggttgtgccttctgtgtcgcaggtcacacagccttttccatcaaacaaatccagatgaatgatgacttgattcaagctcttcgcaatcgtactccaattgaaacagatcctaaattggataccctagctaagtttaccttggcagttatcaataccaagggtcgtgtaggagatgaagccttgtctgagtttttagaagctggctacactcaacaaaatgccttggatgtggtttttggtgtcagcctagcaatcctctgtaactatgccaacaacttagctaatacaccaattaatccagaattgcaaccttatgcctaa

SEQ ID NO: 1268 - DNA, 1323 bp, Streptococcus pneumoniae
  unsure (448): n at each above location is unknown.
atgttagaattgcttaaatcaatcgatgattttgcttggggaccgcccctcttgattttattggtcggaacagggatttacctaaccatgcggctaggactcttgcaggttttgcgtctgcccaaggcctttcagcttatttttatccaggataagggacatggtgatgtatccagttttgcagctctgtgtacagccttggcatcaactgttggaacaggaaatatcataggagttgcgacggctatcaaggttggtggaccaggagctctattttggatgtggatggcggctttctttggaatggctaccaagtatgcggaaggactcttggccatcaaataccgcaccaaggacgaccatggtgcagtagcgggaggtcccatgcattatatccttctagggatgggagaaaagtggcgaccacttgctgttttgtttgcagtancaggagtattggttgctctcttgggaatcggaaccttcacccaagtcaactcgattacagaatctatccaaaatacaacgacgatttcgccagccatcacagctctcgtcttgtctgtctttgtagcgattgcagtctttggtggactcaagtctatttctaaggtttcaactactgttgttccttttatggccatcatttatatcttaggaactcttacagttattttctttaatatcggaaaaatccctggcacaatcgctttagtctttacctcagcttttagtccccttgctgcggtaggtggatttgctggtgctagcgttcggatggctattcaaaatggtgtggcgcgtggtgtgttctcaaacgaatctggtctgggttctgctcatattgcagctgcagctgccaagacaaatgaaccagtagagcaaggtttgatttccatgacaggaacctttattgataccctcatcatttgtactctaactggtttgaccatcttggtaactggagtttggagtggtgacttgaatggggttgccttgactcagtcagctttctcaacagtcttttcacactttggccctgccctcttgaccatcttccttgtgctttttgcctttacaacgattctaggttggaactattacggagaacgctgttttgagttcctctttggggttcgctttatctggctctaccgtgtggtttttgtgctcatggtcttgttaggaggatttatcgagttggatatggtctggattatcgcagatatcgttaacgccttgatggctctgccaaacttgattgccctcttggtcttgtcgccagtcgttattgctgaaactaaaaagtattttgacaaataa

SEQ ID NO: 1269 - DNA, 2337 bp, Streptococcus pneumoniae
atgaataagaaaatattagaaacattagagttcgataaggtcaaggccttgtttgagcctcatttgttgaccgagcagggcttggagcaattgagacagctggctccgactgccaaagcagataaaatcaaacaggcttttgctgagatgaaagaaatgcaggctcttttcgtcgagcaaccgcattttactattctctcaactaaggaaattgcaggagtctgcaagaggttggagatgggagcggatctcaatatcgaggagttcctactcttgaaacgcgtgcttcttaccagccgagaacttcaaagtttttacgccaatctggaaaatgtcagcttggaagaattagccctttggtttgagaaattacatgattttccgcaattacaaggaaatcttcaggcctttaatgatgcgggtttcattgaaaattttgccagtgaagaattggcgcgaatccgtcgaaaaatacatgatagcgagagtcaggtacgcgatgttttacaagacttgctcaagcaaaaagcgcagatgttgacggaaggaattgttgctagcagaaatggccgtcaggttttaccagtcaaaaacacctaccgcaataagattgcaggtgtcgttcatgatatttctgctagtggaaacaccgtctatatcgaaccacgtgaggtagtcaaactgagcgaagaaattgctagtctgcgagcagatgagcgctatgaaatgcttcgcattctccaagaaatttctgagcgtgtccgccctcatgcggctgagattgctaatgacgcttggattatcggtcatctggacttgattcgtgccaaggttcgatttatccaagaaagacaagcagtcgtgcctcagctgtcagaaaatcaagagattcaactgctccatgtctgccatcctttggtcaaaaatgccgtcgcaaatgatgtctattttggtcaagatttaacagctattgtcattacaggtcccaatacaggtgggaagaccatcatgctcaaaactctgggcttgacacaggtcatggcccagtcaggattgccgattttagcagacaagggaagtcgtgttggtatttttgaagaaatttttgctgatattggagatgagcagtctattgagcagagcttgtctaccttctctagccatatgaccaatatcgtggatattcttggcaaggtcaaccaacattcactcttacttttggatgagttgggggctggtactgatccccaagagggagcagcccttgccatggctattctggaggaccttcgcctgcgtcaaatcaagaccatggcgacgacccactatccagaactcaaggcctacggtattgagacagcctttgtgcaaaatgccagtatggagtttgatactgcaactcttcgcccgacctatcgctttatgcagggtgttcctggccgaagtaatgcctttgaaattgccaaacgtctaggcctatctgaagttatcgtaggagatgccagtcagcagatcgatcaggacaatgacgtcaatcgtatcattgagcaactagaagagcagacgctggaaagccgcaaacgcttggacaatatccgtgaggtggagcaagaaaatctcaagatgaaccgtgtgctaaaaaaactctacaacgagcttaatcgtgaaaaggaaaccgagcttaacaaggcgcgtgaacaggctgctgagattgtggatatggccctaagtgaaagtgaccagattctcaaaaatctccacagtaaatcccaactcaagccccacgaaatcattgaagccaaagccaagttgaaaaaattggctcctgaaaaagtggacttgtctaaaaacaaggtccttcaaaaggccaagaaaaaacgagctccaaaggtgggagatgatatcgtggttctcagttatggtcagcgtggtaccttgaccagtcaactcaaggacggtcgctgggaagcccaagttggcttgattaagatgaccttggaagagaaagagtttgatcttgttcaagcccagcaagaaaaaccagtcaagaagaaacaggtcaatgttgtgaaacgaacttctgggcgaggacctcaagctagactggatcttcgaggcaagcgctatgaagaagccatgaatgagctagatgccttcatcgaccaagccttgcttaacaatatggctcaagttgatatcatccatggtatcggaacaggagtcatccgtgaaggagttaccaaatacttgcaaagaaacaaacatgtcaagagtttcggctatgccccacaaaatgctggaggcagtggtgcgactattgtcacttttaaaggatag

SEQ ID NO: 1270 - DNA, 753 bp, Streptococcus pneumoniae
atggatagaggctatgaaagttacaatctcatggctcattttcaagaaaaaggttggctttatatcatccgtattcgagatggaaaacaatccatgccttcctccttcaacttgccaaatacggagtgttttgatcaaaaagtttctctaaaattatcacgaaagcaaactaatcagctcaaaaaactttatcgtgattttcccaatgactatcattttattccacacaattctatttttgattttcttccagaaacaagtcgaaaacaagatcctgtaacactctatgaacttccttttcgtatggtgcgtttagaagtggaagaaggaaaatacgaaactttagtgacgaatacagactattcagtccaagaattaaaaaatctctacgccagtagatggggcatagagactagttttcgtgacctgaaatacagtattggcttggtcaattttcacgccaaaaagaagggagggattctccaagaaatctttgctcgctttacaaattttaacttttgtcgttgggtaacctcgcaagttgccatcgacagtagtcacaaaaaacaaagatataaagtgtgtttctcagatgcggcttatgcctgccgtttgttttttaacggttccctttcttccctccagttgaaaaactacctcaagaaacagttatctattattcgaccgaatcgaaaatattcaagaaagataaaagctcaatcggtagttgatttcatctatagagtaacataa

SEQ ID NO: 1271 - DNA, 195 bp, Streptococcus pneumoniae; identical to SEQ ID NO: 728

SEQ ID NO: 1272 - DNA, 546 bp, Streptococcus pneumoniae; identical to SEQ ID NO: 729

SEQ ID NO: 1273 - DNA, 549 bp, Streptococcus pneumoniae
atgatttcattccttcttctattggtcttggtttggggattttatatcggctatcggagaggcctgctcttacaggtttattacctgatttcagccatggcatcggcttttatggctggccagttttataaggggcttggagagcaattccatttattgctcccttatgcaaattcgcaggaaggtcaggggactttctttttcccatcggatcaactctttcagctggataaggtcttttatgcaggtatcggctacttgcttgtatttgggattgtctatagcattggtcgtttgcttggtcttctcttacacttgattcctagcaaaaaactgggtggtaagttgttccaagtttcagcaggtatcttgtccatgttggtgaccttatttgtcttgcaaatggccttgacaatcttggcgaccatccccatggcagttatacaaaatcctcttgaaaagagtatcgtcgcaaaacacatcatccagagcataccgataacaaccagttggctcaaacaaatctgggtgacaaatttaatcggataa

SEQ ID NO: 1274 - DNA, 312 bp, Streptococcus pneumoniae
gtgaattttatggcaaatctaaatcgattcaaatttacattcgggaaaaaatcgttaaccttgacaagcgaacatgacaacctttttatggaggaaatcgctaaggttgcgacagaaaaataccaagcaattaaagaacaaatgcctagcgcagatgatgaaacaatcgctcttttgttggcagtcaactgtttatcaactcagctcagccgtgagattgaatttgacgataaggagcaagagctagaagaactccgtcacaagcttgtgacttgtaagcaagaacagagcaagattgaggattccttatga

SEQ ID NO: 1275 - DNA, 882 bp, Streptococcus pneumoniae
atggcaagtatcacactcacaccaagcgaaaaggatattcaggcttttcttgaacactatcaaaccagtctggctcctagcaagaatccctatatccgctactttttgaaactacctcaagcaacggtttctatctatacttctggaaaaatcttgcttcagggtgaaggggctgaaaaatacgccagtttctttggctatcaagctgtagagcaaaccagcggacaaaatcttcctttaattgggacagatgaggtgggaaatggttcctactttggtgggcttgcagttgtggctgcctttgtcacacctgaccagcacgactttttacgaaaactcggtgtgggggattctaagactctgaccgaccaaaagatccgtcagattgctcctattctcaaggaaaaaattcagcaccaggcactccttctctcacccagcaagtacaacgaggtcatcggagaccgctacaatgctgtttcggttaaggttgccctccataatcaggctatctatctcctccttcaaaaaggtgttcagcctgagaaaattgtgattgatgcctttaccagtgctaaaaattatgacaagtacttggcacaagaggccaatcgtttcagcaatcctatcagcttagaagaaaaggctgagggcaaatacttgtctgtcgcagtttcttctgtcattgcgcgtgatctctttctggaaaatcttgaaaatctgggacgagaactgggttatcagcttccaagtggagctggaacggcttctgacaaggtggctagccagattttgcaagcctatggtatgcagggactcaacttctgcgccaaattgcactttaaaaacactgaaaaagcgaaaaaacgcttagaaaggtaa

SEQ ID NO: 1276 - DNA, 615 bp, Streptococcus pneumoniae
atgaattcatttaaaaatttcttaaaagagtggggactgttcctcctaattctgtcattactagctttaagtcgtatctttttttggagcaatgttcgcgtagaaggacattccatggatccgaccctagcggatggcgaaattctcttcgttgtaaaacaccttcctattgaccgttttgatatcgtggtggcccatgaggaagatggcaataaggacatcgtcaagcgcgtgattggaatgcctggcgacaccattcgttacgaaaatgataaactctacatcaatgacaaagaaacggacgagccttatctagcagactatatcaaacgcttcaaggatgacaaactccaaagcacttactcaggcaagggctttgaaggaaataaaggaactttctttagaagtatcgctcaaaaagcccaagccttcacagttgatgtcaactacaacaccaactttagctttactgttccagaaggagaataccttctcctcggagatgaccgcttggtttcgagcgacagccgccacgtaggtaccttcaaagcaaaagatatcacaggggaagctaaattccgcttctggccaatcacccgtatcggaacattttaa

SEQ ID NO: 1277 - DNA, 279 bp, Streptococcus pneumoniae
ttggtgattctcggcctcttaggtttcttaaaatgttccgatacgggtgattggccagaagcggaatttagcttcccctgtgatatcttttgctttgaaggtacctacgtggcggctgtcgctcgaaaccaagcggtcatctccgaggagaaggtattctccttctggaacagtaaagctaaagttggtgttgtagttgacatcaactgtgaaggcttgggctttttgagcgatacttctaaagaaagttcctttatttccttcaaagcccttgcctga

SEQ ID NO: 1278 - DNA, 2367 bp, Streptococcus pneumoniae
atggaagtttatttttcaggaactattgaacggattatttttgaaaatcccagcaatttttatcgcatcctcctcctagaaatcgacgatacggacgcagaggattttgatgattttgaaatcattgtcacaggaaccatggctgatgtaattgagggcgaagactatactttttgggggcaaattgtccagcactccaagtatggagaacaactgcaaatcagtcgttatgatcgcgcaaaaccaactagtaagggcttggtcaagtacttttcaagtagccatttcaaggggattggtctcaagacagctcagaaaatcgtggatacctatggcgaaaataccattgacgaaattttgcaacacccagaaaagttagaaggcatcgcaggactctctgccaaaaatcgcgaggctttcgtctccactctccgtctcaactacggaacggagatgattttggccaaactagccaactacggcattcccaacaaactagcctttcagattcaagacttttacaaggaagaaacccttgatgtggttgaaaattatccctaccaactggttgaggatatcaagggtttgggctttaccattgctgaccaactagctgaggaactaggcatcgaaagtcaggctcctgaacgcttccgcgccggtctagttcacagtctttttcagacctgtatggaaacaggggacacctatgttgaagcacgggatttgctggaacaaacccttactctccttgagtcttcccgtcccgtggaactagaccccagccaagttgcccaagagctctcctacctgatcgaagaagacaaggttcagcagattgataccaagatctttgacaacagcctctttttcgctgaggaaggtatccgcagtcacttgattcgtatccttgaaaaaggaaaacagaagagccaagatttagaaactattcaaaagcatatcactactgtcgagcaagaactggggattgagtatgataacattcaaaaacaagctatttgtgacgctatccagaacaaggtctttatcctgacaggtgggcctggtactggtaagacaactgttatcaatggaatcatcgctgtttatgcccttttagaaggacttgacttcaggaagaaaaacaatctgcccattcttcttgctgctccaactggtcgagctgctcgtcgcatgaatgaattgacaggtttgcctagcgcgaccatacatcgccacttgggaatgacaggtgacgatgataccagtcatctggaagattacctagatgctgactttatcatcgtggatgaattctctatggtggatacttggctggccaatcaactcttctccaatatctcttctaacagtaagatcctcatcgtaggtgacagtgatcagctaccttctgtcagtcctggacaggttctagcggatctgcttcatattcctttgattcctcagactcgcttggaaaaaatttatcgacaaagcaaagaatcaaccatcgtcaccctagctagtcagattcgacagggcatcttgccagctgatttcacccaaaaaaaagctgaccgttcctactttgaaattgctagtggccatattcctgccaccattgaaaaaatcttaggtgccgccctcagaaatggtattcctgcccgtgatatccaagttctggctcctatgtaccgagggacggcagggattgatgctatcaatcagctcatgcaagacctgctcaatcccccacaaaaagatcaactcagttttgaagctcctcagtgccactatcgtaagagagacaaggtcattcatttggttaacgatgctgaaatcaatgtctttaatggggatttaggagctatcacagacctgattcctggtaaatacaccgaatcgaaacaagacgagattgtcattgattttgatggtaatgaagtctcttacccccgtaacgaatggtacaagattcgcttggcctatgccatgagtattcataagtctcagggaagtgagttcccagttgtcatcctaccgattactagtgctagccgacgtatgctggagcgaaatctcatctacacagccattacacgtgccaaaagcaaactcatcttactaggcgaattacaagccttcgactatgctacccaacacatcggaactgcccgaaaaacctatctgattgaacgcttcagtgatctactggagaatgttgaagaaaagcaacaagctgtctctgaaacagtcacatcaagtgcctctgaacaatcctacatcctaaccgaagaaaactgggaccgcatcccagccatgattgggattacagacacagacctcaaagagatttttggaaaatag

SEQ ID NO: 1279 - DNA, 1284 bp, Streptococcus pneumoniae
atgtctgtatcatttgaaaacaaagaaacaaaccgtggtgtcttgactttcactatctctcaagaccaaatcaaaccagaattggaccgtgtcttcaagtcagtgaagaaatctcttaatgttccaggtttccgtaaaggtcaccttccacgtcctatcttcgataaaaaatttggtgaagaatcactttaccaagacgttatgaacgctcttttgccaaacgcttatgaagcagctgtaaaagaagctggtcttgaagtggttgcccaaccaaaaattgacgtaacttcaatggaaaaaggtcaagactgggttatcgctgctgaagtcgttacaaaacctgaagtaaaattgggtgactataaaaaccttgaagtatcagttgatgtagaaaaagaagtaactgacgctgatgttgaagagcgtatcgaacgcgaacgcaacaacctggctgaattggttatcaaggaagctgctgctgaaaacggcgacactgttgtgatcgacttcgttggttctatcgacggtgttgaatttgacggtggaaaaggtgaaaacttctcacttggacttggttcaggtcaattcatccctggtttcgaagaccaattggtaggtcactccgctggcgaaaccgttgatgttatcgtaacattcccagaagactaccaagcagaagaccttgcaggtaaagaagctaaattcgtgacaactatccacgaagtaaaagctaaagaagttccagctcttgacgatgaacttgcaaaagacattgatgaagaagttgaaacacttgctgacttgaaagaaaaataccgcaaagaattggctgctgctaaagaagaagcttacaaagatgcagttgaaggtgcagcaattgatacagctgtagaaaacgctgaaatcgtagaacttccagaagaaatgatccatgaagaagttcaccgttcagtaaatgaattccttgggaacttgcaacgtcaagggatcaaccctgacatgtacttccaaatcactggaactactcaagaagaccttcacaaccaataccaagcagaagctgagtcacgtactaagactaaccttgttatcgaagcagttgccaaagctgaaggatttgatgcttcagaagaagaaatacaaaaagaagttgagcaattggcagcagactacaacatggaagttgcacaagttcaaaacttgctttcagctgacatgttgaaacatgatatcactatcaaaaaagctgttgaattgatcacaagcacagcaacagtaaaataa

SEQ ID NO: 1280 - DNA, 1137 bp, Streptococcus pneumoniae
atgaaacattctgttcattttggtgccggtaatatcggtcgtggttttataggtgaaattctatttaaaaatggtttccatattgattttgtggatgtcaataatcagataatttatgctctaaatgaaaagggcaagtatgaaattgaaattgcacagaaaggacagtctcgtatagaagtaactaatgtggctggcattaatagcaaagaacatcctgagcaagtcattgaagcgattcaaaagacggatattattactactgcaatcggacctaatatactcccttttatcgctgaacttctagccaaaggaatcgaagctcgccgagttgcaggaaatacacaggcattggatgttatggcctgtgaaaatatgattggcgggtctcaatttctttatcaagaagtcaagaaatatttaagtccggaaggtttgacatttgctgataactacataggttttccaaatgctgcagtagacaggattgttccaacacaaagtcacgaagattccctttttgttatggtcgagccctttaatgaatgggtcgtggaaaccaagcgtcttaaaaatccagatttacgtctaaaagatgtgcattatgaagaagatttagaaccctttattgagcgaaaacttttttcagtcaattctggacatgcaacttcagcttacattggtgcgcattatggtgccaagacaattttggaagctcttcaaaatcctaatatcaaatctcggattgaatctgtattagctgaaattcggagtctcttgattgccaaatggaactttgataaaaaagaattggagaattatcacaaagtcattatagaacggtttgaaaatcctttcatagtggacgaggttagtcgcgtagctcgtactccaatccgaaaattaggctataatgaacgattcatccggccgatacgtgaattgaaagaactcagtttgtcatataaaaacctacttaaaacagttggctatgcctttgactatcgcgatgtaaatgatgaagaaagtattcgattaggtgaattgttggctaaacaatcagtcaaagatgttgttatacaagttacaggtttagacgaccaagaattgattgagcaaattgtagagtatatttaa

SEQ ID NO: 1281 - DNA, 438 bp, Streptococcus pneumoniae
atgaaacttgaaaaacatttgattaagcttaataaacaattttctaacaaggaggaagctatttgttattgtgggcaagttctttatgagggtggatatgttaatgaagactatattgaagccatgattgagcgagataaagagctatctgtttacatgggtaactttatcgccataccgcatggaacagatgcagcaaaaaaggatgtcctcaagtctggtattacagtcgttcaagtccctagaggggttgattttgggaatgtatctaaccctcaagtggcaacggttctttttggtattgctggtattggtaatgaacacttagaaattattcagaaaatttctatcttctgtgcagatgtagataatgttcttaaactagcagatgctcagtcaaaagaggaagtattgcgcttatttgatgctgttgaataa

SEQ ID NO: 1282 - DNA, 1956 bp, Streptococcus pneumoniae
atgctattaaccaaacgagaagaacaattattgaaggctttcctacatgtagggaagctttcaatgcaagatatgactgaaatcttacaggtttcatctagaacaatttatcgaactttatcagatttgacagatagcatggagcaatatggaatcgaaataacgaagcatgggaaatactatattttgactggagagttggatgatttgccgacagaacttgaagtgttagttgagtatagtccccaagaaagacaagagttgattacctatcgccttctgactgagagtggttttgtcaccaatgaagcattgcaagagtgcacgaaagtcagtaatgtaactattattcaggatatttcagatattgataagcgtcttttagactttgatctgaaaattgaacgacaaaaaggttatcggatttctggtgattcagttggtaagagaagatttttggctattttactgacaaactgtatctcagtagcagatttttcaaccggtaattttgggagctttgatattttagaagcagatagaactaggctggccagtcagattgttaataagcaactgtcaggttttccagatatggatgctaggatgaagatgttttttgcgatcttgttatctcttataggtcaggagcaaaacattgaaaattcacctaatactagtaagcaggctttggaaatttctcaaaaaatttttcaagcttactctaagcagactgcacaattttatagtattcaggaaattatctattttgcgagcatcttggatgaattaatcattaaacgtcaggacaatccgctctttacggagaaatttgatggtgaatttttctacaatatttcaaatctgattgatacggtttccatgtataccaagattgacttttttaaggacaaggttttattcaattttcttttccatcatattcggctcagtttaggcgtccctatcctttttcagagtgaaaatttgccagaatctgtccagattttagttgaaaggaataaatttctttatacagtcatcagtcttttagtgaatgatatttttccgaaatatcttcatacagactatgagtatggcatgattgccctacattttatctctagcttaggccgtagtccagagatttatccagtccgtgttttgcttttaacggatgaacgtcgggtcactagagatttattagtcagtaaaattaagagtgttgctccttttgtagagttgatagatattcagtctctagtagattaccacagtattgatctcagtcagtatgattatattttatctaccaagccgctgactaatcaggaaatcgatgtaatttctagttttccaaccgtcaaagaattgcttgaattacaggaacgacttcagtatgtacaggcacatcgtacaattgtcgcgcgtgatgctatcgctccagagaaaagttatgacttgcaagattatttaatatctagtagtcagcttttgagtcaattcgagttggttcaattggagaataatcaatcatttgagcatacggtagaacaaatcatccaatatcagaagaatgtgagtgacagagattacctaacaagaaaattgttatctcacttccagaatagtcctatggctattcctaatactggtctggtgcttttacatagtcagtctagcaaagtaacaacaaatagttttactatgtttgaactcaaactacctatctccgcattgtcaatgaaacgagaggaagaagaggtcaaaaggtgtctgctaatgctaatgtctaaagaagctagcgaggaagcgagagatttaatgacagctatcagtcagtcgattattgaaaatcatctttatacagagatttacaagacgggaaatcaatccattatttatcagatgctaaatactatttttaacgaaaaaattaagaaattggagaactaa

SEQ ID NO: 1283 - DNA, 1788 bp, Streptococcus pneumoniae
gaaaaggaggatgatctaatggaagaaaaagtatcattgaaagtcagggttcaaaaactagggacatcgctttcaaatatggttatgcccaatattggagcatttattgcttggggagtattgactgccctttttatcgctgatggttatctgccaaatgaacagttagctactgttgttggtcctatgttaacgtatttattgccaatcctgattggttacacaggtggatatatgatccatggccaacgtggtgccgttgtaggagctattgctactgttggtgcaatcacaggttctagtgttcctatgtttatcggagctatggtaatgggcccactgggaggatggactatcaagaaatttgatgagaagttccaggaaaaaattcgtcccggatttgaaatgttagttaataacttctcagctggtctcgttggttttgcattattgcttttggctttctacgcaatcggtccagtcgtatcgactcttactggagctgttgggaatggtgttgaggctattgtcaatgctcacctccttcctatggctaatattatcatcgaaccggctaaagtccttttcctcaataatgccctcaatcatggcatttttactcctctgggagtagaacaggtagctcaagctggtaagtcaattctcttcctattggaagctaatcctggaccaggcctgggaattctattaacttatgctgtattcggtaaaggttctgctaaatcttcttcttggggggcaatggttattcatttcttcggagggattcatgaaatttactttccttatgttatgatgaagcctactctatttttagctgctatggcaggaggtatctctggaacttttacttttcaactcttagacgctggtcttaaatctccagcttcaccaggttctattattgcgattatggctacggcgccaaaaggtgtttggccccatctaaatgttcttttaggtgttttagtggcagcagttgtttctttccttgtagcagcccttattcttcatgcagacaagtcaactgaggattcgctcgaagctgctcaggcggctacccaagcagctaaggctcagtctaaaggtcagttagtatcaacttctgttgatgcagttgtttcgacagactcagtggaaaaaatcattttcgcctgcgatgctggtatgggaagctctgctatgggagctagtattcttcgagataaggttaaaaaagcaggtctagagattccagtatctaatcaggcaatctcaaatttgcttgatacaccaaaaacattaattgttactcaggaagaactgacaccaagagctaaagacaagagtccaagtgctattcatgtttctgttgataatttcttagcgtcccctcgttatgatgaaattgtagcttcattaacaggagcttctccaatagcagaaattgaaggagatataccaacttcagcaccagtagatagtcaggaaattgaccttaaccatattgatgctgtagtagttgcttatggtaaagcacagggaactgcaactatgggctgtgaaacgattcgggctatctttagaaacaagaatattcgtattccagtttctactgccaaaatttcagaattaggtgaatttaattctaaaaatataatgattgtaacaactatttctttacaggcagaagtgcagcaagcagcaccgaattctcaatttcttattgtggatagtttagtaacaacaccagaatatgacaaaatggctgctagaatgtacaaatag

SEQ ID NO: 1284 - DNA, 201 bp, Streptococcus pneumoniae
ttgagctacctgttctactcccagaggagtaaaaatgccatgattgagggcattattgaggaaaaggactttagccggttcgatgataatattagccataggaaggaggtgagcattgacaatagcctcaacaccattcccaacagctccagtaagagtcgatacgactggaccgattgcgtagaaagccaaaagcaataa

SEQ ID NO: 1285 - DNA, 573 bp, Streptococcus pneumoniae; identical to SEQ ID NO: 19

SEQ ID NO: 1286 - DNA, 834 bp, Streptococcus pneumoniae
atgactgagttttcgttagatcttcttctaaaagtcattaaactagctcgttcgacctactactatcacttgaaacagctagacaaaacagataaggaccaagagcttaaagctgaaattcaatccatttttatcgaacacaagggaaattatacttatcgccgggttcatttagaactaagaaatcgtggttatctggtaaatcataaaagagttcaaggcttgatgaaagtactcaatttacaagctaaaatgcgacagaaacgaaaatattcttctcataaaggagacgttggcaagaaggcagagaatctcattcaaagccaatttgaaggctctaaaacaatggaaaagtgctacacagatgtgacagaatttgccattccagcaagtactcaaaagctttacttatcaccagttttagatggctttaacagcgaaattatcgcctatcatctttctacttcgcccaacttagaacaagtacaaacaatgttggaacaggcattcacagagaagcactacgagaatacgattctccatagtgaccaaggctggcaatatcaacacgattcttatcatcggttcctagagagtaagggaactcaagcatccatgttacgcaagggaaacagccaagacaacggtatgatggaatctttctttggcattttaaaatcggaaatgttttatggctatgagaaaacatttaaatcacttaatcaattggaacaagccattatagactatattgattattacaacaacaagagaattaaggtaaaactaaaaggacttagccctgtgcaatacagaactaaatccttcggataa

SEQ ID NO: 1287 - DNA, 1023 bp, Streptococcus pneumoniae
atgaagctttttaaaaaaatgatgcaagtcgtactagccacatttttcttcggtttgctagggactagtacagtatgtgcagatgattctgaaggatggcagtttgtccaagaaaatggtagaacctactacaaaaagggggatctaaaagaaacctactggagagtgatagatgggaaatactattattttgatcctttatccggagagatggttgtcggctggcaatatatacctgctccacacaagggggttacgattggtccttctccaagacaagagattgcttttagaccagattggttttactttggtcaagatggggtactacaagaatttgttggcaagcaagtgttagaagcaaaaactgctacaaataccaacaaacatcatggggaagaatatgatagcccagcagagaaacgagtctattattttgaagatcagcgtagttatcatactttaaaaactggttgggtttatgatgatggggactggtattatttgcagaaggatggtggctttgattctcgcatcaacagattgacggttggagagctagcacgtggttgggttaaggattaccctcttacctatgatgaagagaagctcaaacctgctccatggtactacctagatccagcaactggcatcatgcaaacaggttggcaacatcttggtaataaatggtactatctccgttcatcaggagctatggcaactggctggtatcaagatggttcaacttggtactatttagatgctgaaaatggcgatatgaaaactggttggcaaaaccttgggaacaaatggtactatctccgttcatcaggagctatggcaactggttggtatcaggaaggttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaagtaa

SEQ ID NO: 1288 - DNA, 294 bp, Streptococcus pneumoniae
atgaacgaaatttgtcatttatttatttattcggttcttaaaggttactctcttgaaggatggaagaaaataaatggtagttggtactattatagacaacatgataaacaaacgggttggcaggagataaatgatacttggtattatttagacagttccggtaagatgcttacagattggcaaaaagtaaatggaaaatggtattatctcaattcaaatagagcaatggttacaggtagccaaactatcgatggtaaagtttataacttcgcttcatctggtgagtggatttga

SEQ ID NO: 1289 - DNA, 657 bp, Streptococcus pneumoniae
ttgattaaaattgataatactttacagtatccgtattcgacttcagctatggttttatctaagtattatggagtagccgatggaatgaatgtagaagggaggggaagtgcgaattttattaaagataatgtgttaattacagcggctcacaactactacagacatgactatgggaaagaagcggatgatatttatgttcttccggctgttagtccaagtcaagaaccatttggaaagatcaaagtaaaggaagttcgttatttgaaggaatttagaaatttaaattctaaggatgcaagggaatatgacttggctttattaattctagaaaagcccattggtgcaaaattagggactttgggtcttcctactagtcaaaaaaatttgacaggaataactgtgactatcacaggctatccatcatataattttaaaatttatcaaatgtatacagataaaaaacaagttttaagtgatgatggcatgttcttggattaccaagttgatactttagaggggtctagtggatctacagtttatgatgctagtcaccgtgtagtaggagtgcatactttaggagatggagctaatcaaattaacagtgcagttaaattaaatgaacgaaatttgtcatttatttatttattcggttcttaa

SEQ ID NO: 1290 - DNA, 240 bp, Streptococcus pneumoniae
atgaagaaaactgtttataaaaaattgggtatttcaattattgcgagtactttattggctagccagttatcgacagtatctgctttgagtgttatttctagtacaggtgaagaatatgaggtaagtgagacactagaaaaaggtccaggatctaatgattcttcattatctgagatttcaccaacatatggttcatactaccaaaagcaatcagaagtattatcggtaatgatgatttga

SEQ ID NO: 1291 - DNA, 273 bp, Streptococcus pneumoniae
ttgagtataaaatggagcctattagataatatctggctgagacgtgtcgctattgaccaccagttgttaagaaaagagaagaccaatactcaattaatggaaaaaattctacttcataacttgaaccaaacagaattttttatcaataaagccattggctggactctgcgagcctactccaaaacgaaccccacttgggtagcatgctttattgatgaaaacaaggaaagaatggctgaacttagtatcaaagaagcaagcaagtacctctag

SEQ ID NO: 1292 - DNA, 255 bp, Streptococcus pneumoniae
gtggctgctaactatttgaaagcaatgcagtcttatctaaaggaaaccgatttgcctaagctagagcagttagtcgtgacaaaatcctggtgggacacggtagatatcctagatcgagtagtagggagtttggtgtatgaacaccctgaactagaagaaataatcttaatactcttcgaaaatctcttcaaaccacgtcagctctatctgcaacctcaaaacagtgttttgagcaatctgcggctagcttcctag

SEQ ID NO: 1293 - DNA, 633 bp, Streptococcus pneumoniae
atgaaaattttactagtagatgaccatgaaatggtccgtttgggtttgaaaagctactttgacctccaagacgatgtagaagttgtgggtgaggcgttcaacgggtctcaagggattgacttggccttggaactgcgtccagatgtcattgtcatggatattgtcatgcctgagatgaatgggattgacgcgaccttagcaatccttaaagaatggcctgaagccaagattttgattgtgacctcttatttggacaatgaaaaaatcatgccagtcttagatgctggtgccaaaggctatatgctcaagacttctagtgcagatgaattgcttcatgccgtcagtaaggtagctgctggcgagctggccattgagcaagaggttagcaagaaggttgaataccaccgcaatcatatggaacttcatgaagaattgactgcgcgtgagcgagatgttctccaactcatcgccaagggctacgaaaatcagcgcatcgcagatgacctctttatctctctcaagacggtcaagacccacgtgtccaacattcttgccaaacttgaagtcagcgatcgtacccaggcggctgtctatgcctttcagcaccatttggtggggcaagaggagttttag

SEQ ID NO: 1294 - DNA, 996 bp, Streptococcus pneumoniae
atgaaaaaacaagcctatgtcattattgctctcacctccttcctatttgtcttttttttctcccacagcttgctggaaatacttgattttgactggtctatctttttgcacgatgtcgaaaaaacagaaaaatttgtctttttattgttggttttcagcatgtccataacctgtctcttagccctgttttggcgagggatcgaagagctttctctaagaaaaatgcaggctaatctcaagcgtttattggcagggcaagaagtggttcaggttgcagatccagatttggatgccagtttcaagtccttatcaggtaaacttaaccttttgacagaagctcttcaaaaagctgaaaatcatagccttgctcaggaagaggaaatcatcgagaaagaacggaagcgaattgctcgggatttgcacgatacagtcagtcaggagttgtttgcggcccacatgattttatcgggtatcagtcagcaggctttgaaattggatagagaaaagatgcagatccagttgcagagtgtcacagctattttagaaactgcccagaaggatttgcgggttttgctcttgcatttgcgaccagttgaactggagcagaagagcttgatagaagggattcagattctcttaaaagagcttgaggacaagagtgatcttagggttagtctcaagcagaatatgacgaaattgcctaagaaaatcgaggagcatatcttccgtatcctgcaagagttgattagcaatacgctccgccatgcccaggcatcttgcctagatgtctacctctatcagacagatgttgaattgcaactgaaggtggtggacaatgggattggtttccggttagggagcttagacgacttgagttatggactgcgaaatatcaaggagagggttgaagatatggctggaacagttcaactcttgacagctcccaagcaagggctggcagttgatatccgtattcccctgttagataaggaatga

SEQ ID NO: 1295 - DNA, 699 bp, Streptococcus pneumoniae
atgagaaaatttaaaatctttttatttatcgaagcctgtcttctgacaggagctctgattttgatggtatcagagcatttttcgcgttttctgctgatactattcctctttttgcttttgattcgctactacactggtaaagagggaaataatcttcttttagtagcggcaaccattctcttctttttcatcgttatgctcaatccttttgtgattctagctatttttgttgcggttatctatagcctctttcttctttacccgatgatgaaccaggaaaaagagcagaccaatttggtttttgaagaggtcgtgacggttaagaaggagaaaaatcgttggtttggaaatcttcatcatttttcaagctaccagacttgccaattcgatgatatcaatctctttcgcttcatgggcaaggacactattcatctggagagggtcatcttaaccaatcatgacaatgtcattatcctcagaaagatggtaggaacgaccaaaatcatcgtacctgtagatgtggaagtcagtctcagcgttaactgtctctatggggatttgacttttttcaaccagcccaagcgagccctccgcaatgaacactatcatcaagaaacaaaagactatctcaagagtaacaagagtgtcaagattttcttgaccactatgattggtgatgtggaggtggttagaggatga

SEQ ID NO: 1296 - DNA, 1011 bp, Streptococcus pneumoniae
atgacgacaaatcgtaaggacgagcatatcctctatgcccttgagcagaaaagttcctataatagctttgatgaggtggagctgattcattcttccttgcctctttacaatctggatgaaatcgatctttcgacagagtttgctggtcgaaagtgggactttcctttttatattaatgccatgactggtggaagtaataagggaagagaaatcaatcaaaagctggctcaggtggcggaatcctgtggtattttatttgtaacgggttcttatagcgcagccctcaaaaatccaacggatgattctttttctgtcaagtctagtcatcccaatctcctccttggaaccaatattggattggacaagcctgtcgagttaggacttcagactgtagaagagatgaatcctgttctattgcaagtgcatgtcaatgtcatgcaggaattactcatgcccgagggagaaaggaagtttagaagctggcaatcgcatttagcagattatatcaagcaaattcccgttcctattgtcctcaaggaagtgggctttggaatggatgccaagacaatcgaaagagcctatgaattcggtgttcgtacagtggacctatcgggtcgtggtggcaccagctttgcctatatcgaaaaccgtcgtagtggccagcgtgattacctcaatcaatggggtcagtctaccatgcaggcccttctcaatgcccaagaatggaaagataaggtcgaactcttggttagtggaggggttcggaatccgctggatatgattaagtgcttggtttttggtgctaaggctgtgggattgtcacgaaccgttctggaattggttgaaacctacacagttgaagaagtgattggcattgtccaaggctggaaagcagatctacgcttgattatgtgttcccttaactgtgccaccatagcagatctacaaaaagtagactatcttctttatggaaaattaaaagaagcaaaggatcagatgaaaaaggcgtaa

SEQ ID NO: 1297 - DNA, 1008 bp, Streptococcus pneumoniae
atgattgctgttaaaacttgcggaaaactctattgggcaggtgaatatgctattttagagccagggcagttagctttgataaaggatattcccatctatatgagggctgaaattgctttttctgacagctaccgtatctattcagatatgtttgatttcgcagtggacttaaggcctaatcctgactacagcttgattcaagaaacgattgctttgatgggagacttcctcgctgttcgcggtcagaatttaagacctttttccctaaaaatctgtggcaaaatggaacgagaagggaaaaagtttggtctaggttctagtggcagcgtcgttgtcttggttgtcaaggctttactggctctctataatctttcggttgatcagaatctcttgttcaagctgactagcgctgtcttgctcaagcgaggagacaatggttccatgggcgaccttgcctgtattgtggcagaggatttggttctctaccagtcatttgatcgccagaaggtggctgcttggttagaagaagaaaacttggcgacagttctggagcgtgattggggattttttatctcacaagtgaaaccaactttagaatgtgatttcttagtgggatggaccaaggaagtggctgtatcgagtcacatggtccagcaaatcaagcaaaatatcaatcaaaattttttaagttcctcaaaagaaacggtggtttctttggtcgaagccttggagcaggggaaagccgaaaaagttatcgagcaagtagaagtagccagcaagcttttagaaggcttgagtacagatatttacacgcctttgcttagacagttgaaagaagccagtcaagatttgcaggccgttgccaagagtagtggtgctggtggtggtgactgtggcatcgccctgagttttgatgcgcaatcaaccgaaaccttaaaaaatcgttgggccgatctggggattgagctcttatatcaagaaaggataggacatgacgacaaatcgtaa

SEQ ID NO: 1298 - DNA, 1035 bp, Streptococcus pneumoniae
ttgtatcatagccttggtaaccaatttgacacacgcacaagaactagcagaaagattagaagagaaaggagctgttcagacatggatagagagcctgtaacagtacgttcctacgcaaatattgctattatcaaatattggggaaagaaaaaagaaaaagagatggtgcctgctactagcagtatttctctaactttggaaaatatgtatacagagacgaccttgtcgcctttaccagccaatgtaacagctgacgaattttacatcaatggtcagctacaaaatgaggtcgagcatgccaagatgagtaagattattgaccgttatcgtccagctggtgagggctttgtccgtatcgatactcaaaacaatatgcctacggcagcgggcctgtcctcaagttctagtggtttgtccgccctggttaaggcttgtaatgcttatttcaagcttggattggatagaagtcagttggcacaggaagccaaatttgcctcaggctcttcttctcggagtttttatggaccactaggagcctgggataaggatagtggagaaatttaccctgtagagacagacttgaaactagctatgattatgttggtgctagaggacaagaaaaaaccaatctctagccgtgacgggatgaaactttgtgtggaaacctcgacgacttttgacgactgggttcgtcagtctgagaaggactatcaggatatgctgatttatctcaaggaaaatgattttgccaagattggagaattaacggagaaaaatgccctggctatgcatgctacgacaaagactgctagtccagccttttcttatctgacggatgcctcttatgaggctatggactttgttcgccagcttcgtgagaaaggagaggcctgctactttaccatggatgctggtcccaatgttaaggtcttctgtcaggagaaagacttggagcatttatcagaaattttcggtcagcgttatcgcttgattgtgtcaaaaacaaaggatttgagtcaagatgattgctgttaa

SEQ ID NO: 1299 - DNA, 879 bp, Streptococcus pneumoniae
atgacaaaaaaagttggtgtcggtcaggcacatagtaagataattttaataggggaacatgcggtcgtttacggttatcctgccatttccctgcctcttttggaggtggaggtgacctgtaaggtagttcctgcagagagtccttggcgcctttatgaggaggataccttgtccatggcggtttatgcctcactggagtatttggatatcacagaagcctgcattcgttgtgagattgactcggctatccctgaaaaacgggggatgggttcgtcagcggctatcagcatagcggccattcgtgcggtatttgactactatcaggctgatctgcctcatgatgtattagaaatcttggtcaatcgagctgaaatgattgcccatatgaatcctagtggtttggatgctaagacctgtctcagtgaccaacctattcgctttatcaagaacgtaggatttacagaacttgagatggatttatccgcctatttggtgattgccgatacgggtgtttatggtcatactcgtgaagccatccaagtggttcaaaataagggcaaggatgccctaccgtttttgcatgccttgggagaattaacccagcaagcagaagttgcgatttcacaaaaagatgctgaaggactgggacaaatcctcagtcaagcgcatttacatttaaaagaaattggagtcagtagccctgaggcagactttttggttgaaacgactcttagccatggtgctctgggtgccaagatgagcggtggtgggctaggaggttgtatcatagccttggtaaccaatttgacacacgcacaagaactagcagaaagattagaagagaaaggagctgttcagacatggatagagagcctgtaa

SEQ ID NO: 1300 - DNA, 330 bp, Streptococcus pneumoniae
atgacacgcaaagtatatgatactgatttaaacgatcaagaatgggctaagattgaaccctatttctccaaacaccgcacctataaatggccgaaacgagtacttgttaatgagactttgtacgtcactaaaacaggttgtcaatggcgcatgctccctcacgactttcctctttacttaatggtatggagtttctttcgtcgttctatgacgacaggttggttccaggtcaatggcagatggtactacgcttatagctcaggtgccttggcagtgaatacgaccgtagatggctattctgtcaactataatggtgaatgggttcggtaa

SEQ ID NO: 1301 - DNA, 876 bp, Streptococcus pneumoniae
ttgtaccccccagaactggattctaaaatactctctatcatcaagaaggcagtgacaattagaacgacacatacatatgaatatcaatactcactgctatttggtgatgcaggctatctatggttactcctacatttattttctatcagtaaaaatcaatactatctacaattagcaaacgtcaccgctaaaaaattaatagagaattatgatactctagaggaaatagactttgcattgggaaaatctggtgtcctattatcattaataaaatactatcaatttaccaatgacaatactcttaaaattttcatccacaatagtataggggaaatttatcattatttcctacaaagagatacagccaaagaaagcattttagactatagctttgctcatggatattgtggaattgcatatgctttatttgcctattctaaagtcttagaaccttctatgttctataatgatctccatacattccatactgaattaaaaaaattattagaaaaagttacttctaatactgaaaatttaggaaatttacaactttcttggtgcaaaggaatttccggaataatcttatatctttgtatgtacgattgtgacggaaacaaagatattattagtaaatatcaagaatttgtttttaaccatcatctaaaaatgatgacaggatattgccacggaataactagcttactacaaaccactgtctacaatcaaaacaaattactgatgaaaaaaatccaacaggtaattttagcatgttctgaacgagatgatcacggtttactgatgtttcaaggagatagtggtaaagcagatttgtttgacttcggaataggaagcatggggtatattggtgtctattaa

SEQ ID NO: 1302 - DNA, 1233 bp, Streptococcus pneumoniae
atgaaattattttggacaaacaacatatatagacagttgctgctaaacagctgtttttcatcattcggcgacagtattttctacctcgccattatcaattatgtggctcagtacaatttcgctccgctagcgattttactgatttccatttcagagatggttcccctactatcgcaactctttctcgggattctaggagattttcaagaaaatagagtcaaacacgcactctggattgccaaaatcaaaatcctgctctacgctattttgacagtatttctcgtcttgtcgcccttttcattagtttcagtcattatgattgtcatcatcaacctcatctctgacaccttgagctacctgtctgcctacatgatgaacgccctctacatcagtgtaattaaggacgacctgcatgatgccatggggttcaggcagtctctgatgagggttgtccgtattgtcgccaatctggctggcgcattccttatcaatgttataagtattcaaactatttcccttatcaacactctgacttttgtcattgcctttttgggcctgtatgttattcgacataccttgtatgaggttgaaaaaagaattgaaatgtcacatacagcactgagttttaagaaatattttcaacatcttaaacagtcgctggctgtgctcctgaggttaaaagataccgtcatactactgtttctgacgaccagtatgattgccatcttggatgtgtcccctcggctgattgccctccgcttcatccaacagacactagcacaactgagcattgggcaactcctcgccctgctctccatcatcatgtcttgtggagctatccttggcaatatgaccagcagtaatctatttaaaaatatccgtttcacgcacctcttggttttctgtgagatttccctattgactctaataactagtatcctttgtcaagcctatatcgtaattttcatgaccagtttcatcagttctacgattatcggcattctcagccctcgcctacaagcagctgtctttgcccatatccccagtgacaagatggggacggtgggctctgctctgagcacagtggacattctcgccccgtccctgctctccctattagccctatccatagcatcgggcgtttcggtgcagttagcattgatatttttgtatcttattttaattgctcttatcttttgtcaatggttagtcaagttcaacactcataactaa

SEQ ID NO: 1303 - DNA, 999 bp, Streptococcus pneumoniae
atgaagcttttgaaaaaaactatgcaagctggactaacagtaattttctttggtttgctagctacgaatacagtatttgcagataactctgaagtatggcagtttgtccaagaaaacggtagaacctattacaaaaagggggacctcaaagaaacctactggcgagtgattgatggtaagtactattattttgattctctatctggagagatggttgtcggctggcaatatatcccgtttccatctaaaggtagtacaattggtccttacccaaatggtatcagattagaaggttttccaaagtcagagtggtactacttcgataaaaatggagtgctacaagagtttgttggttggaaaacattagagattaaaactaaagacagtgttggaagaaagtacggggaaaaacgtgaagattcagaagataaagaagagaaacgttattatacgaactattactttaatcaaaatcattctttagagacaggttggctttatgatcagtctaactggtattatctagctaagacggaaattaatggagaaaactaccttggtggtgaaagacgtgcggggtggataaacgatgattcgacttggtactatttagatccaacaactggtattatgcaaacaggttggcaatatctaggtaataagtggtactacctccgttcctcaggagcaatggccactggctggtatcaggaaggtaccacttggtattatttagaccagccaaatggcgatatgaaaacaggatggcaaaaccttgggaacaaatggtactatctccgttcgtcaggcgccatggtgactggctgggtgaaagatgactcaacttggtattacctaaatgcaggtaatggagacatgaagacaggttggttccaggtcaatggcagatggtactacgcttatagctcaggtgccttggcagtgaatacgaccgtagatggctattctgtcaactataatggcgaatgggttcggtaa

SEQ ID NO: 1304 - DNA, 1113 bp, Streptococcus pneumoniae
ttgcagttgtgtaactgcttttttgaggagtttttatatattgacatacaatctagtttttactacaatcgttttaggaggatatataaaatgaagcttttgaaaaaaatgatgccaatcgcattagcagtctttttctttggtttgctagcgacaagtacagtatttgcagataccatgggtggccgatttgttgataaggataatagaaaatattatgtaaaagatgatcataaagcaatctattggcataaaatagacggtaaaacttactattttggtgatattggagagatggttgtcggttggcaatacttagaaattcatggaacaggttatcgtgatgatttatttgataatcgtccagtcttcgaaattggccttcaggagaagtggtactattttggacaagatggtgctttgctagaacaaacagataaacaagtactagaggcaaaaacgtctgaaaatacaggaaaagtatacggtgaacaatatcctctatctgctgaaaagaaaacttattattttgataataattatgctgtaaagacaggctggatttatgaagacggcaattggtattatttaaataagctaggaaattttggcgatgattcttacaatccactaccaattggtgaagttgctaagggttggactcaagattttcatgttactattgacattgatagaagcaaacctgctccatggtactacctagatgcttcaggtaagatgcttacagattggcaaaaagtaaacggaaaatggtattattttggctcctctggttctatggcaacaggttggaaatatgtacgaggcaaatggtattacttagataataaaaatggtgatatgaaaacaggatggcaataccttggtaacaagtggtactacctccgttcatcaggagctatggtaactggctggtatcaagatggttcaacttggtactatttagatgctgaaaatggtgatatgaaaataggttggacaaaagtaaatggaaaatggtattatctcaattcctctggagcaatggttacaggtagtcaaactatcgatggtaaagtttataacttcgcttcatctggtgagtggatttaa

SEQ ID NO: 1305 - DNA, 690 bp, Streptococcus pneumoniae
atggggaaacggattttattacttgagaaagaacgaaatctagctcattttttaagtttggaactccagaaagagcagtatcgggttgatctggtagaggaggggcaaaaagccctttccatggctcttcagacagactatgatttgattttattgaacgttaatctgggagatatgatggctcaggattttgcagaaaaattgagtcgaactaaacctgcctcagtcatcatgattttagatcattgggaagacttgcaagaagagctggaagttgttcagcgttttgcagtttcatacatctataagccagtctttatcgaaaatctggtagcgcgtatttcggcgatcttccgaggtcgggacttcattgatcaacactgcagtctgatgaaagttccaaggacctaccgcaatcttaggatagatgttgaacatcacacggtttatcgtggtgaagagatgattgctctgacccgccgtgagtatgaccttttggcgacacttatgggaagtaagaaagtattgactcgtgagcaattgttggaaagtgtttggaagtatgaaagtgcgaccgagacaaatatcgtagatgtctatatccgctatctacggagcaagcttgatgttaaaggccaaaaaagctacattaaaaccgtgcgtggtgttggttacaccatgcaagaatag

SEQ ID NO: 1306 - DNA, 1374 bp, Streptococcus pneumoniae
ttgcccttaatattgaatctcgtggttacacagttgctatctacaaccggtagtaaagaaaaaacggaagatgtgattgcttgccatcctgaaaagaactttgtaccaagctatgacgttgaaagttttgtaaactcaatcgaaaaacctcgtcgtatcatgctgatggttcaagctggacctggtacagatgctactatccaagcccttcttccacaccttgacaagggtgatatcttgattgacggaggaaacactttctacaaagatactatccgtcgtaatgaagaattggcaaactcaggtatcaactttatcggtactggagtttctggtggtgaaaaaggtgcccttgaaggtccttctatcatgcctggtggacaaaaagaggcctacgaattggtttcggatgttcttgaagaaatctcagctaaagcaccagaagatggcaaaccatgtgtgacttatatcggtcctgatggagctggtcactatgtgaaaatggttcacaacggtatcgagtacggtgatatgcaattgatcgcagaaagctatgacttgatgcaacacttgctaggcctttctgcagaggatatggctgaaatctttactgagtggaacaagggtgaattggatagctacttgatcgaaatcacagctgatatcttgagccgtaaagacgatgaagaccaagatggaccaatcgtagactacatccttgatgctgcaggtaacaagggaactggtaaatggacgagccaatcatctcttgaccttggtgtaccattgtcactgattactgagtcagtgtttgcacgctacatttcaacttacaaagaagaacgtgtacatgctagcaaggtgcttccaaaaccagctgccttcaactttgaaggagacaaggctgaattgattgaaaaaatccgtcaagccctttacttctcaaaaatcatttcatacgcacaaggatttgctcaattgcgtgtagcctctaaagaaaacaactggaacttgccatttgcagatatcgcatctatctggcgtgatggctgtatcatccgttctcgtttcttgcaaaagattacagatgcttacaaccgcgatgcagatcttgccaaccttcttttggacgagtacttcttggatgttactgctaagtatcaacaagcagtgcgtgatatcgtagctcttgcggttcaagctggtgtgccagtgccaactttctcagcagctattacttactttgatagctaccgttcagctgaccttccggctaacttgatccaagcacaacgtgactactttggtgctcacacttaccaacgtaaagacaaagaaggaaccttccactactcttggtatgacgaaaaataa

SEQ ID NO: 1307 - DNA, 1395 bp, Streptococcus pneumoniae
atgagtaaaaaaagacgaaatcgtcataaaaaagaaggtcaagaaccgcaatttgattttgatgaagcaaaagagctaacagttggtcaagctattcgtaaaaatgaagaagtggaagcaggagtcttgcctgaggattccattttggacaagtatgttaagcaacacagagatgaaattgaggcggataagtttgcgactcgtcaatacaaaaaagaggagttcgttgaaactcagagtctggatgatttaattcaagagatgcgtgaggctgtagagaagtcagaagcttcttcggaggaagttccatcttctgaagacatcttactacccttgcctctggacgatgaggagcaaggcttggatcctctattgctagatgatgaaaatccaacagaaatgactgaagaagtggaagaggagcaaaacctttctcgtctggatcaagaggactcagaaaagaaaagtaaaaaaggctttattttgaccgttttggcgcttgtatcagtaattatttgtgtcagtgcttattatgtctaccgtcaagtgaatcgctcgaccaaggaaattgaaacttctcaatcaactacagccaatcaatcagatgtggatgattttaatacactttatgacgccttttacacagatagcaataaaacggctttgaaaaatagccagtttgataaactgagtcaactcaaaaccttgcttgataagctggaaggtagtcgtgaacatacacttgccaaatctaaatatgatagtctagcaacgcaaatcaaggctattcaagatgtcaatgcacaatttgaaaaatcagctattgtggatggtgtgttggatacccatgccaaagctaaatcggatgctaaatttacagatattaaaactgggaatacggagcttgataaagtgctagataaggctatcagtcttggtaagagccagcaaacaagtacttttagctcaagttcaagtcaaactagcagctcaagctctagtcaagcaagctcaaatacgacaagtgagccaaaaccaagtagttcaaatgagactagaagtagtcgcagtgaagtcaatatgggtctctcgagtgcaggggttgctgttcaaagaagtgccagtcgtgttgcctataatcagtctgctattgatgatagtaataactctgcctgggattttgcggatggtgtcttggaacaaattctagcgacttcacgttcacgtggctatatcactggagaccaatatatccttgaacgtgtcaatatcgttaacggcaatggttattacaacctctataagccagatggaacctatctctttacccttaactgtaagacaggctactttgtcggaaatggcgctggtcatgcggatgacttggactactaa

SEQ ID NO: 1308 - DNA, 1158 bp, Streptococcus pneumoniae
atgaaaaaagaatttaatttaattgcaactgtggcagcagggcttgaggctgtcgttggtcgtgaagtgcgagagttgggctacgattgtcaggttgaaaatggacgtgttcgttttcaaggagacgtgagagctattatcgaaaccaacctttggcttcgggcagcagatcgtatcaaaattatcgtaggaacgttcccagctaagacttttgaagagctatttcagggagttttcgctttggattgggaaaattatttaccacttggagctcggttcccgatttcaaaagctaaatgtgttaagtccaaacttcacaatgagcccagtgttcaggctatttctaagaaagctgttgtcaagaaattgcagaaacactatgctcgcccagaaggggttcctctgatggagaatggcccagagtttaagattgaggtctctattctcaaagatgtggcaactgtcatgattgatacgaccgggtctagcctctttaaacgtggttatcgtaccgaaaaaggtggcgctcctatcaaggaaaatatggcagcagccattttacaactttctaattggtatccagacaagactttgattgatccgacctgtggttcggggactttctgtattgaggcagttatgattgctagaaagatggcgccaggtcttcgtcgctcttttgcatttgaggaatggaactggatcagcgatcgcttgattcaagaagtgcgcacagaagcggctaaaaaagtagaccgtgagcttgagctggatatcatgggctgtgatattgatgctcgcatggtggaaattgctaaggccaatgctcaggcagctggtgttgcaggagacattacttttaagcagatgcgcgtgcaggatttacgttccgataaaatcaatggagtaatcatttccaatccgccttatggtgaacgtttgtcagatgatgcaggggtgaccaagctctatgctgagatggggcaagtatttgcaccgctgaaaacttggagcaaatttatcctgactagtgatgaagcttttgaaagcaagtatggtagccaagcagataagaagcgtaagttatacaacggaaccttgaaagtggatctatatcaatattttggtcagcgtgtcaaacggcaagaggtaaaatag

SEQ ID NO: 1309 - DNA, 330 bp, Streptococcus pneumoniae
atggcaagtattattttttcagcgaaagatatttttgaacaagagtttggacgtgaagtccgtggctataataaagtagaagttgacgagtttttagacgatgtcatcaaggactatgaaacctatgctgccttggtcaagtcacttcgtcaggaaattgcggatttgaaggaagaattaactcgtaaaccgaaaccttcaccagttcaagcagaaccccttgaagcggcaattacaagttctatgacgaattttgatattttgaaacgcctgaatagattggaaaaagaagtttttggtaaacaaattttagataactcagatttttaa

SEQ ID NO: 1310 - DNA, 528 bp, Streptococcus pneumoniae
atggctacagctttggttttaggctattctgcttttgatttgggtttattttctgataaggatcctcgtcttaaattgattaaaaaagcgatacgtaaagatttagaggctatggcagcagatggggtgtcttggcttgtgtttacaggaagtttgggttttgaatattgggttttagaggttgctcaggagatgaaaaccgaatacggtttccagttggccaccatttttgcttttgaaacccatggggaaaattggaatgaaggcaatcagatgaaactgagtcgctttaagcaggtagactttgtcaaatatgcttatcctcgctatgaacacaaggggcagttaagagattaccagcagtttttgctggaaaacacgactagttcctatcttttttatgatgaagaaaatgaaacaaaactagcttatttttaccaaaagatgaaaaatcaagaggactattttataaagagattaacatttgatcaattaaatgaacttgctgaaaatttttccgaaaattga

SEQ ID NO: 1311 - DNA, 597 bp, Streptococcus pneumoniae
atggtcaactatccacataaagtttcatcacaaaaaagacaaacatctctttctcaacccaaaaatttcgcaaatcgaggaatgtcttttgaaaagatgatcaatgctaccaacgactactatttgtctcagggcttggctgttatacataagaaaccaactcctattcaaatcgtacaagtggactatccacaacgaagtcgtgccaagattgttgaagcctattttcgacaagcttcaacgacggactattctggcgtttataatggatattacatcgactttgaagtcaaggaaacaaaacaaaaacgtgcgattccgatgaaaaattttcatccacatcagattcagcatatggaacaagtccttgcccaacaaggaatctgctttgtccttcttcacttttcttctcagcaagaaacctacttattgccggcattcgatttgattcgcttctatcatcaagataagggacaaaaatcaatgccacttgaatatattcgagaatatggatatgaaatcaaggctggtgccttccctcaaattccttatctcaatgttatcaaagaacatttattaggtggtaaaacaagatga

SEQ ID NO: 1312 - DNA, 2160 bp, Streptococcus pneumoniae
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatgggctacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtatctacgattcaactgctactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctatctgtctgaaggaagcaatccagaggattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 1313 - DNA, 204 bp, Streptococcus pneumoniae
tcaggggttgtatttgattgttgcgtattattgttaggattggtagtcgtactattatttgtgcttggagtggttgagctagactgtgaagttgaactatctgatgatgagcttgaactttcagttgatgggggttgttgtggagcaggtgagttccacgtagaacgagcaccatttttaaatacgaattctccatttctgtag

SEQ ID NO: 1314 - DNA, 5304 bp, Streptococcus pneumoniae
atgaataaaggattatttgaaaaacgttgtaaatatagtattcggaaattttcattaggtgttgcttctgttatgattggagctgcattctttgggacaagtccggttcttgcagatagcgtgcagtctggttccacggcgaacttaccagctgatttagctactgctcttgcaacagcaaaagagaatgatgggcgtgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacgcctaagacggtaacccctgaatggcaaacggtagagaaaaaagaacaacagggaacagtcactatccgagaagaaaaaggtgtccgctacaaccaactatcctcaactgctcaaaatgataacgcaggtaaaccagctctgtttgaaaagaagggcttgaccgttgatgccaatggaaatgcaactgttgatttaaccttcaaagaagattctgaaaagggcaaatcacgctttggtgtcttcttgaaatttaaagataccaataataatgtttttgtcggttatgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataacgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagagggtaaaaacagaggatacccctgcccagaaagaaacaggtccggttgttgacgatagaaaggtgacttatgatacgatccagtctaaggtacttaaggcagtaattgaccaagccttccctcgtgtcaaggaatacaccttgaatggacatactttgccaggacaggtgcaacaattcaaccaagtctttatcaataaccaccgaatcacccctgaagtcacttataaaaaaatcaatgagacaacagcagagtacttgatgaagcttcgcgatgatgctcacttaatcaatgcggaaatgacagtacgcttgcaagttgtggacaatcaattgcactttgatgtgaccaagattgtcaaccacaatcaagtcactccaggtcaaaagattgatgacgaaagaaaactactttcttctattagtttcctcggcaatgctttagtctctgtttctagtgatcaaactggtgctaagtttgatggggcaaccatgtcaaacaatacgcatgtcagcggagatgatcatatcgatgtaaccaatccaatgaaggatttggctaagggttacatgtatggatttgtttctacagataagcttgctgctggtgtttggagtaactctcaaaatagctatggtggtggttcgaatgactggactcgtttgacagcttataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaaagttgattggcaagatggtgccattgcttatcgtagcattatgaacaaccctcaaggttgggaaaaagttaaggatatcacagcttaccgtatcgcgatgaactttggttctcaagcacaaaacccattccttatgaccttggatggtatcaagaaaatcaatctccacacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatccgtaaccaccaaaaagatgcttgggttggggactacagaagttatggtggtgcagccaactatccactgctaggtggctacagcatgaaagactttgaaggctggcaaggaagaagtgattacaatggctatgtaaccaacttatttgcccatgacgtcatgactaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagcccactataccgtgaacgtacagtaacgctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaaccaatcctgaaatgtcatggagtgaaggcatgcacatctatgatcaaggatttaatagcggtactttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgtcggtgtcgataaccgtagtaatgccaaggcaagtatcactgtgaatactggtgaaaaagaagtgactacttataccaataagtctctcgccctcaactatgtaaaagcctacgcccacaatacacgtcgtaacaatgctacagttgacgatacaagttacttccaaaacatgtacgccttctttacaactggatcggacgtctcaaatgttactctgacattgagtcgtgaagctggtgatcaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgtcgaagacaaccgcactcacttgtctgaaaaacacgatccatatacacaacgtggttggaacggtaagaaagttgatgatgttatcgaaggaaattggtcactcaagacaaatggactagtgagccgtcgtaacttggtttaccaaactattccgcaaaacttccgttttgaagcaggtaagacctaccgtgtaacctttgaatacgaagcaggttcagacaatacctatgcttttgtagtcggtaagggagaattccagtcaggtcgtcgtggtactcaagcaagcaacttggaaatgcatgaattgccaaatacttggacagattctaagaaagccaagaaggcaaccttcctcgtgacaggtgcagaaacaggggatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagccttgaagaatgctttggttcagaagaaaacggctttggtagcagatgactttgaaagtttggatgcgccagctcaaccaggtgaaggcctagagaatgcttttgatggcaatgtgtctagtctatggcatacatcttggaatggtggagatgtaggcaagcctgcaaccatggtcttgaaagaaccaactgaaatcactggacttcgttacgttccacgtggatcgggttcaaatggtaacttgcgtgatgtgaaacttgttgtgacagatgagtctggcaaggagcatacctttactgcaactgattggccagataacaataagccaaaagacattgattttggtaagacaattaaggctaagaaaattgtccttacaggtactaagacttacggagatggtggcgataaataccaatctgcagcggaacttatctttactcgtccacaggtagcagaaacacctcttgacttgttaggctatgaagcagctttggctaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagctctttagcttccgagcaaggtaagacgccagattataagcaagaaatagctagaccagaaacacctgaacaaatcttgccagcaacaggtgagagtcaatctgacacagccctcttcctagcaggtgttagcctagccctatctgctctctttgtagtaaaaacgaagaaagactag

SEQ ID NO: 1315 - DNA, 1983 bp, Streptococcus pneumoniae
atgaaaagttcaaaactatttgcccttgcgggcgtgacattattggcggcgactactttagctgcatgctctggatcaggttcaagcactaaaggtgagaagacattctcatacatttatgagacagaccctgataacctcaactatttgacaactgctaaggctgcgacagcaaatattaccagtaacgtggttgatggtttgctagaaaatgatcgctacgggaactttgtgccgtctatggctgaggattggtctgtatccaaggatggattgacttacacttatactatccgtaaggatgcaaaatggtatacttctgaaggtgaagaatacgcggcagtcaaagctcaagactttgtaacaggactaaaatatgctgctgataaaaaatcagatgctctttaccttgttcaagaatcaatcaaagggttggatgcctatgtaaaaggggaaatcaaagatttctcacaagtaggaattaaggctttggatgatcagacagttcagtacactttgaacaaaccagaaagcttctggaattctaagacaaccatgggtgtgcttgcgccagttaatgaagagtttttgaattcaaaaggagatgattttgccaaagctacggatccaagtagtctcttgtataatggaccttatttgttgaaatccattgtgaccaaatcttctgttgaatttgcgaaaaatccgaactactgggataaggacaatgtgcatattgacaaagttaaattgtcattctgggatggtcaagataccagcaaacctgcagaaaactttaaagatggtagccttacagcagctcgtctctatccaacaagtgcaagtttcgcagagcttgagaagagtatgaaggacaatattgtctatactcaacaagactctattacgtatctagttggtacaaatattgaccgtcagtcctataaatacacatctaagaccagcgacgaacaaaaggcatcgactaaaaaggctctcttaaacaaggatttccgtcaggctattgcctttggttttgatcgtacagcctatgcctctcagttgaatggacaaactggagcaagtaaaatcttgcgtaatctctttgtgccaccaacatttgttcaagcagatggtaaaaactttggcgatatggtcaaagagaaattggtcacttatggggatgaatggaaggatgttaatcttgcagattctcaggatggtctttacaatccagaaaaagccaaggctgaatttgctaaagctaaatcagccttacaagcagaaggagtccaattcccaattcatttggatatgccagttgaccaaacagcaactacaaaagttcagcgcgtccaatctatgaaacaatccttggaagcaactttaggagctgataatgtcattattgatattcaacaactacaaaaagacgaagtaaacaatattacatattttgctgaaaatgctgctggcgaagactgggatttatcagataatgtcggttggggtccagactttgccgatccatcaacctaccttgatatcatcaaaccatctgtaggagaaagtactaaaacatatttagggtttgactcaggggaagataatgtagctgctaaaaaagtaggtctatatgactacgaaaaattggttactgaggctggtgatgagactacagatgttgctaaacgctatgataaatacgctgcagcccaagcttggttgacagatagtgctttgattattccaactacatctcgtacagggcgtccaatcttgtctaagatggtaccatttacaataccatttgcattgtcaggaaataaaggtacaagtgaaccagtcttgtataaatacttggaacttcaagacaaggcagtcactgtagatgaataccaaaaagctcaggaaaaatggatgaaagaaaaagaagagtctaataaaaaggctcaagaagatctcgcaaaacatgtgaaataa

SEQ ID NO: 1316 - DNA, 234 bp, Streptococcus pneumoniae
cctaagctaaattttaaaaagcgagggtggttattttctcaaagttttgaaggagctaaagcaacagctattattatgagtttgttggaaacagctaaacgtcatcaattaaatagcgagaaatatctattctatcttctagaatgtcttccaaacgaggaaactctcgtaaacaaagaggttttagaggcttatttaccatggactaaagttgtacaagaaaagtgcaaataa

SEQ ID NO: 1317 - DNA, 450 bp, Streptococcus pneumoniae; identical to SEQ ID NO: 802

SEQ ID NO: 1318 - DNA, 174 bp, Streptococcus pneumoniae
ttgcccttcctagttttgaacctgctaaaactgactgacgccggcactaagcaaagaagtcttccattaagggctggagatgttcttgacgtttctgtagtcgttcatcagctggcaaagcctcccagtctctttccagggaaaataactgatcacaataagctaaacctttag

SEQ ID NO: 1319 - DNA, 258 bp, Streptococcus pneumoniae
ttggtaaactgcgaaccgctagaagcttatcgtcaactggaagaagctgaacttgttggatgttgggcacatgtgagaaggaagttttttgaagcgacccccaagcaagcagataaatcatccttaggagctaaaggtttagcttattgtgatcagttattttccctggaaagagactgggaggctttgccagctgatgaacgactacagaaacgtcaagaacatctccagcccttaatggaagacttctttgcttag

SEQ ID NO: 1320 - DNA, 429 bp, Streptococcus pneumoniae; identical to SEQ ID NO: 801

SEQ ID NO: 1321 - DNA, 852 bp, Streptococcus pneumoniae
atgattttaattacaggggcaaatggccaattaggaacggaacttcgctatttattggatgaacgtaatgaagaatacgtggcagtagatgtggctaagatggacattaccaatgaagaaatggttgagaaagtttttgaagaggtgaaaccgactttagtctaccattgtgcagcctacaccgctgttgatgcagcagaggatgaaggaaaagagttggacttcgccatcaatgtgacggggacaaaaaatgtcgcaaaagcatctgaaaagcatggtgcaactctagtttatatttctacggactatgtctttgacggtaagaaaccagttggacaagagtgggaagttgatgaccgaccagatccacagacagaatatggacgcactaagcgtatgggggaagagttagttgagaagcatgtgtctaatttctatattatccgtactgcctgggtatttggaaattatggcaaaaacttcgtttttaccatgcaaaatcttgcgaaaactcataagactttaacagttgtaaatgatcagtacggtcgtccgacttggactcgtaccttggctgagttcatgacctacctagctgaaaatcgtaaggaatttggttattatcatttgtcaaatgatgcgacagaagacacaacatggtatgattttgcagttgaaattttgaaagatacagatgtcgaagtcaagccagtagattccagtcaatttccagccaaagctaaacgtccgctaaactcaacgatgagcctggccaaagccaaagctactggatttgttattccaacttggcaagatgcattgcaagaattttacaaacaagaagtgagataa

SEQ ID NO: 1322 - DNA, 1050 bp, Streptococcus pneumoniae
atgactgaatacaaaaatattatcgtgacaggtggagctggctttatcggttctaactttgtccattatgtttacgagaactttccagatgttcacgtgacagtcctagataagttgacttatgctggaaaccgcgcgaatattgaggaaattttaggtaatcgtgttgagttagttgttggtgacattgctgatgcggagttggtagacaagttggctgctcaagcagatgctatcgttcattatgcagcggaaagccacaatgataattcgctcaatgatccatcgccatttattcatactaacttcattggaacctatactcttttagaagctgctcgtaagtatgatattcgcttccaccatgtatcgacagatgaagtttatggggatctccctttacgcgaagatttgccaggtcatggagaagggccgggtgagaaatttacggctgaaaccaagtacaatccaagctcgccttactcatcaaccaaggcagcctcagatttgattgtcaaagcctgggtgcgttcttttggagtcaaggcaacgatttccaactgttcaaataactacggtccttatcaacatatcgaaaaattcatcccacgtcagattactaacatcctaagtggtatcaagccaaaactttacggtgaaggtaaaaacgttcgtgactggattcataccaatgaccattcttcaggagtttggacaatcttgacaaaagggcaaatcggtgaaacctacttgattggggctgatggtgagaagaacaataaggaagttttggaacttatccttaaggaaatgggacaagctgcggatgcctatgatcatgtgactgaccgtgcaggacatgaccttcgctatgcgattgatgctagcaagctccgtgatgagttggggtggaaacctgaatttaccaactttgaagctgggctcaaggcaacaatcaagtggtatacagataaccaagaatggtggaaagcagaaaaagaagctgttgaagccaattatgctaagactcaggagattattacagtataa

SEQ ID NO: 1323 - DNA, 597 bp, Streptococcus pneumoniae
atgtcagataatttttttggaaaaacacttgcagtgcgtaagattgatgctataccaggactgctagagtttgacattcccgttcatggagacaatcgtggttggtttaaggaaaacttccagaaggaaaagatggagccacttggctttcctgaaagcttctttgctgcagggaaattgcaaaacaacgtcagcttttctcgcaaaaatgttcttcgaggattgcatgcagaaccttgggacaagtatatctctgttgcagacgatgggaaggttttaggatcttgggttgatctacgcgagggtgaaacctttgggaatacctatcagacagtgattgatgcgagtaagggaatctttgttcctcgaggcgtagctaatggcttccaagttttatcagatacagtgtcatatagctatctggtcaatgattactgggctcttgaactcaaacccaagtatgcctttgtgaactacgctgatccaagccttggtattgaatgggaaaatattgcagaagcagaggtttcagaagcagataaaaatcatccactacttaaggatgtaaaacctttgaaaaaagaagatttggaataa

SEQ ID NO: 1324 - DNA, 870 bp, Streptococcus pneumoniae
atgaaaggtattattcttgcaggcggctcaggtacccgcctgtacccacttactcgggctgcgtcaaaacagctgatgccggtttatgataaacctatgatttattatccgttgtcgacattaatgttggctggaattaaagatattttgattatctcaactcctcaagatttgccccggtttaaggacttgctcttggatggttccgaatttgggatcaagctttcctatgcggaacaacctagtcccgatggacttgctcaggcttttcttatcggtgaagaatttatcggtgacgatagtgttgccttgattttgggcgacaatatctatcatggacctggtttgagcaaaatgcttcaaaaggcagcccagaaagagaaaggtgcgactgtttttggctaccaagtgaaggatccagagcgttttggtgtggtcgagtttgatacagacatgaatgccatttccatagaagaaaaaccagagaatcctcgctccaactatgccgtgaccggtctgtatttctatgataatgatgttgtagaaattgctaaaggtattaaaccaagtgcacgtggcgagttagaaattacagatatcaacaaggcttacctaaatcgtggtgacctttctgttgagctgatggggcgtggttttgcctggttggatacgggaacccatgaaagcctgctagaagcttctcagtatatcgaaacagttcaacggatgcagaatgttcaagttgcaaacttggaagaaattgcctatcgcatgggctatatcagttgtgaagatgtgctcgagttggcgcaacctctgaagaagaatgaatacggacaatatttgctccgtttgattggagaagcatag

SEQ ID NO: 1325 - DNA, 1428 bp, Streptococcus pneumoniae
gtggggagtatagttatgaaattgaagtttcttataacaaatttgtttcatgttcttttgtctaatctgattacaattcttacatcagttatagttgtactaattttaccaaaaattatgggagtaactgagtatagttattggcaactatatattttttacctaacatatattggtttttttcatctgggatggattgatggaatttatcttaaatatggcggattagagtaccagaacttagataagaaacagttttattctcaaatacttcaattttccagttttttaattttaatttcttttctattatttggttttaacttattgactgtgacagatcaaaatgcaaaatatatttataacatgactattattagtatgatagttacaaatttaagaatgttattcgtttatattttgcagatgacaaatcgattaaaggatagttccatcattctaatcagtgatcgcgttatatatgttattcttttattcctgtttattatatttaaatggcatgaatacaaggtaatgatttgggcagatgttttgggaaggacattttctctcctactttctttttggatttgtaaagatattgtttttcaatccttatccgagtttatattggatctgagagagtcttttgacaatatccgtgttggaatcaatttaatgttatccaatattgcaagtagtatgattattggtattgttcgaatgggaattcaatggaattggaatatcgaaacattcgggaaagtatcactgacgctaagcatctctaatttattaatgacttttattaatgcgattggtttagttgtttttcctttgttaaaacggacaaaaacggaaaatttatctaaaatttattccaacttaagaaatgttttgatgcttatcatgttcgcgattttgctcatttactatcctttaaaaattgtattagacctctggttgccagcctatcaagatgccttgattttcatgacccttattttccctatgtcagtctatgaaggaaaaatggcattggtcattaatacttacttaaaggcattaagaatggagagagatattctcaaaataaatactttgattatgttgttcagtatgttagttaccctaataactactctattattaaatagtttagagctgactgttgtatcgatagttgttttgctagctttacgtagcgtaatagcagaactaattctatctaaaaaactggatgtttcggttaagaaagatattgtattagaatttcttttgacgattgtctttatttcttcaagttggtacttaccgatttggcccgcagtaatagtttatttgttagcgtatactttatacttgtatctaaagcgtaaagatataaaaatgtatatagaatattttagaaagaaaatatttgaataa

SEQ ID NO: 1326 - DNA, 285 bp, Streptococcus pneumoniae
actattactgcgggccaaatcggtaagtaccaacttgaagaaataaagacaatcgtcaaaagaaattctaatacaatatctttcttaaccgaaacatccagttttttagatagaattagttctgctattacgctacgtaaagctagcaaaacaactatcgatacaacagtcagctctaaactatttaataatagagtagttattagggtaactaacatactgaacaacataatcaaagtatttattttgagaatatctctctccattcttaatgcctttaagtaa

SEQ ID NO: 1327 - DNA, 1344 bp, Streptococcus pneumoniae
atgcttttaaatttcttattcatatttatttttctattaattatcattacatttatattatttgagggagatttgtttcaacccgcagtaattttaacacttgcttattttatttcgattgcaagtgctctagttaatagaaatgtttggggaacagaactccatttcaaaacctttggtttgatattgctaggggttgctacatttattatagtttccttgttgacaaaattgtcgtacaaacctaaagtggagggaatttcgtataaagaattaaaagaaataaatccttcaaagataatatatggcattcttctgattctaaatcttgttatgctatttctttatatccatgaaattcagaaagtggtactgttttcaggtagaggtttttctaatattacagatttgataagtaactataggtacctatcttattattcaaatgaagtagaagatcgtgtaagtggaatgattaatcaactagctaaaattattccagcgactacatttgtttctttatatatatttataaataattattttataacgaagcaaataaagaaaaatttcatttatttgattccaatagctatattctttgtctatgcaatcattagtggtggtagactgccccttataaggttagttattggaactctgttgatattgtatatatactctgtgtacgggagtcataaatctcaacttaccagaagttttaaaatgattactcgctctctttttgcatttcttatgttgatagttttattctttcttttaaaatttgtattagggcgttcttctcaggaagattttatcagttacatcactcgttatatgggaggctcaattcaactatttgatttatttgttatagatccgatacgacgtaacaaagaactaggtgcagaaactttttcgggaatttatgagatgcttgcaaaattaggatttgataataatattataaaaggcttagaatggagaatatcgcctaattattattctttagggaatgtgtatactgcaattagacgctattattcagactttggtgtaattggtattgtaatttgtcagagttttacagcatggttgtatactttaggttatgaaaaaattagacatcattctttagttacaaatggtcaaagatttaggttgattctattagcagcttcattttatccattatttttaaatagtatcgaggatgtgttttatatttcaatggttaccattggatatggaatccaaattgttatcttttatctggttttttgggttcttctgaaagttcaggttgactttaacaaaggtaaattaaggataaatagatga

SEQ ID NO: 1328 - DNA, 987 bp, Streptococcus pneumoniae
atgggaaaatcagttgcaattttaatgaccacttataatggtgagagatatttgtcacaacagattgatagtattaggtctcaaacatttaccaattggacgctttttattagagatgatggatcaaaagataagacagtagaagtaatacagaggtattctaagatagatgatagaattagattagttgaaaatccctcaaagtttcatggagcttattataatttttttaatctaattgaatacgttaaaaacaattatcaatttgattattactttttttgtgatcaagatgatatttggaaagagcacaagctagaaatacagctgttaagattttctaaggatgaaatgccagagatggtttactctgatatgtcaacgattgatgccaataataagttgatagatattagtataaataacataatggggattgaattaccgaacataaataatttgtattttattcatgcctatatctgggggtgtacggcaggctttaatcatgcattgttagagatggttccttcagttgatattgataaagattatttatatatagaaaaactgtctcatgataattattttgcaaagtttgcactagagtatgggaaggtgttgttctgccctgagcaactggtcttgtatcgaagacacggacataatgtaacaactagtcatcattttaaattatctccgctaaatattctcagaaaggctattttgggtttcaatgaattggcacttacacatgctggggtatataatcaaactctttatatgctaaaaaaagcttctgaaaaaagtcctttaagtgatagactgcttgaaattcaggaagtaatcaaaattggaggattaaaaggtgtgagatatttctgtcagaatcgaatttctcgaaagcaactcgtaagaaccatcggcttatataccatcatgctttttggcacctataaaaaatatattatgaaagaactctcataa

SEQ ID NO: 1329 - DNA, 726 bp, Streptococcus pneumoniae
atgataatgtcaatatataaactttataaagatattgaaagaaaaacgatgtcgcctgctaaaaaagcaatggctaaaaatgattattttgcgttttatgttggaagaccgttatcctatcttttaacagttccttttttaaaaacgaatattactcccaatcaagtatcttatttatctatagcccctttgattcttggatttctgacaatgacatttacaactaatttcattctattattgctggcatggtttctattttttttatggaacttactagatggagtagatgggaacttagctagatatcgggagcaatactcgaaggatggaagtgtagtagatgcaatggcaggctatgtggctatggtgctgacgtattttggtgcaggaatagtagcaactcatctaaatggctcagatatgtatgtgattttgggtgctttatctggaatttctttgatttttccaagattggtgatgcataagtatatcaacacagtagcacgaaatgagtctgtcaataacattaaagataaatcaaattttagtactataaaactactggctttaaatatgacatcaattacaggtattcctcaggttttactactagtaacgattttaacaaatcagtgggaattttttactttagtatatttcacgattaattttttattaatgatattttcgttatattcattatttaaaaaggagaatgtttag

SEQ ID NO: 1330 - DNA, 558 bp, Streptococcus pneumoniae
ttgaaagttcaagaaaaattgaaattattaaaagagtttataaaaatatgttctaaaaataaaatgaagtattttgcttctggaggtagtctattggaagctgcaagatacaaaggttttattccttggaatgatgatatggctctaggtttaccaagaaagcattttgaaaagtttataaatgaaatagattttgaaaaatataataaaaattatattttagaaagttcggaaatgaatttaggtatttttcaatataaattaaaatctgctattttaattttagggaaatcgtatgacgtatgtttgaatttatttctgttagacaggatgtcagaattggttattgatggtgagtcaggttttaaagtcccactatataatttagaagtggctgtagatagaagtagaagtattattgagaatagagaactagccaatgagttaggtagtgttgctttccaaagagttcaatctatatttgaaataaaagaaaaagtgtcagagctagagaatatattcatgagtttaggagaagatgataatgtcaatatataa

SEQ ID NO: 1331 - DNA, 945 bp, Streptococcus pneumoniae
atggatatagtatatgcgacagataataattttgtagatgtattgagtgcatctatcaagtcgctttacactactaattcagatttggatttaaatttatggattattgctgataaagtttcggatagaaataaagaaaagataaatagattatcaaaacaatttgcgcagagagaaattaattggatagagaacgttgagattccatttaaattacatttagataggggatcaattagttcatttagcagattatttctgggaagtgttcttccatcttcaatgagtaaagttctctatcttgatagtgatattattgtaatggattctttacgaagtattcttgatattgattttaaagataaaattctctatggggtaaatgatacttttaataaagaatacaagcaggtgttggggataccaatcgacaaaccaatgtttaatgctggagttatgctgattaatttagagttatggagaaataataacgtcgaagaaaaatttttgcaagtaattcaaaagtttaatggtactatattacaaggtgatttaggagttttaaatgcagttttatataactcatttggtgtacttcctccagaatataattatatgaccatatttgaagatttgacttatgaagaaatgatagtttttaaaaaaccaattaactattattcaaaagaagaaattaaaaatgctagagaacgtatagtcttgcgccatttcacaacgtgttttctatcactcagaccttggcaagaaaatagtgaggtggcgcatgtggaaatatttaaaaaatactatagaggaacatacaaacaagtatctccatctaagttatcaagaatttataaaattttaccgaaaaaaatgtcgctctatttactaggttttattcaatcaaaagtgcgtccaaaactgtatagaattttgaaataa

SEQ ID NO: 1332 - DNA, 1368 bp, Streptococcus pneumoniae
atgaatggaaaactagtaaagccttcattggccatagtccagagttttcttgttattttattggcttatctacttagcactgtgagagaaacagagattgtttcaacaacagctattgtactttatatcctccactattttgccttttatatcagtgattatggacaggatttctttaaaaggggatatttgattgaacttgtccagacattgaaatatatcctattctttgcgctagcgattagtatttctaattttttcttagaagatcgatttagtatttccagaagaggcatgatttacttcctcctattacatgttctcttagtctatgtgctaaaccgatttatcaagtggtattggaagcgggcttatcccaactttaaaggaagtaagaagattctcctacttacagcaacttctcgtgtcgaaaaggtattggatagactaatagaatcagatgatgttgttggggagttggtagccgtcagtgttttagataaaccagattttcagcatgattatttaaaggttgtagcagagggggagatcgtaaactttgcgactcatgaggtggtcgatgaagtctttatcaatcttccaagtgaaaaatacaatattggagagcttgtctctcagtttgaaacgatgggagttgatgtaacagtcaatctaaatgctttcgattgtatcttggcacataacaagcaaatttgtgagatggcaggactaaacgttgtgactttttctacaacattttataagactagccatgtgattgctaagcgggttattgatattatcggttccctggtaggtttgatactatgtggtctagtcagtattgtactggttcctttgattcgaaaggatgggggctctgctatttttgctcagacgcgtattgggaaaaatggtcgccatttcactttttacaagtttcgctctatgtgtgtggatgctgaggagaaaaaaagagaactcatggaacaaaataccatgcagggtggaatgtttaaggtggatgaggatccacgtatcacgaaaattggtcattttatacggaagacgagcttggacgagctaccacagttttacaatgttctaaagggagatatgagtttggtagggacacgaccaccaacagtggacgagtatgagcactataccccagaacaaaaacgtcgcctaagttttaaacctggcataacaggtctatggcaggtcagcggacgaagcgagatcaagaatttcgatgaggttgtcaaattagatgtggcctatatagacggttggacaatttggaaagatattgaaattttattgaagacagttaaagttgtattgatgaaggatggagcgaagtag

SEQ ID NO: 1333 - DNA, 681 bp, Streptococcus pneumoniae
atgccaacgttagaaatctcacaggtgaaattagaacttgcgaaaaaggcagaggaatattataatgctttgtgcacgaacctacagttaagtggagatgatttgaaagtattttctatcacttctgtgaaaccaggagaaggaaaaacaacgacttccaccaatatcgctcgggcttttgcgcgtgcaggttacaaaacgttgctgattgatgcagacatgcgtaactccgtgatgtcaggtgtctttaaatcaagggaaaggattaccgggctaacagaatttctatcagggactacagacctgtcacagggactttgtgataccaatattgagaatctctttgtgattcaggctggctctgtgtcaccaaatccgacagcccttcttcaaagtaggaatttcagtacaatgcttgaaaccgtgcgtaaatattttgactatatcgtcgtagacactgctcctgtcggtgtcgtgattgatgcggctatcattacgcagaaatgtgatgcttctattttagtgacgaaggcaggcgaaacaaagcgacgggatattcaaaaagcgaaagaacagatagaacaaactgggaagccgtgtttaggagttgtgttgaataaattcgatacttcagtagacgaatacggttcttatggaagttatgggaaaaagaaaaaatag

SEQ ID NO: 1334 - DNA, 696 bp, Streptococcus pneumoniae
atgatgaaagaacaaaacacgatagaaatcgatgtatttcaagtacttaaaaccttgtggaaacacaagttaataattttattagtggcgcttgtgacaggggcgggagcttttgcatatagcacttttattgttaaaccagaatatacgagcaccacgcgtatttacgtcgtcaaccgtaatcaagaaggtaagtcgggactgacgaatcaggacttgcaggcaggaacttatctggtaaaagactaccgcgaaattatcctttcgcaagatgtattggaaaaggtagcgacaaatttgaaattggatatgccagcaaaagcgttaactagcaaagttcaagtgactgtaccaaccgacactcgtatcgtctcaatctctgtcaaggataaagaaccagaggaagccagtcgcattgctaattctctacgagaagttgctgcaggaaagatcgtcgctgtaacgcgagtatctgatgtaacgacgcttgaagaagcgcggccagctacgactccctcttctcccaatgttcgacgtaacaccttagttggttttcttggaggagccgtcgtaacagtaattactgttcttttgattgagttgctcgatacccgtgtgaaacgtcctgaagaagttgaagaggtgctgcaagtgccacttctaggagtcgttccagatttggataaaatgaaatag

SEQ ID NO: 1335 - DNA, 780 bp, Streptococcus pneumoniae
ttgcatctgtcaaaacggctattcaggacgtgttggagggcagatgaaatgattgatattcattcgcacattgtctttgatgtagatgatggtcccaagtcaagagaggaaagtaaggctctcttgacagaagcctacaggcagggggtgcgaaccattgtctctacctctcaccgtcgcaagggcatgtttgaaactccagaagagaagatagcagaaaactttcttcaggttcgggaaatagctaaggaagtcgcgagtgacttggtcattgcttatggggctgaaatttactacacgccagatgttttggataagctggaaaacaatcggattccgaccctcaataatagtcgttatgccttgatagagtttagtatgaacactccttatcgcgatattcatagtgccttgaataaaatattgatgttgggaattactcccgtcattgcccacatagagcgctatgatgttcttgaaaataatgaaaaacgcgttcgagagctgatcgatatgggctgttacacgcaaataaatagttcacatgtcctcaaatccaaactttttggagaaccttataaattcatgaaaaaaagagcgcagtatttcttggagcgtgatttggttcatatcattgcaagtgatatgcataatgtggacggcagacccccccatatggcagaagcatatgaccttgtttcccaaaaatacggagaagcgaaggctcaggaactttttatagacaatcctcgaaaaattgtaatggatcaactaatttag

SEQ ID NO: 1336 - DNA, 1455 bp, Streptococcus pneumoniae
gtgttaatcatgagtagacgttttaagaaatcaggttcacagaaagtgaagcgaagtgttaatatagttttgttgactatttatttattgttagtttgttttttattgttcttaatctttaagtacaatatccttgcttttagatatcttaatctagtggcaactgcctttgttctactagttgccttaatagggctactctcgattatctataaaaaagctgaaaagtttaccatttttctgttggtgctctctattcttgtcagctcagtgtcgctctttgcagtacagcagtttgttggactgaccaatcgtttaaatgcgacttctaattactcagaatattcgctcagtgtcgctgttttagcagatagtgagattgagaatgttacgcaactgacgagtgtgacagcaccgactgggactgataatgaaaacattcaaaaactactagctgatatcaaatcaagtcagaatatcgatttgacggttaatcaaagttcgtcttacttgtcagcttacaggagtttgattgcaggagagactaaggccattgtcttaaatagtgtctttgaaaatatcattgaatcggagtatccagatcacgcatcgaagataaaaaagatttataccaagggattcattaaaaaagtagaagctcctaagacgtctaagaatcagtctttcaatatctatgttagtggaattgatacttatggtccaattagttcggtgtcgcgttcagatgtcaatatcttgatgactgtcaatcgagataccaagaaaattctcttgaccacaacgccacgtgatgcttatgtaccaatcgcagatggtggaaataatcaaaaagataaattgactcatgcgggcatttatggagttgattcgtccattcacaccttagaaaatctctatggagtggatatcaattactatgtgcgattgaacttcacttcgtttttgaaattgattgatttgttgggtggggtagatgtttataatgatcaggaattcacagctcttgctaataaaaaacactattctattggtaatgtccatttagattcagaagaggcactcgcttttgttcgtgagcgctattccctagcggatggtgatcgtgaccgtgggcgcaatcaacaaaaggtgattgtggctatccttcaaaaattaacttcgaccgaagtactgaaaaattatagtacgatcattgatagcttgcaagattctatccaaacaaacatgccacttgagaccatgataaacttggtcaatgctcagttagaaagtggtggaacgtacaaagtaaattcgcaagacttgaagggtaggggacggacggatcttccttcctatgcgatgccagatagtaacctctatgtgatggaaattaacgacagtagccttgcatctgtcaaaacggctattcaggacgtgttggagggcagatga

SEQ ID NO: 1337 - DNA, 1074 bp, Streptococcus pneumoniae
atgaaaaggatccaactgaatatgaatgaaacgaaaaaatatcttgtgataaaagctatagcccaaggaaagaaaacaaagaaacgggcctgtgtcgaactcaatctttctgaaagacaaatcaatcgtctgctactagcctatcaacagaaagaaaaagaagccttcagacacggaaacagaaatcgaaaaccaaaacatgcaatccctgatgaaatcaaagaacgtatcctaaagaaatacctctcctatcaaacatataaaccaaatgtccgtcatttctgtgaattgctagctgaagaagaaggaattcagctctctgatacaactgttagaaaaatactctataagaaaaatatcctgtcgcctaagtctcacagaaagacaaagaagagagtaagaaaacaagctaaactgaaccccaagcaacccctagacaatccaatcttaccgacagctgaaaacttcctggaagaccctaaaaaggtacatcctagtagacccagaaaaaaatttgctggagaactcatccaaatggatgccagccctcatgcctggtttggagtagaaacctctaacttacacctagccattgatgatgcttctggcaatatcctaggcgcttattttgacaaacaagagaccttgaatgcttactatcatgtcctcgaacaaatcttagccaaccacggcattcctcttcaaattaaaacagataagagaactgtttttacctatcaagcctccaactctaagaaaatggaggacgacacccatacacaatttggatacgcctgtcaccaactgggaattctccttgagacaacctctatccctcaagctaaagggagagtcgaaagactcaatcagacactacaatctcgcctgcctatcgaactggaacgaaacaatattcataccttggaagaagccaatacctttctaccttcctatatccaaacctttaatgaacagtttggaaacaagacaaaactctctgtctttgaggaggctcctaagccctctgaacgaaatctcattctagctagactggcgggagagagtcgtcgatag

SEQ ID NO: 1338 - DNA, 360 bp, Streptococcus pneumoniae
ctagactggcgggagagagtcgtcgatagtggacaccatatccgattccaaaatcgttgctatatccctaccgagcaaggaaaagaagtctatttcatcagaaagacaaaagcattagttataaaagcatttgatggtgacatctacctcaatatcgctgacaaaatctatcacacaaaggagctactaaatcatgaactctattcgaaaaactttgaacaagaaccagaacaaaaaaaagaaagacgcaagtatatccctccacaaacccatccgtggaaactcacatctttcaaacaatatcttcataaaaataaaaaggattatgaagagtttaaaggaggatttttcagtacgtgc

SEQ ID NO: 1339 - DNA, 951 bp, Streptococcus pneumoniae
atgaactctattcgaaaaactttgaacaagaaccagaacaaaaaaaagaaagacgcaagtatatccctccacaaacccatccgtggaaactcacatctttcaaacaatatcttcataaaaataaaaaggattatgaagagtttaaaggaggatttttcagtacgtgctgaaaaatatgagaactatcaggagacatttcaagggcctaacagtttttccaaaaccgatccagatgccacttttatgcggatgaaggaagatcatatgaaaaatggtcaactcaaggctgcttataatcttcaaatcgctacggaaaaccaatttgttcttcactatgatgtcttttcaaatccgacagataccaagactcttctgccattccttgaaacctatccgcatgacttgaagacagttgtcgcagatgctggatatggaagtgaagagaacctccttcgtttagatgaaaaggaggtaaaccatctgattaaatatgccatgtttgataaggaacagaagagaggctataaacagtcagctagaaacttagcgaattggcactataatgacaaggaggatagctatacacatcctgatggctggtattatcgttttcaccataccaaacatcagaaaacacagacagactttcaacaagaaatcaaggtttactacgccgacgaacctgaatcagcccctcaaaagggactgtatatgaacgaaggctatcaaaacttgaaggcgaaagaatgtcaagcgcttttatctccccaaggtagacagattttcgctcaacgcaagattgatgtggaacctgtctttgggcagataaaggcttgtttgggttacaagagatgtaatctgaggggcaagcgtcaagtgagaattgacatgggattggtacttatggccaataacctcctaaaatacaataagagaacgactcaaaattaa

SEQ ID NO: 1340 - DNA, 537 bp, Streptococcus pneumoniae
atgaaattaacttatgatgataaagttcagatctatgaacttagaaaacaaggatatagcttagagaagctttcaaataaatttgggataaataattctaatcttaggtatatgattaaattgattgatcgttacggaatagagttcgtcaaaaaagggaaaaatcaatactattctccagaactaaaacaagaaatgattgataaagttttacatgcaaactggtctcaagatagagtttctctcaaatatgctctcccaaatcgtggtatgcttccaaattggctggcgcaatataagaaaaacgggtatactattgttgagaaaacaagagggagaccagctaaaatggaacgtaaacgaaagaaaacttgggaagaaatgacagaattagaacgacttcaagaggagaatgaacgcttacggactgaggtggcttacttaaaaaagttaaaagagttagaggaaagggacgaagccctagagcgagaaaggcagaaacagttagagaaatggtttcaggaggatttcgactag

SEQ ID NO: 1341 - DNA, 483 bp, Streptococcus pneumoniae
atggtttcaggaggatttcgactagattttcttcttgaaacagcacgtttagctcgctcgacttactattatcagttgaaacaactggatggggttgataaagataaagagattaaaaccgaaattcaggccatttataatgaacataaaggcaactatggctatcgtcgaatccatttagaactaagaaatcgtggttttgtggtgaatcataagaaagttcaacgtctgatgaaagttcttggtttaacagctcgaattcgtcggaaacgaaagtattcctcctaccaaggagagattggcaagaaagcagagaatctcattcaacgtcagtttgaagcaaccaaaccaatggaaaagtgctatacggatgtgacagagtttgccattccaaatagcacacagaaactctatttatcgcctgttttagatggctttaacagcgaaatttcgcctataatctttcaacttcaccaaacttag

SEQ ID NO: 1342 - DNA, 834 bp, Streptococcus pneumoniae; identical to SEQ ID NO: 600

SEQ ID NO: 1343 - DNA, 1611 bp, Streptococcus pneumoniae
atgcaagaaaaatggtggcacaatgccgtagtctatcaagtctatccaaagagttttatggatagtaatggagatggagttggtgatttgccaggtattaccagtaagttggactatctagccaagctaggaatcacagcaatttggctttctcccgtttatgacagccctatggatgataatggctatgatattgctgattatcaagcgattgcggctatttttggaaccatggaggacatggatcagctgattgcagaagctaagaagcgtgacattcgtatcatcatggacttggtggttaatcatacctcagatgaacatgcttggtttgtcgaagcctgtgaaaatactgacagccctgagcgagactactatatctggcgcgatgaacccaatgacctagattctatctttagtgggtctgcttgggaatacgatgaaaagtcaggtcaatactatctccactttttcagcaaaaaacagccggatctcaactgggaaaatgaaaaacttcgccagaaaatttatgagatgatgaacttctggattgataaaggtattggtggtttccgtatggatgttattgacatgattggcaaaattcctgacgagaaggtagtcaataatggtcctatgctccatccctatctcaaggaaatgaatcaggcgacctttggagataaggatctcttgacagtaggggagacttggggagcaacgccagagattgccaagctctactctgatccaaaggggcaagaattgtctatggtcttccagtttgaacatatcggtcttcagtatcaggaaggtcagcctaaatggcactatcaaaaagagctgaatatcgctaagttaaaagaaatcttcaacaaatggcagacagagttaggagttgaggacggctggaattccctcttctggaacaaccatgacctccctcgtattgtctcaatctggggaaatgaccaagaataccgcgaaaaatctgccaaagcctttgcaatcttgcttcatcttatgagaggaactccttatatctaccaaggtgaggagattgggatgaccaactatccgtttgaaacactggatcaagtagaagatattgaatctctcaactatgcgcgtgaggctcttgaaaaaggtgttccgattgaagaaatcatggacagtatccgtgttattggacgtgacaatgcccgtacccctatgcaatgggacgagagcaaaaacgctggtttctcaacaggtcaaccttggttggcggttaatccaaattacgagatgatcaatgtccaagaagcgctggcaaatccagattctattttctatacctatcagaaactggtccaaattcgcaaggagaatagctggctagttcgagctgactttgaattgcttgatacggctgataaggtctttgcttatatacgtaaggatggcgaccgtcgcttcctagtcgtggctaatttatccaatgacaaacaaaacttttcagtagatggaaaagttagatctgtcttgattgaaaacactgcggctaaagaagtacttgaaaaacaggtcttggctccatgggatgctttctgtgtggaaatgactgattag

SEQ ID NO: 1344 - DNA, 1485 bp, Streptococcus pneumoniae
atgaaaaaccaagcttttagttctgagcaatatttaaatctacaacgcgaccacatcttagagcgcattatccaattggacggcaagctttacatagagtttggtggcaaaatgttagaagatttccacgctgctcgtgtccttcctggttatgaacctgacaacaaaatcaagctcttgcaagaattgaaagagcaggttgaggttgtgattgccattaatgctagtaacattgaacattccaaagcacgtggcgacttaggcatttcttatgaccaagaagttcttcgtttgattgacaaattcaatgaattagggatttttgttggttccgttgtcattacacaatacactggccaacccgctgcagatgccttccgcaaccaacttgagaaaaacggaattgattcttatcttcattatccaatcaaaggatatccgacggatatggatcacatcatttcctcaaaaggcatgggcaaaaacgactacatcaaaaccagtcgcaacttgattgtcgtaaccgctcctggacccggttctggaaaattggcaacgtgtatgtccaatatgtaccacgaccaaatcaatggcatcaagtctggctacgctaaatttgaaaccttccctgtttggaatcttccccttcatcatccagttaacttggcttatgaagctgccacagctgaccttgatgatgtcaacatgattgaccccttccatcttcaaacctatggagaaaccactgtcaactacaaccgtgatatcgaaatcttcccagtgctcaagcgcatgttggaacgtattctcggaaaatcaccatacgcttcaccgacagatatgggtgtcaacatggttggtttcgctattacagatgacgaggctgctgtcgaagcttctaaacaagaaatcatccgccgttactatcaaacagttcttgacttcaaagctgaaaaagttggcgaagctgccgtcaagaaaattgagttgctcatgaacgacctcggtatcacacctgcagaccgtaaggttgctgtcgttgcgcgccaaaaagcagaagaaactggtggaccagccctagcctttgaattgccaaatggggaaatcgtcactggtaagaactcagaactctttgggcctacagccgctgccttgatcaacgccatcaaaaaatcagctgacatcgctaaagaagtaaaactaatcgagcctgaagttgttaagccaatccaaggtcttaaaatcgatcatctcggtagccgcaatccacgccttcattcaaatgaaattctgattgcacttgctatcacagctacagaaaatcctgatgctgcccgcgctatggaagaactcggcaacctcaaaggaagcgaagcccactcaaccatcatcttgactgatgaagacaagaatgtccttcgtaaactgggtatcaacgtaacctttgacccatactaccaatacgaccgcttatatcgtaagtaa

SEQ ID NO: 1345 - DNA, 483 bp, Streptococcus pneumoniae
atgtcaaaagaagttattgtcgaaagttttgaacttgaccacaccattgtcaaagcaccctatgttcgcttgattggggaagaaacaggaccaaaaggagacatcatctccaattatgatattcgcttggtgcaaccaaacgaagactctatccctactgccggccttcacactatcgagcacctcttagccaaactcatccgtacccgcattgacggcatgattgactgttcaccatttggttgccgcacaggcttccacatgattatgtggggacgtcacaccagtgctaaaatcgcagctgttatcaaggattcgctcaaggaaatcgctgaaactactacttgggaagatgtcccagggacaaccatcgaatcttgcggaaactacaaggaccacagcctcttctctgctaaagaatgggcaaaactcatcttggaacaagggatttcagatgatgcctttgaacgtcatgtgatttaa

SEQ ID NO: 1346 - DNA, 2106 bp, Streptococcus pneumoniae
atgaataacaactttaataattttaataacatggatgatttatttaaccaattgatgggtggtatgcgaggatatagttctgaaaatcgccgttacttaattaatggacgcgaagtcacacctgaggaatttgctcactatcgtgcgactggtcaattaccaggaaatgcagaaactgatgtgcaaatgccacaacaggcatcaggtatgaaacaagatggtgtccttgcaaaactaggtcgaaacttaacagcagaagcgcgtgagggcaagttggaccctgttatcggacgaaacaaggaaattcaagaaacatctgaaatcctctcacgccgcaccaagaacaatcctgttttggtcggagatgcaggtgttggtaagacagcagttgtcgaaggtctagcgcaagccattgtgaacggagatgttcctgctgctatcaagaacaaggaaattatttctattgatatctcaggtcttgaggctggtactcaataccgtggtagctttgaagaaaatgtccaaaacttggtcaatgaagtgaaagaagcagggaatattatcctcttctttgatgaaattcaccaaattcttggtgctggtagcactggtggagacagtggttctaaagggcttgcggatattctcaagccagctctctctcgtggagaattgacagtgattggggcaacaactcaagacgaataccgtaacaccatcttgaagaatgctgctcttgctcgtcgtttcaacgaagtgaaggtcaatgctccttcagcagagaatacttttaacattcttcaaggcattcgtgacctctatcaacaacaccacaatgtcatcttgccagacgaagtcttgaaagcagcggtggattattctgttcaatacattcctcaacgtagcttgccagataaggctattgaccttgtcgatgtaacggctgctcacttggcggctcaacatccagtaacagatgtgcatgctgttgaacgagaaatcgaaacggaaaaagacaagcaagaaaaagcagttgaagcagaagattttgaagcagctctaaactataaaacacgcattgcagaattggaaaggaaaatcgaaaaccacacagaagatatgaaagtgactgcaagtgtcaacgatgtggctgaatctgtggaacgaatgacaggtatcccagtatcgcaaatgggagcttcagatatcgaacgtttgaaagatatggctcatcgcttgcaagacaaggtgattggtcaagataaggccgtagaagttgtagctcgtgctatccgtcgtaaccgtgctggttttgatgaaggaaatcgcccaatcggcagcttcctctttgtagggtctactggggttggtaagacggagcttgctaagcaattggcactcgatatgtttggaacccaggatgcgattatccgtttggatatgtctgaatacagtgaccgcacagctgtttctaagctaattggtacaacagcaggctatgtgggttatgatgacaatagcaataccttaacagaacgtgttcgtcgcaatccatactctatcattctcttggatgaaattgaaaaggctgaccctcaagttattacccttctcctccaagttctagatgatggtcgtttgacagatggtcaaggaaatacagtaaacttcaagaacactgtcattattgcgacctcaaatgctggatttggctatgaagccaacttgacagaagatgcggataaaccagaattgatggaccgtttgaaccccttcttccgtccagaactcctcaaccgctttaatgcagtcatcgagttctcacacttgactaaggaagacctttctaagattgtagatttgatgttggctgaagttaaccaaaccttggctaagaaagacattgacttggtagtcagtcaagcggctaaagattatatcacagaagaaggttacgacgaagtcatgggggttcgtcctctccgtcgagtggttgaacaagaaattcgtgataaggtgacagacttccacttggatcatttagatgctaaacatctggaagcagatatggaagatggcgttttggttattcgtgagaaagcctaa

SEQ ID NO: 1347 - DNA, 240 bp, Streptococcus pneumoniae
ttgttctttgattttcattgtgtatttaaacacaaaaacaccctaaaacatcagggtgccattcttacatcaaatataaaattgctagggtcaggagacttgctagaagcccaactccccaaaagaagaagtcaaccttccactcgctccaaggatttcctttaccagacaatcccccaagctcaaaatggtgatgtacaggcgtcatacggaaaatacgtttaccacctgtcagtttga

SEQ ID NO: 1348 - DNA, 981 bp, Streptococcus pneumoniae
atgtttatttccatcagtgctggaattgtgacatttttactaactttagtaggaattccggcctttatccaattttatagaaaggcgcaaattacaggccagcagatgcatgaggatgtcaaacagcatcaggcaaaagctgggactcctacaatgggaggtttggttttcttgattacttctgttttggttgctttctttttcgccctatttagtagccaattcagtaataatgtgggaatgattttgttcatcttggtcttgtatggcttggtcggatttttagatgactttctcaaggtctttcgtaaaatcaatgaggggcttaatcctaagcaaaaattagctcttcagcttctaggtggagttatcttctatcttttctatgagcgcggtggcgatatgctttctgtctttggttatcaagtgcatctagggattttctatattgttttcgctcttttctggctagtcggtttttcaaacgcagtaaacttgacagacggtgttgacggtttagctagtatttccgttgtgattagtttgtctgcctatggagttattgcctatgtgcaaggtcagatggatattcttctagtgattctggccatgattggtggtttgctcagtttcttcatctttaaccataagcctgctaagatctttatgggtgatgtgggaagtttggctttaggtggaatgctggcagctatctctatggctctccaccaagaatggactctcttgattatcggaattgtgtatgtttttgaaacaacttctgttatgatgcaagtcagttatttcaaactgacaggtggtaaacgtattttccgtatgacgcctgtacatcaccattttgagcttgggggattgtctggtaaaggaaatccttggagcgagtggaaggttgacttcttcttttggggagttgggcttctagcaagtctcctgaccctagcaattttatatttgatgtaa

SEQ ID NO: 1349 - DNA, 2253 bp, Streptococcus pneumoniae
atgaagtggacaaaaagagtaatccgttatgcgaccaaaaatcggaaatcgccggctgaaaacagacgcagagttggaaaaagtctgagtttattatctgtctttgtttttgccatttttttagtcaattttgcggtcattattgggacaggcactcgctttggaacagatttagcgaaggaagctaagaaggttcatcaaaccacccgtacagttcctgccaaacgtgggactatttatgaccgaaatggagtcccgattgctgaggatgcaacctcctataatgtctatgcggtcattgatgagaactataagtcagcaacgggtaagattctttacgtagaaaaaacacaatttaacaaggttgcagaggtctttcataagtatctggacatggaagaatcctatgtaagagagcaactctcgcaacctaatctcaagcaagtttcctttggagcaaagggaaatgggattacctatgccaatatgatgtctatcaaaaaagaattggaagctgcagaggtcaaggggattgattttacaaccagtcccaatcgtagttacccaaacggacaatttgcttctagttttatcggcctagctcagctccatgaaaatgaagatggaagcaagagcttgctgggaacctctggaatggagagttccttgaacagtattcttgcagggacagacggcattattacctatgaaaaggatcgtctgggtaatattgtacccggaacagaacaagtttcccaacgaacgatggacggtaaggatgtttatacaaccatttccagccccctccagtcctttatggaaacccagatggatgcttttcaagagaaggtaaaaggaaagtacatgacagcgactttggtcagtgctaaaacaggggaaattctggcaacaacgcaacgaccgacctttgatgcagatacaaaagaaggcattacagaggactttgtttggcgtgatatcctttaccaaagtaactatgagccaggttccactatgaaagtgatgatgttggctgctgctattgataataatacctttccaggaggagaagtctttaatagtagtgagttaaaaattgcagatgccacgattcgagattgggacgttaatgaaggattgactggtggcagaatgatgactttttctcaaggttttgcacactcaagtaacgttgggatgaccctccttgagcaaaagatgggagatgctacctggcttgattatcttaatcgttttaaatttggagttccgacccgtttcggtttgacggatgagtatgctggtcagcttcctgcggataatattgtcaacattgcgcaaagttcatttggacaagggatttcagtgacccagacacaaatgattcgtgcctttacagctattgctaatgacggtgtcatgctggagcctaaatttattagtgccatttatgatccaaatgatcaaactgctcggaaatctcaaaaagaaattgtgggaaatcctgtttctaaagatgcagctagtctaactcggactaacatggttttggtagggacggatccggtttatggaaccatgtataaccacagcacaggcaagccaactgtaactgttcctgggcaaaatgtagccctcaagtctggtacggctcagattgctgacgagaaaaatggtggttatctagtcggggtaaccgactatattttctcggctgtatcgatgagtccggctgaaaatcctgattttatcttgtatgtgacggtccaacaacctgaacattattcaggtattcagttgggagaatttgccaatcctatcttggagcgggcttcagctatgaaagactctctcaatcttcaaacaacagctaaagctttggagcaagtaagtcaacaaagtccttatcctatgcctagtgtcaaggatatttcacctggtgatttagcagaagaattgcgtcgcaatcttgtacaacccatcgttgtgggaacaggaacgaagattaaaaacagttctgctgaagaagggaagaatcttgccccgaatcagcaagtccttatcttatctgataaagtagaggaagttccagatatgtatggttggacaaaggagactgctgagacccttgctaagtggctcaatatagaacttgaatttcaaggttcgggttctactgtgcagaagcaagatgttcgtgctaacacagctatcaaggacattaaaaaaattacattaactttaggagactaa

SEQ ID NO: 1350 - DNA, 318 bp, Streptococcus pneumoniae
atggcagaaaaaatggaaaaaacaggtcaaatactacagatgcaacttaaacggttttcgcgtgtggaaaaagctttttacttttccattgctgtaaccactcttattgtagccattagtattatttttatgcagaccaagctcttgcaagtgcagaatgatttgacaaaaatcaatgcgcagatagaggaaaagaagaccgaattggacgatgccaagcaagaggtcaatgaactattacgtgcagaacgtttgaaagaaattgccaattcacacgatttgcaattaaacaatgaaaatattagaatagcggagtaa

SEQ ID NO: 1351 - DNA, 951 bp, Streptococcus pneumoniae
atgacaaaagaatttcatcatgtaacggtcttactccacgaaacgattgatatgcttgacgtaaaacctgacggtatctacgttgatgcgactttgggtggagcaggccatagcgagtatttattaagtaaattaagtgaaaaaggccatctctatgcctttgaccaggatcagaatgccattgacaatgcgcaaaaacgcttggcaccttacattgagaagggagtggtgacctttatcaaggataacttccgtcatttacaggcacgtttgcgcgaagctggtgttcaggaaattgatggaatttgttatgacttgggagtgtctagtcctcaattggaccagcgtgagcgtggtttttcttataaaaaggatgcgccactggacatgcggatgaatcaggatgctagtctgacagcctatgaagtggttaatcattatgactatcatgatttggttcgtattttcttcaaatacggtgaggataaattctctaaacagattgcgcgtaagattgagcaagcgcgtgaagtgaagccgattgagacaacgactgagttagcagagattatcaagttggtcaaacctgccaaggaactcaagaagaagggtcatcctgctaagcagattttccaggctattcgaattgaagtcaatgatgaactgggggcggcagatgagtccatccagcaggctatggatatgttggctctggatggtagaatttcagtgattacctttcattccttagaagaccgcttgaccaagcaattgttcaaggaagcttcaacagttgaagttccaaaaggcttgcctttcatcccagatgatctcaagcccaagatggaattggtgtcccgtaagccaatcttgccaagtgcggaagagttagaagccaataaccgctcgcactcagccaagttgcgcgtggtcagaaaaattcacaagtaa

SEQ ID NO: 1352 - DNA, 195 bp, Streptococcus pneumoniae
atgaatcgtgtgaaagaatttcgcaaggaactgggcatttcccagctcgagctcgccaaggatatcggtgtctcgagacagaccatcaatatgattgaaaacgacaagtacaatccaactctggaactctgtctcaatctcgcccgcagcctccaaactgacctcaacagtctcttttggaaggaagatttttaa

SEQ ID NO: 1353 - DNA, 426 bp, Streptococcus pneumoniae
ttgagggtatttataggccagaaggagtggaataagatttccgaaaatcatcagataaaagaggacgataaagacttggttcccaatactatcggcctcacgccgtttgtattcgtcaaggggaccagaaataccgtatgtgcgtttgatcagtttttcagtgaaggtttcttttttcatgagtttgctccttttttaaaaatcttccttccaaaagagactgttgaggtcagtttggaggctgcgggcgagattgagacagagttccagagttggattgtacttgtcgttttcaatcatattgatggtctgtctcgagacaccgatatccttggcgagctcgagctgggaaatgcccagttccttgcgaaattctttcacacgattcatctggtctcctttctgatttgtgtcgtatatatttga

SEQ ID NO: 1354 - DNA, 282 bp, Streptococcus pneumoniae
atgaaaaaagaaaccttcactgaaaaactgatcaaacgcacatacggtatttctggtccccttgacgaatacaaacggcgtgaggccgatagtattgggaaccaagtctttatcgtcctcttttatctgatgattttcggaaatcttattccactccttctggcctataaataccctcaagaagtggctctaatctatcctcctctgattttagtgattgccctcatcgctgctggctatgtcacctaccaaatgaaaaaaaacaggcatcacagtcattga

SEQ ID NO: 1355 - DNA, 255 bp, Streptococcus pneumoniae
atgctgaatgagaaagaaagcaagcaactacactacccaggtctgaaagcaggtttgttctttggtctatggatgttttttataactcctcttctcagtatactcatagatgaaggtcaggactattttcattctcttctcactataagaaatggtgtatcaagtattctcggttctattttcttcggagcgagcatacagtttctcatctcccgtcgcattgcaaaaactaagaaaaatcaagatgaggattag

SEQ ID NO: 1356 - DNA, 243 bp, Streptococcus pneumoniae
atgaaaaaagaaaagaaacagttacgttatcctggtctgaaagcaggttcgatttatggaacagtgatattttttataattccactcattgataccctaacaagtgaaaatccaaattttatcagttctcttctaaatacaaaacatatttttaaaactatgctgggagctttctttttcggagtgatgatacatattgtcgactcacttcgtattgcaagagctaaaaaagaccaggattag

SEQ ID NO: 1357 - DNA, 336 bp, Streptococcus pneumoniae
atgaaatcactagctagactactgaacattcatgtttttatcagtattttccttttctttgcccttatttcaggagctgtttctcatacagttttactactcctactcctctttcttcctgcgctcaataaaggacttgagaaaatacaatcaaaacggatacctgtcctcaacgcagccctcttctttctcctcatatcctttccacaacttttaaccaaccctgtccaatggaaattttcaatattcctagtcgtaaccatcatttcaagtttggcctacttctataacttttatcaagtagttaaagaagtagatcaaaaacagttgatttag

SEQ ID NO: 1358 - DNA, 192 bp, Streptococcus pneumoniae
acattcatgtttttatcagtattttccttttctttgcccttatttcaggagctgtttctcatacagttttactactcctactcctctttcttcctgcgctcaataaaggacttgagaaaatacaatcaaaacggatacctgtcctcaacgcagccctcttctttctcctcatatcctttccacaacttttaa

SEQ ID NO: 1359 - DNA, 1002 bp, Streptococcus pneumoniae
ttggagaagaaactgaccataaaagacattgcggaaatggctcagacctcgaaaacaaccgtgtcattttacctaaacgggaaatatgaaaaaatgtcccaagagacacgtgaaaagattgaaaaagttattcatgaaacaaattacaaaccgagcattgttgcgcgtagcttaaactccaaacgaacaaaattaatcggtgttttgatcggtgatattaccaacagtttctcaaaccaaattgttaagggaattgaggatatcgccagccagaatggctaccaggtaatgataggaaatagtaattacagccaagagagtgaggaccggtatattgaaagcatgcttctcttgggagtagacggctttattattcagccgacctctaatttccgaaaatattctcgtatcatcgatgagaaaaagaagaaaatggtcttttttgatagtcagctctatgaacaccggactagctgggttaaaaccaataactatgatgccgtttatgacatgacccagtcctgtatcgaaaaaggttatgagcattttctcttgattacagcggatacgagtcgtttgagtactcggattgagcgggcaagtggttttgtggatgctttaacagatgctaatatgcgtcacgccagtctaaccattgaagataagcatacgaatttggaacaaattaaagaatttttacaaaaagaaatcgatcccgatgaaaaaactctggtatttatccctaactgttgggccctacctctagtctttaccgttatcaaagagttgaattataacttgccgcaagttgggttgattggttttgacaatacggagtggacttgcttttcttctccaagtgtttcgacgctggttcagccctcctttgaggaaggacaacaggctacaaagattttgattgaccagattgaaggccgcaatcaagaagaaaggcaacaagtcttggattgtagtgtgaattggaaagagtcgactttctaa

SEQ ID NO: 1360 - DNA, 1902 bp, Streptococcus pneumoniae
atgaaagaagaaagaagacaattttttgaaagaatcgatggaaaccaatgtcgtgattatatcttgtcgcactgttcaaaagactatgagaaagtcaagagttcccttgaacgcttgatggacaatcgttttatgtttgatagtccttgggatatggagccttgttcaaaaatccatcaaaaccagccgatggtatgggatcaagtatttgaagatgatccagaatgggcttatatgctcaatcgacaagaatatctcttgcagtttatgatagggtatgtggtagaaggagataaggactatattcaaaagtgcaagttctttctatttgattggattgagcaggtgagagaattttctcctcaatccttgatgactagaaccttggatacgggtattcgttcctttacttggttgaaactactcttgcttctcttgaaatttgacttgctagaggagaaagaactagagaaaattttggtcagtctagaaaagcagattgactttatgaaaagctactatcgcgccaagtacacccttagtaactgggggattttacaaacaattccgatgcttgctatctatcatttcttttcagataagatggacctagaagaagcttaccattttgcttcagaggagttgaaacagcaaattgagacacagattttaggagatggaagccagtttgaacagtcgattctctatcatgtagaggtttataaagccttgctggatttgtgtctcttgcttccagacttgcaagatagttaccaagagttgctggaaaagatggcgacctatattcaaatgatgacaggcttagatggacggactttggcttttggtgatagcgattctacagaaacgacagaaatgttgagcctgtctgctgtggttttgaacaaggaagaccttcttaacggtctggatgttaaagttgatttgcttagcctcttgttcctggggcgagaaaaggtcaagcgactgcaggaatttgaaaggagagcttggcagcctaagtccatgatctttgaagactctggacatgtctgcattaaggatgaacatcgttatctatttttcaaaaatggtccgctaggaagtgcccatagccatagtgacgagaatagtttttgcttacagtatcaaggccaacctattttcatagatgctgggcgttattcttatcgggagatatatgaacgttatctcttaaagagtgcttggagtcattcgacctgcattgtagatgggaaagctccggaaagaatcacgggatcctgggaatatgaatactatcctcactccctgttttgtcaccataaagaaagggagggagtgcattatattgagggggcttattggtcagcagaacctgatttgccttatcttcacaagagaaaaatcctcatgttggtagaggatgtctggctcttggtagatgacatcaggtgtcaaggtcagcatgaggcgttgactcagtttatccttgacaaggatgtgacctatcaagatgggaaaatcaatcagttgagactatggagtgaagttgattttgatttggaagataccatcatttctcctaaatacaatgagcttgaaagaagtagcaaactcaccaagcgccaattctttgagaatcagatgctggattataccatcattgcgcatgagagttttgaaatcatccgtcattctgtctaccagacagatgatcgtgaagtggaaaatgctctggcttttgaagtgaaaaatgacgaaacagacaagctgattctgttattaagcgaggatatttgtgtaggtgaaaaattgtgcctcgttgacggaacaaaaatgcgtggaaaatgtctagtatatgataaaataaatgagagaatgattcgcttgcagtgctag

SEQ ID NO: 1361 - DNA, 294 bp, Streptococcus pneumoniae
atggatacaacattgttttatggaatagtgattgtcttggcagtgagtccccttttactgtcaagctttcattctattcgtcagcaaaagttgcttcgcaaacagatggagcaacgacaagagtatttagcttctttaacatctggtgatgaagtgttgttattgtctggaattcatggaaaaatcatttctatccaagatgacttggtctccttgcagattgcaaaaggtgtggtcatctatgtagaaaaggaaagtgtaatgggaaagacaaaagaactgctttttaagtag

SEQ ID NO: 1362 - DNA, 819 bp, Streptococcus pneumoniae
atgactggatctaacaaattaacaaaacgtgattatcttaaaacgtctttgcgggcattcttttgtcaaaatggatttaactatagtaactatcaagggttgggatatgccaatgtgatgtatcctgctttgaaaaaacactatggagaggatcaggaaggtttctaccaagccttggaagaaaactgtgaattctataataccaacccacacttcctgccttttattaccagcttgcaccttgtaatgttggaaaatggccgtccggcaaaagaaacacgtagtatcaagatggccttgatgggaccattggcaggtattggggattctctttctcaattctgtttagctccattgttctcaaccatcgcagcttcgtttgctcaaaaaagcttggttgtcggtccaatcttgttcttccttgcgatgaatacgattttaacagcgattaaattgtcaactggtctgtatggatacaaactaggaacaactgtgattgataaactaagcgaacagatggcaacgatttctcgtattgccaatattatcggtgtaaccgtaattgctggtttggcagcgacatctgttaagattatggtgccgattacctttgctgcaggggaagttaaagcagacgctaaacaaagtatcgtaagtattcagggaatgcttgataaggttgctccagctcttctaccagccctatttacacttttagtttactacttgatcaaagaaaagaaatggacaacatataaactcgttattttaacagttatcatcggaattatcggaagctggcttaagattatagcttaa

SEQ ID NO: 1363 - DNA, 780 bp, Streptococcus pneumoniae
atgtcgattaatgtatttcaagcgattttaattggattatggacagctttctgttttagtggaatgctgttaggaatttacaccaatagatgtattgttctgtcatttggtgtcggaattattctaggtgatctgcctactgctcttgcaatgggagctattggtgaattggcttatatgggattcggtgttggtgctggaggtactgttccaccaaacccaatcggacctggtatctttggtaccttgatggctatcactagtgctggtaaagtcagtccagaagcggctcttgccctctctactccgattgctgtggcgattcaattcttacaaactttcgcctacactgtacgtgctggtgcgcctgaaacagcgatgaagcacttgaaaaaccataatttgaagaaattcaagttcactctaaatgcaacaatttggttgtttgcctttattggatttaccttgggttgcttgggtgccctttcaatggataccttgttgaaactcgtagactacattccaccggtattgcttacaggtttgacagttgctggtaaaatgctcccagctatcggttttgcgatgatcttgtcagtgatggctaagaaagagttgattccctttgtcttgttgggatatgtttgtgcagcttatctaaacatcccaacaattggtattgcaattgtaggtactatctttgctttgattgaattttataacaagccaaaaacagcggatcatgtggtagaggaggaagcacacgatgactggatctaa

SEQ ID NO: 1364 - DNA, 492 bp, Streptococcus pneumoniae
atgacaatgccaaatattattatgacccgtatcgatgaacggttgattcatggacaaggacaactttgggtaaaatacctaggttgtaatacggtcattgttgccaatgacgaagtaagcacggacaagatgcaacaaactctgatgaaaacagttgtgccagactcagttgccatgcgtttcttccctttgcaaaaggtgattgatatcattcacaaggctaatcctgctcaaacgatctttatcgttgtaaagaatgtgaaggatgctttaaccttggtagaaggtggtgtccctatcaaagaaatcaatattgggaacattcacaatgctactggtaaagagcaagtgacacgctccatcttcctaggtgaagaggacaaggtggccctcaaggaattgagccaaactcatcaagtaacatttaatacgaaaacaactccaacaggaaatgatggagctgttcaagtcaacattatggactatatttaa

SEQ ID NO: 1365 - DNA, 1008 bp, Streptococcus pneumoniae
atggataacacggaatggaccaatggtttctggacaggagaactgtggttggcttatgaatacagtcaacaggatgcatttaaaaacatcgctcataaaaatgttctttctttcctggatcgtgtcaataagagagtagaattggatcaccatgatctcggcttcttgtacacaccgtcttgtatggctgaatataagataaatggagatggagaggctagagaagcaaccttgaaagctgcagataagttgattgaacgctatcaagaaaaaggtggttttattcaagcttggggagacttgggcaagaaagagcattaccgtttgattatcgactgcttgctcaatatccaactcttattctttgcttatcaagaaacaggcgatcaaaaatactacgatattgcagaaagtcatttctatgcttcagctaataatgtaatccgtgatgacgcttcgtccttccacaccttctattttgatcctgagacaggtcaaccctttaaaggtgtaacgagacaagggtatagtgatgattcatgctgggcacgtggtcaatcatggggagtctatggtattcctttgacttatcgtcacttaaaagacgagtcctgctttgacttgtttaagggtgtgaccaattatttcttgaatcgtctgccaaaagatcatgtgtcctattgggatttgatttttaatgatggtagtgatcaatcacgagattcttcagcaacagctatcgccgtctgtgggattcatgaaatgctaaaacatctcccagaggtggatgctgacaaagatatttataaacatgctatgcatgccatgcttcgttccttgatcgaacattatgcaaatgatcaatttacccctggtgggacaagtctcctccacggtgtgtactcatggcattcaggtaaaggagtggatgaaggcaatatctggggtgactactattacctagaagcccttatccgtttctacaaagactggaacctatattggtag

SEQ ID NO: 1366 - DNA, 438 bp, Streptococcus pneumoniae
ttggatattgagcaagcagtcgataatcaaacggtaatgctctttcttgcccaagtctccccaagcttgaataaaaccacctttttcttgatagcgttcaatcaacttatctgcagctttcaaggttgcttctctagcctctccatctccatttatcttatattcagccatacaagacggtgtgtacaagaagccgagatcatggtgatccaattctactctcttattgacacgatccaggaaagaaagaacatttttatgagcgatgtttttaaatgcatcctgttgactgtattcataagccaaccacagttctcctgtccagaaaccattggtccattccgtgttatccatgattggatagacattatcaaaggtagctggtgtcgggaaatcttccttgaaatagtcaaggttgagttgctaactgccgaataa

SEQ ID NO: 1367 - DNA, 435 bp, Streptococcus pneumoniae
atgaaaattgtacttgtagggcatggacattttgctacagggatttatagttctttacaattgattgcaggcaatcaagaaaatgtggaggcgattgactttgtggaaggaatgtcagcagatgaactcaagcaaaaaatcttacttgcaatttcaaatgaagaagaagttttaatcctaagtgatctcttgggaggatcgccattcaaggtttcttctaccataatgggagaaaatccagccaaaacaatgaatgttctctcgggtttgaacttagccatgttaatggaagcagtctttgctagaatggctcatagctttgatgaagttgttaataaatcagtagtggcggcccagggcggagtcgtaaatggtaaagaattgttttcaacggatgcagaggaagaggaagaagatttcgaatcgggtatttaa

SEQ ID NO: 1368 - DNA, 654 bp, Streptococcus pneumoniae
atgacaaatacatcattctcaattgagcagttttctttaaaaggaaaaattgctctcatcaccggcgcttcttatggaattggatttgctattgccaaatcctacgctgaagccggcgctactattgtctttaacgatatcaatcaagatctggtcaataaagggattgaagcttatcgtgaagttggcatcgaagcccatggatatgtctgtgacgtgacagacgaggacggtatccaagccatggtcaagcaaatcgaacaagaggttggtgtcattgacatcctcgttaataacgctggtattatccgccgagttccaatgtgcgaaatgagcgccgctgatttccgtaaggtcatcgatattgacttaaacgcaccatttatcgtttcaaaggcagttattccttctatgataaagaaagggcatggaaagattatcaatatttgttcgatgatgagcgaactgggacgtgaaacagttagcgcttatgctgctgctaaagggggcttgaaaatgttgacccgcaacattgcgtctgaatacggtggagccaatatccaatgtaacggaattggaccgggttatattgccactcctcaaacagcacctcttcgtgagttgcaagaagagtggttctcgccacccatttga

SEQ ID NO: 1369 - DNA, 375 bp, Streptococcus pneumoniae
atgtggccattgacaaaattgctggcatcactagcgagaaagacagcagggcccatcaaatcttcaggatttccccaacgtgcagcaggtgtttttgcaatgatgaactggtcaaatgggtggcgagaaccactcttcttgcaactcacgaagaggtgctgtttgaggagtggcaatataacccggtccaattccgttacattggatattggctccaccgtattcagacgcaatgttgcgggtcaacattttcaagccccctttagcagcagcataagcgctaactgtttcacgtcccagttcgctcatcatcgaacaaatattgataatctttccatgccctttctttatcatagaaggaataactgcctttga

SEQ ID NO: 1370 - DNA, 294 bp, Streptococcus pneumoniae
cccgcaacattgcgtctgaatacggtggagccaatatccaatgtaacggaattggaccgggttatattgccactcctcaaacagcacctcttcgtgagttgcaagaagagtggttctcgccacccatttgaccagttcatcattgcaaaaacacctgctgcacgttggggaaatcctgaagatttgatgggccctgctgtctttctcgctagtgatgccagcaattttgtcaatggccacatcctatatgtagatggcggtatcttagcctacatcggaaaacaacctgagtaa

SEQ ID NO: 1371 - DNA, 642 bp, Streptococcus pneumoniae
atgaaaatcgcattaatcaatgaaaatagtcaagctagcaagaatcacattatttacgatagtctaaaagaagcgacagataaaaaaggctaccaattatttaactatggtatgcgtggagaagaaggagaaagtcaattaacttatgtgcagaacggactaatggctgccatccttttaaatacaaaggcagttgactttgttgttaccggctgtggtacgggtgtaggggctatgcttgctttaaacagcttccctggtgttgtctgtggtctagcagtggacccaactgacgcttacctttattctcaaatcaatggtggtaacgccttgtctatcccttatgccaaaggatttggctggggggcagaactgaccctcaaattgatgtttgaacgcttatttgctgaagaaatgggcggtggctacccaagagaacgtgtaatccctgaacaacgcaacgctcgtatcttaaacgaggtgaaacaaatcacccacaatgatttgatgaccatccttaaaataatcgaccaagacttcctcaaagacaccatctctggcaaatacttccaagaatacttctttgaaaactgccaagatgatgaagttgctgcttatttgaaagaagtattagccaagtaa

SEQ ID NO: 1372 - DNA, 1002 bp, Streptococcus pneumoniae
atgacgaaaatattactgtttggagaaccattaattcgaatctcaccattagatgccaccagtatcggcgatcatgttgccagttcgacttattttggcggatcagaaattaacatcgcttgtaatttgcaagccctgggtatctcaacgaaagtctttaccgcactccctgccaacgagattggagatcgttttctcacattcttgaaacagcaccaaatcgataccagttcaatctgtcggcttggcgatcgaatcggcctctactatttggagaacggctttggttgtcgtcaaagtgaagttttctacgatcgtaagcatacgagtatcagccagattcggccaaacatgctagatatggattctctctttcaggggattagccattttcattttagtggaatcaccgtagctatcggtcaagaggtccgtgcgatccttctcctactcttggaagaagccaagcgccgaggaattgtcgtttcaatggatctcaatctgagaacaaagatgatttcagtcctagaagccaagtatgaattttctaagtttgcacgttttactgactattgcttcggtattgatcctctcatgattgatgaccaaaatctagagatgtttccaagagacagtgctagcctagaagaggtggaaaatcgcatgcgacttttaaaagaagcctatggtttcaaggccattttccataccctccgatctagtgatgagcaagacaaaaatgtctatcaagcctatgctctggaagaacgatttgaagagtctgtccaactaaaaactgcagtctatcaacgaattggtagcggggatgcctttatatctggtgccctttaccaactactccatcattcctccctaaaaactaccattgactttgcagttgcgagcgcaactctcaaatgcactcttccaggagaccatctctccacttccgcaactagtattgaaaatttactggcaaatgcacaagatatcattcgttag

SEQ ID NO: 1373 - DNA, 630 bp, Streptococcus pneumoniae
atgaccaaatcagatacgattattgaactaaaaaaacagaaaattgtcgctgtcattcgaggaaatacaaaggaagaaggactacaagcctcgattgcttgtatcaagggcggtatcaaagctattgaaatcgcctataccaatcagtatgcaggacaaatcatcaaggaacttgtagacttgtatcaggacgatcagagtgtttgtatcggtgcaggtactgtgcttgatgccgtaactgctagagatgccattctagctggagcaaattacgttgtttctccatctttccatgctgaaactgcgaaaatgtgcaatctctacagcacaccgtacattccaggctgtattaccctcacagagatcacgactgcacttgaagccggtagtgaaatcatcaaactcttcccaggtagtactctcagtccagcatatatctctgcagtcaaggcaccgatcccacaagtttccgtaatggtaaccggaggagtcggcctaaacaacatccctcaatggttcgctgctggtgcagatgccgttggaattggtggcgaactcaataaactcgcttcccaaggcaactttgaccgcatcagcgagattgcccaacagtatattacactcagataa

SEQ ID NO: 1374 - DNA, 354 bp, Streptococcus pneumoniae
gtggaggtgttctatcacattgtgttcacccctaagtatagacgaaaagtcatctataatcaatatagaagtagtttaggcgaaatatttcatcgcttgtgtagttataaaggtgttgaaatgatcgagggtcacttaatgccagaccatgtacacatgttagtcagtattccgtcgaggctaagtgtttcaagttttatggggtatttaaaaggcaaaagtgcactcatgatgtttgacaaacacgccaatctcaagtacaagtttgggaatcggcatttctgggcggaaggttattatgtaagtccagtagggcttaatgaagccacaattaagaaatatagtcaagattaa

SEQ ID NO: 1375 - DNA, 3237 bp, Streptococcus pneumoniae
ttgattttacaatatgtttattggagtgtatacatgcaaacaaaaacaaagaagctcattgtgagtttgtcttcacttgttttatcaggatttttattaaaccattatatgacagttggagcggaagaaacgactacgaatactattcagcaaagccagaaggaagttcagtatcagcaaagggatacaaaaaatttagttgaaaatggtgattttggtcagacggaggacggaagcagtccgtggacaggaagcaaagctcaggggtggtcaacttgggtagaccagaagaatagttctgcagatgcctcaactcgagtcattgaggctaaggatggggctatcactatctcaagccctgagaaattaagggcagcggttcaccgtatggttcctattgaagctaagaaaaagtataaactgcgtttcaagattaaaacagataataaagtcgggattgccaaagttcgtatcattgaggaaagtggtaaggacaagcgattgtggaattctgcaacgacgtcaggaacaaaggactggcagaccattgaagcagactatagcccgactttagatgttgataaaatcaagctggagttattctatgaaacaggaactgggactgtttcctttaaggatattgagctggtagaggtagcagaccagctttctgaggattctcaaacagataaacagcttgaggaaaagattgatttaccaattggaaaaaaacatgttttttctcttgcggactatacttataaggtagaaaatcctgacgttgcttcagtcaaaaatggaattttagaacctcttaaggaagggacaaccaatgtcattgtcagtaaagatggcaaggaagtgaaaaagattcctttgaagattctagcctctgttaaggatgcatacacagcccgtttggatgactggaatggcatcatcgctgggaatcaatactatgattctaaaaatgaacagatggccaaattaaaccaggaattggaaggaaaggtagctgatagcctatctagtatttcaagtcaggcggaccgcacctatttgtgggaaaaattttcaaattataaaatgtctgcaaatctgactgccacttatcggaaattggaggagatggccaagcaagtgaccaatccttcttctcgttattatcaagatgaaactgtcgttcgaacagtcagggattccatggaatggatgcataaacatgtctacaatagtgaaaagagcattgttgggaactggtgggattatgaaatcggtacacctcgtgccatcaacaataccttgtctctgatgaaagaatacttctctgatgaggaaattaaaaaatatacagatgtaattgaaaaatttgtaccagaccccgaacatttccgaaagacgactgataacccatttaaggctctaggtggaaacttagttgatatgggaagagtaaaagtaatagctggtttactgcgtaaagatgatcaagaaatttcttctaccattcgctcgattgagcaagtgttcaagttggtagaccaaggtgaaggtttttatcaagatggatcctatatcgaccacaccaatgttgcctatacgggtgcttatgggaatgttttgattgatggcctgtctcaactgttgccagtcattcaaaagaccaagaatccaatcgataaagataaaatgcaaaccatgtaccactggattgataaatcgtttgctcctttgctggtgaatggagagctgatggatatgagtcgtggacgctcgatcagtcgtgcaaatagcgaggggcacgtggccgcagtagaagtactaagagggattcaccgaatagcggatatgtctgaaggagaaaccaaacaacgtttgcagagtcttgtgaagaccattgttcaatcggatagttattatgatgtctttaagaatttgaagacttataaggatatcagtttgatgcaatccttgttaagtgatgcaggagtcgcaagtgttccaagaacaagttacctatctgcctttaacaagatggataaaacagccatgtacaatgcagagaaagggtttggatttggcttgtcactcttttccagtcgtaccttgaattacgaacacatgaacaaggaaaataaacgtggttggtatacgagtgatgggatgttctatctttacaatggcgatttgagtcactatagcgatggctactggccaacagttaatccatataagatgcctggtacaacagagacggatgctaagagagcggatagcgatacaggtaaagttttaccgtctgctttcgttggaacgagcaaactagatgatgccaatgcgacagcaaccatggatttcaccaactggaatcaaacattgactgctcataagagctggtttatgctgaaggataagatcgcctttttaggaagcaatatccaaaacacttcaacagatactgctgcaactacaattgaccagagaaaactggaatcaagtaatccatataaagtctatgtcaatgataaagaagcctcccttacagaacaagaaaaggattatcctgaaacccaaagtgtctttttagaatcgtccgattcgaaaaagaatattggttactttttctttaagaagagttcaatcagtatgagtaaggctttgcaaaagggagcctggaaggatatcaatgaaggacagtcagacaaggaagttgaaaatgaatttcttacgattagtcaggctcataagcaaaatggagattcttatggctatatgctcatccctaacgtggatcgtgccaccttcaatcaaatgataaaagagttagaaagtagcctcatcgaaaataacgaaacccttcagtctgtttatgatgctaaacaaggagtttggggcattgtgaaatatgatgattctgtctctactatttccaaccaattccaagttttgaaacgtggagtctataccattcgaaaagaaggggatgaatataagattgcctactataatcctgaaacccaggaatcagctccagatcaggaagtctttaaaaagctagagcaagcagctcagccacaagtacagaattcaaaagaaaaggaaaaatctgaagaggaaaagaaccattcggatcaaaagaatctccctcagacaggagaaggtcagtcaatcttggcaagtctagggttcttgctacttggggcattttatctattccgtagaggaaagaacaactaa

SEQ ID NO: 1376 - DNA, 477 bp, Streptococcus pneumoniae
atgacttcactttatgatttttccgttttgaaccaaaacaaccaagcaactcccttggatagctatcgtggcaaagttctcttgattgtcaacactgctactggatgtggtttaacgccccagtaccagggacttcaagaactctatgaacgctatcaagatcagggcttcgaaatattggatttcccttgcaatcagtttatgggacaagcacccggcagcgcagaggaaatcaacgccttctgtagcctacattttcaaaccaccttcccacgttttgccaagattaaggtcaacggtaaggaagcagaccctctctatgtctggttaaaagaccataaatctggcccactaggaaaacgaatcgaatggaatttcgctaagtttctcattagtcgtgatgggcaagtctttgaacgcttttcttcaaaaacagacccaaaacaaattgaagaggcgatacaaactctactataa

SEQ ID NO: 1377 - DNA, 2214 bp, Streptococcus pneumoniae
ttgaaaatttttaagggagagttttatcgaatctctgtattaacagacaagctagtaaggttagaatactctcaaactggaagttttgaggatagaacgacacaacttatctataatagagattttggccaagtttcgttagattatatcgagacatcaaacgtactagatattatgacggactattttcatctgcactttaataaaggagaatttaacgccgaaaatttatttatagaattaaaaggaaattttgccgtatatggtagtcgctggtattttggtgaatctattgaaacgttaaaaggaacagctcggactctggataaggcagatggagcaatctcgttagaagatggaattattagccgaaatggtatagccttattggatgattctcaaggatttatttgggatgaacaatctggttatattgagagagaaaatcaaattgacctgtatttctttgcctatgggcatgattatagaggagcaatcagagatttttaccatttgactggttcaacacccttgttgccaagatatgctttaggcaattggtggagtagatattggccttatacgtcggatgaatacttggatttaatagacagatttgaaacagagaaaattccattatctatcggtgtgttagatatggattggcatataactgacattccagctcgctttggaagtggctggacaggatatagttggaatagaaacttaataccaaatccagaacagttattgcaacaacttcatgatagaaagctaaagctctccttaaatgtccatcctgctgatgggatacgggcttatgaagaagcttatcctcaaatcgcaaaacggttggggttaaatgtagaactagaagaacctgctatttttgatttttttaatccctcttttagggaagcctactttaaagatgttcattatgaactagaaaagcagggagtagatttttggtggattgactggcaacaagggacacaaggtatgctagatccactttggcttttaaaccattatcactatcaggatagttgtaaaaatgcagaaggtggtttgattttatcaagatatgcaggtcctggtagtcaccgctaccctgttggtttttcaggggacactattattagttggaattccttaagatttcaaccctattttacagcgacagcatctaatatcggttatagttggtggagtcatgatatcggtggacatatgttgggggattatgacgaagagctacaaactagatggctacagtttggtgtttttagtccgattactcgattacatagttctagaagtccttttaatagtaaagaaccttggttcttttcagaaacaacatctaagattatgaagaaataccttcgtttgagacatcagatgattccctatctatataccatgaatgtaaagacacatgaggaaggtgccccattaatcagtccaatctattatttctatccagagaatgatgagagctataatgttccaaaccaatacttttttggaacagaactgatggtggctcccattgtagaaaagatggatttgacattccaatctgcaaaagtagatgtatggttccctgaaggtgaatggtatgacttcttttcagagaaaaaatacacaggtggtgtgaagttaagtgtttatagggacatctcgactacgcctgtgtttgcaaaaagtggtgcaatcattcccttggttggttctgagataggtatgggtgttgatttacctgaagttgtagattggtatgtattcccaggaaaacaacattcttttgaaatgcttgaagatcaaaatggtcaaagatataaaacaagattatcaatcgattgggaaatgggaatggtagagttagcattacaaggagattctagtatcgttccaagcaatagaaaacatagaattcattttaaaggaacgaatgtgtctataattgaattgccaaataagaatgatacagctaaatttgaatggaaagataataaaaggacatctttaaatgacgaagtttttagactactaaagacagcttctcttccatatgaattaaaagatagattgttaaatcaattcatcaatgcgaaaaactctcatgacttaatgaatatcttgcatcatcaggataaggaattgagagggcgtttgttggaaatgatatttactagccaaaactaa

SEQ ID NO: 1378 - DNA, 183 bp, Streptococcus pneumoniae
ttgcttttttactattgtatcgtattctacgataacatactttactttattgtttttttaaataacagcagttccctgtttatcaactattcgaactactttctattttgcttcataccctacatagcgaaaaaatatgaaaaagcagagaagaatatcttaaaaagacctcttcactgctaa

SEQ ID NO: 1379 - DNA, 1347 bp, Streptococcus pneumoniae
atggatcaacaaaacgggttgtttggttttcttgaaaaccatgttatgggaccaatgggcaaacttgctcagtttaaagtagtacgtgctatcacggctgcaggtatggctgctgtaccatttactattgtaggatcaatgtttttggtattcagtattttgccacaagctttctcattttggccaattgtggcagatattttctctgcttcatttgataaattcagatcactttacatggttgcaaactatgcgactatgggttctctatctctttatttcgttctatcacttgcatatgaattgacaaaaatttatgcagaggaagaagaactcaatatgaatcctcttaatggtgccttgcttgccttgatggcttttgtcatgacagtaccgcaaatcatttttgatggtggaatgatgaagactgtgacaagtctaaaagaaggtgcagtaattgcagatggatgggcaatgggaaatggagtcgcacgttttgggacaacagggatttttaccgcaatcattatggcaattgtgactgttcttatttatcgtatgtgtgttaaacataattgggttattaaaatgcctgaagctgttccagaaggagtttctcgtggatttaccgctttggttccgggatttgttgttgcatttgttgttatctttatcaacggtcttcttgtagcaatgggaacagatatttttaaagtcattgcaattccatttggttttgtatccaatctgactaattcgtggattggtttaatgattatttatctattgactcaactactttggattgtaggtatccacggtgcgaacattgtttttgcatttgttagtccaattgctcttgccaacatggctgaaaatgctgctggcgggcacttcgctgttgcaggtgaattttctaatatgtttgtaattgcaggtggttctggtgcaactttaggactatgtttatatattgcttttgcctctaaatctgaacagcttaaagcaataggacgagcatctgtagttccagccttatttaatattaatgaaccattaatttttggattacctattatctataatccagccttggctataccatttattttagcaccaatggttactgctactatttattacgtagcgaattctctaaactttattaagccaattatcgcacaggttccatggccaactccagtagggattggagctttcttagggacagcagatcttcgagctgtattagttgctctagtatgtgcatttgcagcattcctagtctatcttccattcatccgtgtatatgatcaaaaattggtgaaagaagagcaaggtatctaa

SEQ ID NO: 1380 - DNA, 507 bp, Streptococcus pneumoniae
atggataaaaaagaacgacaaaagattgaacaacaacgtcgagagatggctctaactaatactttttttaatcgatatcttcttctacgttattcaatagcactcttcttttttgggaatatttattggcttttgaatcagtttattaatccctcgcctattattattttccccattatgctcatagtattttctattttagcaactgttgaacaatttaaactctatggaaataggaaagaaaagttgggaataacactaatgtttgttagaatacaaatgcttatttcaataggattacttgttttaacttggacaagttggtttaagaatctttttccgatttttgaaaataaccaagtagcacgtttatttgtttttgtagttcttctattaggtttagttctgagtttgttagacattagaagaattaaaaaaatttataaacgaacagataaggtttatcaacaatttgtccaattggaaaagaactcacttagtttataa

SEQ ID NO: 1381 - DNA, 315 bp, Streptococcus pneumoniae
atgaatcaagaggaactgcaggttgcagcatttgaaattatcctgcattcgggaaatgcaaggtcagaaatacatgaagcatttgcaaaaatgagagaaggtagttttgatgatgcagaaagtaaattaaatcaatcaaatgagataattcttgaagcgcatcatgcacaaaccaaactcttgcaagaatacgcaagtggagtggaaattaaaattgaaattatcatggtacatgctcaagatcatttaatgaccactatgacattattagaagtagcaaaggaaatgttagctctttataagaaagttaactaa

SEQ ID NO: 1382 - DNA, 1980 bp, Streptococcus pneumoniae
atgaatgtgttaaacattaaagagaaagatatccttcaatttttaataaaaaataaggaacgttttgttacaagcaaagaactagcagaatatttatcctgttcagatagaactgtccgtaatgtactgaaattaattgagaagacaatgattattcaaggagtccggttgatttcaaaacaaggtcaagggtatcaaatattttttgagaatcaaggcgcttaccaggagtttagacaaacttatgaactggaagaagactatacgaaaactgcggtttcaaaaggtgatgatcgtttagtatttatcttaaataaattattatttgagcaagttccagttctttttgatgatttagctgatgaactttacgttagtcgttcaacattatctcatgatttcagaaagatacgagtgatgttatcagagtataatttgtccattgagagtagggcgaataaaggagtttatgtctcaggcgaggaacgtgataaacgacgttttatcataaattatttcctagagaatcaattttttaaaacaatacattgctatgtaaaatttaacttttttgatcaaactgttccattagaagaatttgctagaattgttttggatgaatgccaagaggccaacctaaaactatctgattttgtactacagaatttagtagttcacatagcattgtctgtgattcgtttaaaatccggatttgaaataaaaaatatagactgtcagatgactgatgatgcaacagagagaaaggttgcccaaagaattctttctaaagtaagagaagtaacaaatcaggaatttccagttcaggaaatagactacattactttgcatttgttagctaagagtcaacaatgtcaaaaaaatcagaagaatatttctgaagaagttttaaaaaaatctttatttaaaacatttcagaatttaggattagatgatatgtataacttttcttcagatttccaactaattgaaggattgataactcatctaatgacactacaagtacgtttagaaagccggattaccttaaataaccctttagtagatgaaattaaacagaattatagtgatatattctttatgactagagaaattcttgcaaatatggacaagttcttggagtggacaatatcagatgatgaagtagcatatgtaagtcttcactttttagctgctatggaacgtagcaaagagagtactaagtttaatattcttgctatttgtgcaacaggatttggtgcagcccaaatgttaagaaatcgtttggaaacggagtttgggaagcgagtagaagttgttgatgtaataggctattatgaattgaatcaagaaaaacttaaaggaatagattttatagtgtcagctgttgatttatcaaatctatattttcaaatcccagtttttaaagttagtgtgtttcttaagagtgatgagatggaaatgattagaaaagctatggatcagatgcaagtttctagttatgtaccatcatcaaagattaacaaatttgaaaacaacggctttagacagtattttagtaaagaaaattttttaatatgtactgaatcagacaaggtaaatttacttgaaaagatggttgagggtttatctgttggtgaatcaaatgagtttgaacaatctttactttatggaattaaacagcgcgaagaattaagttcagttgttttttctgaaaaaattgcagttccgcatcctattcagccctttggtacagagggaaaggtttcggttgcaatctgtaaagattcgttactctgggataatcaaagttcatatgtccagctagtatttcttctatctccatcaatatatgggaacgaaggtttggcaactgtgactaaaaagatagtctctctgacagagaatgatgagttgcaaaatcagctaatatcttgcaataactttgaagattttattaacatatttgagaagataaaatag

SEQ ID NO: 1383 - DNA, 342 bp, Streptococcus pneumoniae
ttggatttaagaaaaggagaaaatattatggcaaaagctttaattatttgtgcagcaggaatgtcttcatcacttatggcacagaaaacaacagagtttctaaaaggaaaagggaaagatattgtagttgatgctattagtgctactgaaggagggaaagctatcgcagcagcagcttttgatttgtatcttgtcagccctcaaacaaaaatgtactttaagcaatttgaagaggctggttctaaagcaggaaaaccagttgtacaaatacctcctcaagcctatattcctattccaatgggaattgaaaaaatggctaatttgattcttgagaatatttga

SEQ ID NO: 1384 - DNA, 240 bp, Streptococcus pneumoniae
atgattggaagtattgcagcaattttaacaacatttgcatttttaccacaagtttttcgtgtagttaagacaaaggacacaggatctattgctctaggtatgtatgttatgcaagttattggtattgcattgtggcttgctcatggtattcgtataggagacttgcctttgattttagctaatagtgtttcatttctactttcaggaataattttattttataaattgaagtataaataa

SEQ ID NO: 1385 - DNA, 1479 bp, Streptococcus pneumoniae
ttgaggtttataataagagtatcaaagtcaggaggaaaaaagatgactacttttaaagatggatttttatggggtggtgctgttgctgctcatcaacttgaaggtggatggcaagaaggtggcaagggaattagtgttgctgatgttatgactgctggtcgtcatggagtagctcgtgaaattactttgggagttttagagggtaaatattatccaaatcatgaggcgatagatttttatcatcgttataaagaagatatagcactttttgctgaaatgggattcaagtgcttccgtacctctattgcatggacacgtatctttccaaaaggtgatgagttagagccgaatgaagaaggattacagttttatgataatctttttgatgaatgcttaaagaatggtattgaacctgtcatcactctatctcattttgaaatgccttatcacttagtgaccgaatatggtggttggaaaaataggaaattgattgatttctttgctcgttttgcagaagtcatatttaaacgttacaaagataaggttaaatattggatgactttcaatgaaatcaataatcaagcgaattatcaggaagattttgcaccatttactaactcaggtattgtatatgaggaaggtgataatagagaggcaattatgtatcaagcagcacattacgaattagttgcttctgcacgagctgtaaaaattggtcatgagattaatccagattttcaaataggttgtatgattgcgatgtgtccaatttatccagctacttgcaatcctaaggatatcttaatggcaatgaaagctatgcaaaagcgttattattttgctgatgtgcatgttttaggtaaatatcctgagcatattttcaagtattgggaacgaaaaggtatttcagttgattttactgcccaggataaagaagatttacttggtgggactgtagattacattggtttcagttactatatgtcctttgctatcgactctcatcgtgaaaataatccttattttgattatcttgaaacagaagatttagtgaaaaataattatgttaaggcttctgaatgggagtggcaaattgatccagaaggtttgcgttatgcgttaaattggtttacagaccactatcacttaccactctttattgttgaaaatggttttggagctatagataaagttgcagcagatggtatggtacatgatgattatagaattgaatatctaggtgcccatattcgtgaaatgaaaaaggctgtagttgaagatggtgttgatttaatgggttatactccatggggatgtattgatttagtttcagctggtaccggtgaaatgcggaaacgttatggctttatttatgtagataaagatgacaatgggaagggaagttataatcgttccccgaaaaaatcttttggctggtataaggaagttatttcatctaacggtgaatcagtagaatag

SEQ ID NO: 1386 - DNA, 366 bp, Streptococcus pneumoniae
ttgaaggatgattttggaggatataagatgacattgactattcatgtatattataaaggtgatggagatagtgcaataaagtttgcaagagaaatgcttgatagtggccttgttgaagaaattagaaatcaaaaaggtaacttgaaatacgaatattttttaccaattgaaaaagagggaactattctccttattgatcagtggataaatcaagaaactttagataaacattatcaatcaaagacaatgcagaaaatcttagatttaagaaaaaaatatcacttgcagatgcaagttgaacgttatatagaagatgattctgggatgccagaaagcgataagtcgtttatagacacagggaattag

SEQ ID NO: 1387 - DNA, 207 bp, Streptococcus pneumoniae
atggataatgcaagattccatagaatgggtaagctagaactcttgtgtgaagagtttgggcataaacttttacctcttcctccctactcatctgagtacaatcctattgagaaaacatgggctcatatcaaaaagcacctcaaaaaggtattaccaagttgcaataccttttatgaggctcttttgtcttgttcttgtttcaattga

SEQ ID NO: 1388 - DNA, 393 bp, Streptococcus pneumoniae
atgtcacaagcacaatatgcaggtactggacgtcgtaaaaacgctgttgcacgcgttcgccttgttccaggaactggtaaaatcactgttaacaaaaaagatgttgaagagtacatcccacacgctgaccttcgtcttgtcatcaaccaaccattcgcagttacttcaactgtaggttcatacgacgttttcgttaacgttgtaggtggtggatacgctggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaatttagtaaacgttaa

SEQ ID NO: 1389 - DNA, 447 bp, Streptococcus pneumoniae
atgaacaaaacaacatttatggctaaaccaggccaagttgaacgtaaatggtacgtagttgacgcaactgatgtaccacttggacgtctttctgcagtagttgctagcgtacttcgcggaaaaaacaaaccaacatttacaccacacactgatacaggtgacttcgtgattgttatcaatgctgaaaaagttaaattgactggtaaaaaagcaactgataaaatctactacactcactcaaaccacccaggtggattgaaacaaatctctgcaggtgaacttcgttctaaaaatgcagtacgtttgattgagaaatcagttaaaggtatgcttccacacaatacacttggacgcgctcaaggtatgaagttgaaagtatttgttggagctgagcacactcatgctgcacaacaaccagaagttcttgacatttcaggacttatctaa

SEQ ID NO: 1390 - DNA, 366 bp, Streptococcus pneumoniae
ttgataacaatcacgaagtcacctgtatcagtgtgtggtgtaaatgttggtttgttttttccgcgaagtacgctagcaactactgcagaaagacgtccaagtggtacatcagttgcgtcaactacgtaccatttacgttcaacttggcctggtttagccataaatgttgttttgttcatgatttctcctatatatagttcgatttttgtttacggtgatgggtgttccttcccatcgaaaagtatttggaaggttccggggcctttcaaatggggtaaacaataccgcctactatcataccaaatttcacccctaaaagtcaatagatatgaaaaatatttttcggtaacttctcaaagtaactga

SEQ ID NO: 1391 - DNA, 318 bp, Streptococcus pneumoniae
atggcttttaccaatacccacatgcggtctgctagttttggcattgttaccagcttgcctgatgacatcattgactctttttggtatattatcgaccatttcttaaaaaatgtctttgaattggaagaagaactcgagtttcaattgcttaataaccaaggaaagattaccttccacttttcaagtcaacacctccctacagccattgattttgactttaaccatcctttcgaccctcgttatcccccaagagtactggttttagacatggacggtagagaaactatcctcctcccagaagaaaatgacctattttaa

SEQ ID NO: 1392 - DNA, 393 bp, Streptococcus pneumoniae
ttgacaaactgcgagctcgtgggcatctatattctcaaagagtccagtgtcttagcgacggagccttggggtggagtggagcaggatagctttgccaatcaagtggttgaggtggaaacctggctaccagcacaagacttgttagaaaccttgttagccattgagtcagagctgggacgggtgagagaagtgcattggggacctcgtttgattgatttggacttgctctttgtggaggaccagatcctttatacagacgacctcatattgcctcatccttacatagcggaacgcctttttgtccttgagtccttacaggaaattgcgcctcattttatccatccgatattaaaacaaccgatccgtaacttgtatgatgctttgaaaaaatag

SEQ ID NO: 1393 - DNA, 510 bp, Streptococcus pneumoniae
atggatcaactgcagattaaggatttggaaatgtttgcctatcatggtctttttcctagtgagaaagaattggggcagaaatttgtcgtttcagccatcctatcctatgatatgaccaaggcagctacagacttggatttaacagcctctgtccattacggagaattgtgtcagcagtggacgacttggtttcaggaaacgagtgaagatttgattgaaacggtagcctataaactggtggaacgtacctttgagtcttatcctcttgtccaagaaatgaagttggaactgaaaaaaccttgggcaccggtgcatttgtcactagatacttgctcggtaaccattcatcgccgcaagcaacgagcctttatcgccctaggaagcaatatgggagataaacaagcaaacttgaagcaagccattgacaaactgcgagctcgtgggcatctatattctcaaagagtccagtgtcttagcgacggagccttggggtggagtggagcaggatag

SEQ ID NO: 1394 - DNA, 555 bp, Streptococcus pneumoniae
atggatacacaaaagattgaagcggctgtaaaaatgattatcgaggctgtaggagaggacgctaatcgcgagggcttgcaggaaacacctgctcgtgtagcccgtatgtatcaagagattttttcaggtcttggtcaaacagcagaggaacatttgtcaaaatcctttgaaattattgacgataatatggtggtagaaaaggatatctttttccataccatgtgtgaacaccacttcttgccattttatggtagagcgcacattgcctacattccagatggtcgtgtggcaggcttgtctaagctagcccgtacggttgaagtttattcgaaaaaaccacaaattcaagaacgtttgaatatcgaagtggccgatgccttgatggactatctaggtgctaaaggagcctttgttgtcattgaggcggaacatatgtgtatgagtatgcgtggtgttagaaaaccaggcactgcaaccttgacgacagtagctcgtggtctatttgaaacagataaggacctccgcgaccaagcttatcgtttaatggggctataa

SEQ ID NO: 1395 - DNA, 1323 bp, Streptococcus pneumoniae
atgaaagaaattgaaaacaatcagtggattgctaactaccggacggatcaaccgcattttggcttggaacgaatggtggaactgttagctttgcgtggcaatccccatctcaaactcaaggtcctccatatcggaggaactaacggcaagggctcgactattgcttttttgaaaaagatgctagaaaagctagggctgagagttggcgtgtttagctcgccctatctcattcattacacagaccagattagcatcaatggggaatcgatctcagaagtgaggctagaagctctcatggcagactatcagtctttgctggagggagaagcggtcgccaatttacagggcacaaccgagtttgagattatcacagccctagcctatgactactttgcctcagagcaagtagatgtggctatcatggaagttggcatgggtggacttttggatagtaccaatgtctgtcagcccattttgacaggaattacaactattggcttggatcatgtggccctacttggtgacaccttggaggccatagcagagcagaaggcaggtattatcaaacaagggatgcccttggtaacagggcgtattgctccagaagccttggctgtgattgaccgcattgcggaagggaaagatgcgccgagacttgcctacgggacagattatcaggttcgtcatcaagaaagtgtggtgacaggggaagtctttgactatacaagtgctgtcagacaaggtcgcttccagactagcctgcttggtttgtaccaaatagagaatgctgggatggccatagctttacttgatactttttgtcaagaagatggtcgagagctagcaagcaatgattttcttggtcaagccttggaagaaacaagttggccagggcgtttggaaatcgtgtcaagagatcccttgatgattttggatggagcccacaatccccatgctatcaaggccttgttggtaaccttgcaagaacgttttgcggattatcataaggaaatcctcttcacttgtatcaaaaccaaggccttggaggatatgttggacttgctgggagccatgccagataccgagcttactctaacacattttgcggatagtcgggcgacggatgaaaacgtgctgaaagaggcagctaagtctagaaatctcagctaccaagattggcatgattttctagagcagaatttgacagataaaaaagaagagaaacaaacagttaggattgtcacaggttccttgtatttcttgagccaagtgagggcctatctgatggagaggaagaacgagaatggatacacaaaagattga

SEQ ID NO: 1396 - DNA, 981 bp, Streptococcus pneumoniae
atgatgaaaagccttgagggagtgatcgatatgtcaagtaaagccaatcatgcaaagacagctatttgcggaattatcaatgtaaccccagattccttttcggatggtggtcaattttttgctcttgagcaggcactccagcaggctcgtaaattgatagcagaaggagccagcatgctagatatcggtggagaatcaactcggccgggaagtagctatgttgaggttgagatagaagaggaaatccagcgtgttgttccagtgatcaaagctattcgcaaggaaagtgatgtcctcatttctattgatacttggaaaagtcaggtggcagaggctgctttggctgctggtgctaatctagttaatgatatcactggtctcatgggtgatgaaaaaatggcccatgtgatagctaaagatggagcgaaagtggtcattatgtttaatcttgttatggctcgacctcagcatcctagctcgctcatattccctcattttggatttaatcaagcttttacagaggaagagttagctgactttgaaacattgccaatcgaagagttgatggagactttctttgaaagagcactagcgagagcaaatcaagctggaattgcacaagaaaatatcctgttggatccaggaatcggctttgggctgactaagaaagaaaatttgcttcttttacgagacctggataaactacatcagaagggctatccaatctttcttggagtgtcgcgcaagaggtttgtcatcaatatcctagaagaaaatggttttgaagtcaatcctgagacagaacttggtttccacaattgggacacagcttcggctcatgtaactagtatcgctgcgagacagggtgtagaagtggtgcgcgtgcatgacgtagctagtcacaagatggcggttgaaattgcctccgctattcgtctggctgatgaagcggaaaatttagatttaaaacaatataaataa

SEQ ID NO: 1397 - DNA, 708 bp, Streptococcus pneumoniae
atgaaagataagacgatttggcaagaggttttaaacagagggaaatgggtgctcatccttttggtagcttttgttttatctcaatttcccataggactggctttgtttttagcaaacaaacagtttccgattttacagtcagggctcttagtaggtgctctatccatagtcgttttgattgtattcattattggtgcacgaaaaacacaacttgctacttttaatctatccttttttaaggcaaaagacttggctcgcttggtactgagttatctggtgatttttgcgacaaatctcttgggttcactcctgcttcgactaacaaatgaggtaacaaccaataaccaatcaatactgaatggtatagttcagaatagctccttgatttcaacttttttcctgctagtcttgattgcaccaatttgtgaagaaattttgtgtcgtgggattattccaaaaaagatcttccgcggaaaagaaaaacttggctttgttgttggtgcaattgtctttgccttgctccatatgccaaccaatctaccttctgtgattatttatggagggatgtcaacggttttgacttggacagcctataagactgagcgtttggagatgtccattttgcttcatatgattctcaatggtattgcattttgtttgttggccttattggtattgattagtagaaatctaggtctatcattctaa

SEQ ID NO: 1398 - DNA, 186 bp, Streptococcus pneumoniae
ttggtgcaatcaagactagcaggaaaaaagttgaaatcaaggagctattctgaactataccattcagtattgattggttattggttgttacctcatttgttagtcgaagcaggagtgaacccaagagatttgtcgcaaaaatcaccagataactcagtaccaagcgagccaagtcttttgccttaa

SEQ ID NO: 1399 - DNA, 1482 bp, Streptococcus pneumoniae
atgataaatgatataattctattattgttcgtaaaaattaaaaggagattgatgatggacaaattatttaaactaaaagagaacggtacagacgttcgtacagaggttctcgctggtttaacaactttctttgcaatgagctatattctctttgtaaacccacaaatactttcacaaacaggaatgcctgctcagggcgtcttcctagcgacgattattggtgcagtagcgggtaccttgatgatggctttttatgctaacttaccttatgcccaagcgccaggtatgggactcaatgccttctttacctttacagttgtattcgggcttggttattcttggcaagaagccctagctatggtcttcatctgtgggattatttcattgattattaccttgacaaatgttcgtaaaatgatcattgaatcgattcccaatgctcttcgctcagctatttcagctggtatcggtgtcttccttgcctatgtagggattaagaatgctggacttttgaaattcacgattgatccaggcaactatactgttgtaggagaaggggctgacaaagctcaagcaacgattgcagcaaactcttcagcagttccaggattggtcagctttaataatccagctgttttagtggctcttgcaggacttgccattactatcttctttgtcatcaaagggattaaagggggaattattctctctatcttgacaacaactgttcttgctattgcagttggtttggttgatttgtctagtatcgattttgctaataaccatgttggtgcagcttttgaagatttgaagacaatctttggtgcagctcttggttcagaaggtttgggagctttggtttcagatacagctcgcttgcctgaaactctgatggccattcttgccttctcattgacagatatttttgacacaattggtaccttgatcggtacaggtgaaaaagttggtattgtagcgacaaatggtgaaaatcaccaatcagccaaattggataaggctctttactctgatttgattggaacgacagtcggtgccattgcaggtacttcaaacgttacaacctatgttgagtctgcggcgggtatcggcgctggtggccgtactgggttgacagccctagtggttgcgatctgttttgctctatctagcttctttagcccacttctagcgattgttcctacagctgcaacagcaccaattttgattattgtcggaatcatgatgctttctaacttgaaaaatatcccttgggatgatatggctgaagcggttcctgctttcttcacatctatctttatgggattcagctactctatcacacaagggattgctgttggtttcttgacatataccttgacaaaagttgtcaaaggtcaagccaaggatgtgcacgtgatgatttggattttggatgccttgtttatccttaactatatcagtatggcgctatctatggtataa

SEQ ID NO: 1400 - DNA, 813 bp, Streptococcus pneumoniae
atgacgaaaaaaattattgcagttgacctggatggaaccctgctcaactcagacagtcaaatttctgactttaccaaaagaaccatcaaaaaagttgctgaaaaaggccatcaggttattattacgacaggtcgcccttaccgtatgtcaaaagatttttaccgtgaactgggcttagacactcctatgattaacttcaacggatcccttactcatttaccagaccaagtttgggattttgaaaagtgtttgactgtagacaaaaaatatctgctagatatggttcaacgttcagaggacattcaagccgattttatcgctggagaatatcgtaaaaaattctacattacaaatcccaatgaagaaattgccaatcccaaactatttggtgtagaagctttccagcctgaagatcaattccagcctgaattggtgaccaaggaccctaactgtatcctcttgcagaccagagccagtgacaaatatgccttggcaaaagacatgaacgccttctaccagcatcaactttctatcaacacctggggaggtccgctcaatatccttgaatgtaccccaaaaggtgtcaacaaggcctttgctttggactacttgctcaagataatgaatcgtgacaaaaaagatttgattgcctttggagatgaacacaatgataccgaaatgctcgcttttgctgggaagggttatgccatgaaaaatgccaatccagagctactcccttatgcagatgagcaaatttccctttccaacgaccaagatggggttgccaaaaccctacaagacttattcttataa

SEQ ID NO: 1401 - DNA, 933 bp, Streptococcus pneumoniae
atgaaagctgttgttgtaaatccagaaagcactggtgttgctattgaagaaaaagtactccgtccacttgaaactggggaagcacttgtagaagttgaatactgtggcgtttgccacaccgacctccacgttgctcatggtgactttggtcaagtcccaggacgtgttcttgggcacgaaggtatcggtatcgttaaagagattgctccagatgtgaaaagccttaaagtcggtgaccgcgtcagcgttgcttggttctttgaaggatgtggcacttgcgaatactgtacaactggtcgcgaaaccctttgccgtacagtgaaaaatgctggctactcagtagacggtggtatggctgaacaatgtatcgtaactgctgactatgctgtcaaagttcctgacggacttgatccagcccaagcttcttctatcacatgtgctggagtaacaacctataaagctatcaaagaagcaaaagttgaaccaggccaatgggttgttctttacggtgctggtggacttggtaacctcgctgttcaatacgctaaaaaagtattcaatgctcatgttatcgcagtcgatatcaacaatgacaaacttgcccttgcaaaagaagtaggcgctgacattgtgattaacggcctcgaagttgaagatgtagctggactcattaaagaaaaaactgatggaggagctcattcagctgtcgtaactgctgtgtctaaagttgccttcaaccaggctgttgactccattcgtgctggtggtcgcgtcgtcgctgttggtcttccttctgaaatgatggaactcagcatcgttaaaacagtcctagatggaatccaagtcatcggttctcttgtcggaactcgtaaagacttagaagaagccttccaatttggtgcagaaggtctggtagtcccagttgttcaataa

SEQ ID NO: 1402 - DNA, 999 bp, Streptococcus pneumoniae
atgacaataatgagtatcggaatcattattgcgagccacggcgaatttgctgcgggtattcatcagtcaggatctatgatctttggtgaacaagaaaaggttcaagttgtgacctttatgccaaatgaaggtcctgatgatctatacgctaagtttaataacgctgttgctgcatttgacgcagaagatgaggttctagttttagctgacctttggagtggttctccatttaaccaagctagtcgcgtgatgggagaaaatcctgagcgtaagtttgccatcatcacaggacttaacttaccgatgttgattcaagcctacacagagcgcctcatggacgctgctgcaggtgtagaaaaagtcgctgctaatatcattaaagaagccaaggatggcatcaaagctcttccagaagagctaaatccagttgaagaagttgcaagcgctgcagctgctccagttgcccaagctgctatcccagaaggaactgttatcggagacggtaaattgaaaatcaatcttgcccgtcttgacacacgtctacttcacggtcaggttgcaactgcttggactccagattcaaaagcaaatcgtatcatcgttgcttcagataacgtggctaaagacgaccttcgtaaagaattgattaaacaagcagctccaggtaatgtcaaggctaacgtggttccaattcaaaaactgattgagatttcaaaagacccacgttttggagaaacacatgcccttatcttgtttgaaacacctcaagatgcccttcgtgccatcgaaggcggcgtgccaatcaagactcttaacgttggttctatggctcactcaacaggtaaaacattggtcaataccgttttgtctatggacaaagaagatgttgcgacatttgaaaaaatgcgtgacttgggtgttgaatttgatgtccgtaaagtaccaaatgattctaaaaaagatttgtttgacttgattaacaaagccaatgtcaaataa

SEQ ID NO: 1403 - DNA, 804 bp, Streptococcus pneumoniae
atgtctattatttctatggttttagtagtcgttgtagccttctttgcaggtcttgaaggcatcctcgaccagttccaatttcaccaaccacttgtagcctgtacccttattgggcttgtaacaggtcacttggaagcagggattatcctcggtggatcgcttcaaatgattgcccttggttggtcaaatatcggtgctgctatcgctcctgatgctgcacttgcttctgtcgctgctgccattatcatggttcttggtggtgactttaccaagactggtatcggtgttgcccaagcggttgctatccctcttgccgtagctggacttttcttgacaatgattgttcgtacaatttcagttggtttggttcatactgcagatgctgccgctaaaaaaggtgacttcggcgctgtggagcgtgcgcatttcattgcgctactcttccaaggacttcgtatcgcgcttcctgcagctcttctccttatggtaccaactgaaactgtacaaagtatccttagtgccatgccagactggctcaaagatggtatggctatcggtggtggtatggtcgttgccgttggttacgccatggttatcaacatgatggcaactcgtgaagtatggccattcttcgctcttggtttcgttctcgctgctgtgtcagatattactctaatcggattcggtgctatcggtgttgctatcgctcttatctaccttcacctttctaaaactggtggaaatggtggcggaggagccgcaacttctaacgacccaatcggcgatatcctagaagactactaa

SEQ ID NO: 1404 - DNA, 912 bp, Streptococcus pneumoniae
atgactgaaaaacttcaattaactaaatcagatcgtaaaaaagtttggtggcgttcaaccttcttacaagggtcttggaactttgaacggatgcaaaacttgggctgggcttatacactcattccagctatcaaaaaactctatactaaaaaagaagatcaaatcgctgctcttgagcgtcaccttgagttcttcaacactcatccatacgtagctgctccagtcatgggggttactcttgcgcttgaagaagaacgtgctaacggtgtggaaatcgatgacgctgctatccaaggggtcaaaatcggtatgatgggacctcttgctggtatcggtgacccagtattctggtttacagtacgcccaatccttggatctctcggtgcttcacttgcccttactggcaatatcttgggtccactcctcttctttgttgcatggaacttgattcgtatgtcattcttgtggtatgttcaagagattggatacaaggctggatcagaaatcactaaagatatgtctggtggtatccttcaagatatcactaaaggagcttctatccttgggatgttcattcttgctgtccttgttcaacgctgggtaaatattaaatttgctttcgatgtttctaaagttcaactagatgaaaaggcttatatccattgggataaattgccagaagggtctaaaggtatccaagaagcattcgcacaagtaggacaaggattgtctcaaactcctgaaaaagttactactttccaacaaaacttggatatgttgattcctggattatcaggactactccttactttactttgcatgtacttacttaagaaaaaagtatctccaatcactattatccttgccctcttcgcagtgggtattgtggcacatgttcttcacatcatgtaa

SEQ ID NO: 1405 - DNA, 1335 bp, Streptococcus pneumoniae
atgaacgcgattcaagaatcatttactgataaactatttgccaactatgaagcaaatgtaaaataccaagcgattgaaaatgctgctagccacaacggaatttttgcagctctggaacgtcgtcaaagccatgtagacaacacacctgttttctcattggatataaccaaggacaaggtcactaaccagaaagcgtctggtcgttgctggatgtttgcggctctcaacaccttccgccacaaactcatctcgcaatacaaattggagaactttgagttgtcacaagcccacactttcttctgggataagtatgagaaatcaaactggttcttggagcaagtcattgcgacttcagaccaagaattgactagccgcaaggttagcttcttacttcaaacacctcaacaagatggtggtcaatgggatatggtcgtttccctctttgaaaaatacggtgtcgtgcctaagtcagtttatcctgagtctgtttcatctagcagcagtcgtgagctaaatgcgatccttaataaattgcttcgtcaagatgctcaaatcttgcgtgacttgcttgtttctggtgcagatcaagcgactgttcaagctaagaaagaagacctcttgcaagaaatctttaactttcttgctatgtcattaggacttccaccacgcaagtttgactttgcttatcgcgataaagataacaactacaaaagtgaaaaaggaatcacaccacaagagttttacaagaaatatgtcaatcttcctttagaagactacgtttctgttatcaatgctccaactgctgataaaccttacggaaaatcttacacagttgagatgttggggaatgtggttggtagccgtgcagttcgttacatcaacgttccaatggagcgcttgaaagaattggcgattgcccaaatgcaagcaggtgagactgtttggtttggttctgatgtcggccagctcagtaaccgtaaggctggcatccttgcgacagatgtttatgactttgaatcaagcatggacattaaacttactcaagacaaggctggacgtttggactatagcgaaagcttgatgacccacgccatggtcttgacaggtgttgacttggacgaaaatggtaaatcaaccaagtggaaggttgaaaactcatggggagacaaggtcggtacagatggttactttgttgcctcagacgcttggatggacgaatacacataccaaatcgttgttcgtaaggaattgctgacagcagaagaacaagctgcctatggagcagaaccaattgtacttgcaccatgggatccaatgggagccttggctgaataa

SEQ ID NO: 1406 - DNA, 723 bp, Streptococcus pneumoniae
atgagattagataaatttttagttgcctgtgcggtgggaagtcggactgaggtcaaaaacttgctcaaggctgggcgcgtgactgtaaatggtaaaaaagaaaaatcagctaaattgcagattgatgaaaaaatagatgagattcgctttgatgggcaagtgttggagtatgaagagtttgtctactacatgatgaacaagcccaaaggagttatatcagcgactgaggatcccaagcacagaaccgttctggacttgttggatgacttggcgcggagtaaggaaattttcccagtaggacgcttggatattgacacgcatggtcttttgctcttgaccaatgatggtcagctggctcatgttcttctttcgcccaagcgtcatgtggacaagacttatctggcacaagtcaagggaatcatgacccaagaagatgtggagatatttgctgagggtattcctctcaaagactttacctgtcaacccgctatactggagcttgtatccatagatacagaaaagaatcaaagccaaatccgtgtgaccattgcagaagggaagtttcatcagatcaagcgtatggtgggctactgtggcaaggaagtggtggacttgcaacgattgactatgggaactttagtattagatgagaacctggaacgaggggaatggcgtcgcttgaccaaggaagaattagaaattctccgcgctaatattatttaa

SEQ ID NO: 1407 - DNA, 411 bp, Streptococcus pneumoniae
  unsure (48),(49),(51): n at each above location is unknown.
ttgtactctcttcaaaccacttcagattcactttgccgtaggtgtggnngntatgcttcgtcagttctatctgcaacctcaaaacagtgttttgagctgacttcgtcagttctatctacaacctcaaaacggtgttttgagctgacttcgtcagttctatctacaacctcaaaacggtgttttgagctgacttcgtcagttctatctgcaacctcaaaacagtgttttgagcaacccgcagctagtttcctagtttgctctttgattttcattgagtataacacaaaaggtagcccatcagctacctttttcttatgcttcctcaatcaagcgagtatgttctctcttgatacagcgattcatcacgatatcatcacatccaccatcacgcaaaatctctttcgcttctaa

SEQ ID NO: 1408 - DNA, 231 bp, Streptococcus pneumoniae
atgaaaatcaaagagcaaactaggaaactagccgcaggttgctcaaagcactgctttgaggttgcagatagaactgacgaagtcagctcaaaacactgttttgaggttgcagatagaactgacgaagtcagtaacatatatacgggcaaggcgacgttgacgcggtttgaagagatttttgaagagtatgaaacgaaaaggaggttggtcattgtaccagcctccttttga

SEQ ID NO: 1409 - DNA, 231 bp, Streptococcus pneumoniae
atgttaggaagtatgttcgttggtctcctagtgggatttttagcaggtgctatgaccaatcgtggagagcgaatgggatgttttggaaaaatgtttctcggttggatcggagcctttctaggtcacttgctctttggaacttgggggccagttttatcaggaacagctattatcccagctgttttaggtgccatgattgtcttagctattttttggagacgaggaagttaa

SEQ ID NO: 1410 - DNA, 1242 bp, Streptococcus pneumoniae
atggttttaccaaattttaaagaaaatctagaaaaatatgcgaaattgttggttgcgaacggaattaacgtgcaacctggtcacactttggctctctctattgatgtggagcaacgtgaattggcacatctaatcgtgaaagaagcttatgccttgggtgcgcatgaggtcatcgttcagtggacagatgatgtgattaaccgtgagaaattcctccatgccccgatggagcgtttggacaatgtgccagaatacaagattgctgagatgaactatctcttggagaacaaggctagccgtcttggagttcgttcatctgatccaggtgccttgaacggagtggacgctgacaagctttcagcttctgctaaagctatgggacttgccatgaagccaatgcgaatcgcaactcaatctaacaaagttagctggactgtagcagctgcagcaggacttgagtgggctaagaaagtcttcccaaatgctgcgagcgacgaagaagcagttgatttcctttgggaccaaattttcaaaacttgccgtgtctacgaagcagatcctgttaaggcttgggaggaacatgcagccattctcaagagcaaggccgatatgcttaataaggagcaattttcagcccttcactacacagcgccaggaacagatttaacacttggtttgccaaagaaccacgtttgggaatcagctggtgctgtcaatgcacagggcgaagaattcttgccaaatatgccgacagaagaggtcttcacagcgcctgacttccgtcgtgcagatggttatgtcacttctacaaaaccgcttagctacaacggaaatatcattgaaggcattaaggtgacctttaaggatggacaaatcgtagatatcactgctgagaagggtgatcaggttatgaaagaccttgtctttgaaaatgcgggtgcgcgtgccttgggtgaatgtgccttggtaccagatccaagtccaatttctcagtcaggcattaccttctttaacacccttttcgatgaaaatgcgtcaaaccacttggctatcggtgcagcctatgcgactagcgttgttgatggagcggagatgagcgaagaggagcttgaagctgcagggcttaaccgttcagatgttcacgtagactttatgattggttctaaccaaatggatatcgatggtattcgtgaggatggaacgcgagtacctcttttccgtaatgggaattgggcaaattaa

SEQ ID NO: 1411 - DNA, 180 bp, Streptococcus pneumoniae
tttattttaatctattttaagggggttctcatgaaactaagaatatttgcggaagataagccggctaagaaggtatttgaatatcaattagaacttgctgatcgtacaattcttctatcgacagcactcttgtcaggtgctattgctttagcaggaatcttttctgctttgaaagaaaaa

SEQ ID NO: 1412 - DNA, 231 bp, Streptococcus pneumoniae
attaaaataaatcactgtgactgcctgtcctcagcaaatttaaaatcaattccgacttatctactttataaaccaaaagccaatctggctgggtatggcattcacgaactccttgaaaatgcttggatgccgtcaatgaatgatcacgatatctggcaggatgttctttttcttgaaccagaaaattcaaaacttcttctaataattctgccttcaaaccacgcttcatag

SEQ ID NO: 1413 - DNA, 279 bp, Streptococcus pneumoniae
gtgcttaagattcgttatcataaacagtttaaaaaagattttaagttggctatgaagcgtggtttgaaggcagaattattagaagaagttttgaattttctggttcaagaaaaagaacatcctgccagatatcgtgatcattcattgacggcatccaagcattttcaaggagttcgtgaatgccatacccagccagattggcttttggtttataaagtagataagtcggaattgattttaaatttgctgaggacaggcagtcacagtgatttattttaa

SEQ ID NO: 1414 - DNA, 264 bp, Streptococcus pneumoniae
atgtcaaagatgagtatgagcatccgtctggatagtgaggttaaggagcaggcccaacaggtgtttagtaatctgggaatggatatgacaacagctattaatattttccttcgtcaggcaattcaatatcagggattaccttttgatgttagactagacgaaaatcggaagttgctccaagtgttaacggatttagaccaaaatcgtaatatgagccagtcttttgaatcagtctcagatttgatggaggacttacgtgcttaa

SEQ ID NO: 1415 - DNA, 4392 bp, Streptococcus pneumoniae
atgtcaaatagttttgaaattttgatgaatcaattggggatgcctgctgaaatgagacaggctcctgctttagcacaggctaatattgagcgagttgtggttcataaaattagtaaggtatgggagtttcatttcgtattttctaatattttaccgattgaaatctttttagaattaaagaaaggtttgagcgaagaattttctaagacaggcaataaagctgtttttgaaattaaggctcggtctcaagaattttcaaatcagctcttgcagtcctactatagggaagctttctctgaaggtccatgtgctagtcaaggttttaagtccctttatcaaaatttgcaagttcgtgctgagggtaatcagctatttattgaaggatctgaagcgattgataaggaacattttaagaagaatcatcttcctaatttagccaaacaacttgaaaagtttggttttccaacttttaactgtcaagtcgagaagaatgatgtcctgacccaagagcaggaagaggcctttcatgctgaaaatgagcagattgttcaagctgccaatgaggaagcgctccgtgctatggaacaactggagcagatggcacctcctccagcggaagagaaaccagtctttgattttcaagcgaaaaaagctgcagctaaacccaagctggataaggcggagattactcctatgatcgaagtgacgacagaggaaaatcgtctggtatttgaaggggttgtttttgatgtggagcaaaaagtgactagaacaggtcgtgttttaatcaactttaaaatgacggactatacttcaagtttttctatgcaaaagtgggttaaaaacgaggaagaggcccagaagtttgacctcatcaagaagaattcttggctccgagttcgagggaatgtggagatgaataacttcacacgcgatttgactatgaacgtacaggatctgcaggaagttgttcactatgagcggaaggatttgatgccagaaggtgagcgtcgggttgagtttcatgctcatactaacatgtcgactatggatgctttgccagaggtcgaagagattgttgcaacagctgctaagtggggacacaaggcggttgctatcacggaccatgggaatgtccagtcctttccacatggctataaggcggctaagaaagcgggaatccagctgatctatgggatggaagccaatatcgtggaggaccgtgtccctatcgtctataacgaagtggagatggacttgtcagaagcaacctacgtggtctttgacgtggaaacgacgggactttcagctatctataatgacttgattcaggttgcggcctctaagatgtacaaggggaatgttattgctgaatttgatgaatttatcaatcctgggcatcccttgtcagcctttactacagagttaactggaattacagatgatcatgtcaaaaatgccaaaccactagaacaagttttgcaagaattccaagaattttgcaaggatacggtcctagttgcccacaatgctacctttgacgttggctttatgaatgctaattatgagcggcatgatcttccaaagattagtcagccagttattgatacgctggagtttgctagaaacctctatcctgagtataaacgccatggtttggggcctttgaccaagcgttttggtgtggccttggaacatcatcacatggccaactacgatgcggaagcgactggtcgtctgcttttcatctttatcaaagaggtagcagaaaaacatggtgtgaccgatttagctagactcaacattgatctaatcagtccagattcttacaaaaaagctcggatcaagcatgcgaccatctatgtcaagaatcaggtaggtctaaaaaatatctttaagctggtttccttgtctaataccaagtattttgaaggagtgccacggattccgagaacggttctagatgcccatcgagagggcttgattttaggttcagcctgttcagagggtgaagtttttgacgtggtcgtttctcaaggtgtggatgcggcggttgaggtggccaagtattatgactttatcgaggtcatgccaccggctatctatgcgcccttgattgccaaagagcaggtcaaggatatggaggaactccagaccattatcaagagtttgatagaggttggagatcgccttggcaagcctgttctggctacgggaaatgttcactatatcgaaccggaagaagagatttatcgtgaaattatcgtccgtagtttgggacagggtgcgatgattaaccgaactatcggtcatggtgaacatgcccaaccagcaccacttccaaaggctcattttcgaacgactaatgagatgttggatgaatttgcctttttgggagaggaactggctcgtaaactggttattgaaaacaccaatgccttggcagaaatatttgaacccgttgaagtcgttaagggtgatttgtatacgcctttcatcgacaaggctgaagaaacagttgctgagttgacctataagaaagcttttgagatttatggaaatccgctgccagatattgttgatttgcggattgaaaaagaattaacatccatactggggaatggatttgctgtgatttatctggcatcgcagatgctggtgcaacgttctaatgaacggggttatttggttggttctcgtgggtctgtcggatctagtttcgttgcgaccatgattgggattacggaggtcaatcctctctctcctcactatgtctgtggtcagtgtcagtacagtgagtttatcacagatggttcgtacggttcaggatttgatatgccccataaggactgtccaaactgtggtcacaaactcagtaaaaacggacaggatattccgtttgagaccttccttggttttgatggggataaggttcctgatattgacttgaacttctcgggagaagatcagcctagcgcccacttggatgtgcgtgatatctttggtgaagaatatgccttccgtgcgggaacggttggtacggtagctgccaagactgcctatggatttgtcaagggttacgagcgagattatggcaagttttatcgtgatgcagaagtagaacgcctcgctcaaggagcggcgggtgtcaagcggacaacaggccaacacccggggggaatcgttgttattccgaactacatggatgtctacgattttacgcctgtccagtatccagcagatgatgtcacggctgaatggcagaccactcactttaacttccacgatatcgatgagaacgtcctcaaactcgatgtactgggacatgatgatccgaccatgattcgaaaacttcaggatttgtctggtattgaccctaataaaattcctatggatgacgaaggcgtgatggcactcttttctgggactgatgtgctaggggtaacacctgaacaaattggaacgcctacgggtatgttggggattccagagtttggaacaaatttcgtacgtggaatggtagacgaaacccatccgacaacctttgcggaattgcttcagctgtctggtctgtcccacggtactgacgtttggttggggaatgctcaggatctgattaagcaaggaatagcggacctatcgactgttatcggttgtcgggacgacatcatggtttacctcatgcatgcgggtctggaacctaagatggcctttaccattatggaacgggtacgtaagggtttgtggctaaagatttcagaagaggagagaaatggctatatcgaagccatgaaggctaataaggtgccagagtggtatatcgaatcctgtgggaaaattaagtacatgttccctaaggcccatgcggcagcctacgttatgatggccttgcgtgtagcttacttcaaggttcaccatcctatttattactactgtgcttacttctccattcgtgctaaggcttttgatatcaagaccatgggtgcgggcttggaggccatcaagcgcagaatggaagaaatctctgaaaaacggaagaacaatgaagcctctaatgtggaaatcgatctctatacaactcttgagattgtcaatgagatgtgggaacgaggtttcaagtttggcaaattagatctctaccgtagtcaggcgacagagttcctcatcgacggggatacccttatcccaccatttgtagcaatggatggtctgggagagaacgttgccaagcaactggtgcgggcgcgtgaagagggagaattcctctctaaaacagaactacgcaagcgtggtggactctcatcaaccttggttgaaaagatggatgagatgggtattcttggaaatatgccagaggataaccagttgagtttgtttgatgagttgttttaa

SEQ ID NO: 1416 - DNA, 2082 bp, Streptococcus pneumoniae
atggcacgcgaattttcacttgaaaaaactagtaacatcggtatcatggctcacgtcgatgccggtaaaacaacaactactgagcgtattctttactacactggtaaaatccacaaaatcggtgaaactcacgaaggtgcgtcacaaatggactggatggagcaagagcaagaacgtggtatcacgatcacatctgctgcgacaacagctcaatggaacaaccaccgcgtaaacatcatcgacacaccaggacacgtggacttcacaatcgaagtacaacgttctcttcgtgtattggatggtgcggttaccgttcttgactcacaatcaggtgttgagcctcaaactgaaacagtttggcgtcaagcaactgagtacggagttccacgtatcgtatttgccaacaaaatggacaaaatcggtgctgacttcctttactctgtaagcacacttcacgatcgtcttcaagcaaatgcacacccaatccaattgccaatcggttctgaagatgacttccgtggtatcattgacttgatcaagatgaaagctgaaatctatactaacgaccttggtacggatatccttgaagaagacatcccagctgaataccttgaccaagctcaagaataccgtgaaaaattgattgaagcagttgctgaaactgacgaagaattgatgatgaaatacctcgaaggtgaagaaatcactaacgaagaattgaaagctggtatccgtaaagcgactatcaacgttgaattcttcccagtattgtgtggttcagccttcaaaaacaaaggtgttcaattgatgcttgatgcggttatcgactaccttccaagtccacttgacatcccagcaatcaaaggtattaacccagatacagacgctgaagaaactcgtccagcatctgacgaagagccatttgcagctcttgccttcaagatcatgactgacccattcgtaggtcgtttgacattcttccgtgtttactcaggtgttcttcaatcaggttcatacgtattgaatacttctaaaggtaaacgtgaacgtatcggacgtatccttcaaatgcacgctaacagccgtcaagaaatcgacactgtttactcaggtgatatcgctgctgccgttggtttgaaagatactacaactggtgactcattgacagatgaaaaatctaaaatcatccttgagtcaatcaacgttccagaaccagttatccaattgatggttgaaccaaaatctaaagctgaccaagacaagatgggtatcgcccttcaaaaattggctgaagaagatccaacattccgcgttgaaacaaacgttgaaactggtgaaacagttatctcaggtatgggtgaacttcaccttgacgtccttgttgatcgtatgcgtcgtgagttcaaagttgaagcgaacgtaggtgcgcctcaagtatcttaccgtgaaacattccgcgcttctactcaagcacgtggattcttcaaacgtcagtctggtggtaaaggtcaattcggtgatgtatggattgaatttactccaaacgaagaaggtaaaggattcgaattcgaaaacgcaatcgtcggtggtgtggttcctcgtgaatttatcccagcggttgaaaaaggtttggtagaatctatggctaacggtgttcttgcaggttacccaatggttgacgttaaagctaagctttatgatggttcatatcacgatgtcgactcatctgaaactgccttcaagattgcggcttcactttcccttaaagaagctgctaaatcagcacaaccagctatccttgaaccaatgatgcttgtaacaatcactgttccagaagaaaaccttggtgatgttatgggtcacgtaactgctcgtcgtggacgtgtagatggtatggaagcacacggtaacagccaaatcgttcgtgcttacgttccacttgctgaaatgttcggttacgcaacagttcttcgttctgcatctcaaggacgtggtacattcatgatggtatttgaccactacgaagatgtacctaagtcagtacaagaagaaattattaagaaaaataaaggtgaagactaa

SEQ ID NO: 1417 - DNA, 357 bp, Streptococcus pneumoniae
accatcataaagcttagctttaacgtcaaccattgggtaacctgcaagaacaccgttagccatagattctaccaaacctttttcaaccgctgggataaattcacgaggaaccacaccaccgacgattgcgttttcgaattcgaatcctttaccttcttcgtttggagtaaattcaatccatacatcaccgaattgacctttaccaccagactgacgtttgaagaatccacgtgcttgagtagaagcgcggaatgtttcacggtaagatacttgaggcgcacctacgttcgcttcaactttgaactcacgacgcatacgatcaacaaggacgtcaaggtgaagttcacccatacctga

SEQ ID NO: 1418 - DNA, 450 bp, Streptococcus pneumoniae
accacacaatactgggaagaattcaacgttgatagtcgctttacggataccagctttcaattcttcgttagtgatttcttcaccttcgaggtatttcatcatcaattcttcgtcagtttcagcaactgcttcaatcaatttttcacggtattcttgagcttggtcaaggtattcagctgggatgtcttcttcaaggatatccgtaccaaggtcgttagtatagatttcagctttcatcttgatcaagtcaatgataccacggaagtcatcttcagaaccgattggcaattggattgggtgtgcatttgcttgaagacgatcgtgaagtgtgcttacagagtaaaggaagtcagcaccgattttgtccattttgttggcaaatacgatacgtggaactccgtactcagttgcttgacgccaaactgtttcagtttgaggctcaacacctga

SEQ ID NO: 1419 - DNA, 432 bp, Streptococcus pneumoniae
atgaatctcattggttgcaaccgcaacctgcttcgattccctattttctctgggactttcttaacgctttcgcatcctatcttaccaacggaagtgtgcgaatgcacggttagcttcagccatacggtgagtatcttcacgtttcttaactgctgcaccagtgttgttagcagcatccaagatttcttttgcaagacggtcttgcattgtgtgttcaccacgaagacgagcgattgttaccaaccaacgaagtccaagtgttgtacgacgttctggacgaacttcaactgggacttggtagttagaaccaccaacacgacgtgcacgtacttcaagtacaggcatgatgttttccatagctgtttcaaatacttcaagtgcatcgttgccagtagcttctttgatttgctcaaaagcaccgtaaacgattga

SEQ ID NO: 1420 - DNA, 471 bp, Streptococcus pneumoniae
atgagtcgtaaaaatagagctccaaaacgtgacgtattgccagatccgctatacaattcacaactagttactcgtcttatcaaccgcgttatgcttgatggtaaacgtggtactgctgcttcaatcgtttacggtgcttttgagcaaatcaaagaagctactggcaacgatgcacttgaagtatttgaaacagctatggaaaacatcatgcctgtacttgaagtacgtgcacgtcgtgttggtggttctaactaccaagtcccagttgaagttcgtccagaacgtcgtacaacacttggacttcgttggttggtaacaatcgctcgtcttcgtggtgaacacacaatgcaagaccgtcttgcaaaagaaatcttggatgctgctaacaacactggtgcagcagttaagaaacgtgaagatactcaccgtatggctgaagctaaccgtgcattcgcacacttccgttggtaa

SEQ ID NO: 1421 - DNA, 414 bp, Streptococcus pneumoniae
atgcctacaattaaccaattggttcgcaaaccgcgtaaatcaaaagtagaaaaatctaaatcaccagctttgaacgttggttacaatagtcataaaaaagttcaaacaaacgtttcttcaccacaaaaacgtggtgttgcaactcgtgttggaacaatgacacctaaaaaacctaactcagcccttcgtaaattcgctcgtgtacgtttgagcaaccttatcgaagttactgcctacatcccaggtatcggacacaacttgcaagagcacagcgtggtgcttcttcgcggtggacgtgtaaaagaccttccaggggtacgttaccatatcgtccgtggtgcacttgatactgcaggtgttaacgatcgtaaacaaggccgttctaaatacggtactaaacgtccaaaagcataa

SEQ ID NO: 1422 - DNA, 3615 bp, Streptococcus pneumoniae
gatacagcagctggctctggtaagaacgaaagtgatatttcttcacctagaaatgcaaacgcttccctagagaaaacagaagaaaaacctgctgcaagcccagccgatccagcaccacaaactggacaagatcgttcaagtgagccaactacttctactagtccagtaacaactgaaactaaggcagaagagcccatcgaagataactacttccgtatccatgtcaaaaaacttcctgaagaaaacaaggatgctcaaggactatggacttgggacgatgttgaaaaaccatctgaaaactggccaaacggagctttgtccttcaaggatgccaagaaagatgactacggctattacctagatgtcaaattaaagggagaacaagccaagaaaattagcttcctcatcaacaatacagctggaaaaaatctaaccggcgataaatctgtagaaaaactagttccaaaaatgaacgaagcttggttagaccaagattacaaggttttctcttacgagccacagcctgcaggaactgttcgcgtcaactactaccgcacagatggcaactatgacaagaaatctctctggtactggggagatgtaaaaaatccaagtagcgctcaatggcctgacggaacagactttacggctacaggcaaatatggccgctatatcgacattcctcttaatgaagccgcaagagaatttggatttttattactagatgagagcaaacaaggagacgacgtgaaaatccgtaaagaaaattataagttcacagatttgaaaaatcatagccaaattttcctaaaagacgatgatgaatcgatttacacaaatccatactatgtccatgatatccgtatgacaggagcccaacacgtaggcacttctagcattgaaagtagcttttcaacacttgtcggtgctaaaaaagaagatatcctcaaacactccaacatcactaatcacctaggaaacaaggtaactattaccgatgttgcaatcgatgaagctggtaagaaagtgacctacagcggagatttctctgacacaaaacatccttatactgttagctacaattccgaccaattcactaccaaaacaagctggcgcctgaaagatgagacatacagctatgatggcaaactgggagctgacctaaaagaagaaggaaaacaagttgatttgaccctttggtcaccaagtgctgataaggtttctgttgttgtctacgacaagaatgaccctgacaaagtagttggaactgtcgctctcgaaaaaggggaaagaggaacttggaaacaaactctagacagcacaaacaaactcggaatcacagatttcactggctactattatcaataccaaatcgagcgtcaaggtaaaactgttcttgcactcgatccttacgctaaatctcttgctgcttggaatagcgacgatgccaagattgacgatgcccataaagtggctaaagccgcctttgtagatccagctaaactcggacctcaagacttgacttatggtaagattcacaatttcaagactcgtgaagacgccgttatctacgaagctcatgtgcgtgacttcacttcagatcctgccattgcaaaagacttgaccaaaccatttgggacttttgaagccttcattgaaaaactagactatctcaaagacttgggtgtaacccatatccagctccttccagtcttgtcttactactttgtcaatgaattgaaaaaccatgaacgcttgtctgactatgcttcaagcaacagcaactacaactggggatatgaccctcaaaactacttctccttgactggtatgtactcaagcgatcctaagaatccagaaaaacgaatcgcagaatttaaaaacctcatcaacgaaatccacaaacgtggtatgggagctatcctagatgtcgtttataaccacacagccaaagtcgatatctttgaagacctagagccaaactactaccactttatggatgccgatggcacacctcgaactagctttggtggtggacgcttggggacaacccaccatatgaccaaacggctcctagttgactctatcaaatacctagttgatacctacaaagtggatggcttccgcttcgatatgatgggagaccatgacgccgcttctatcgaagaagcttacaaggctgcacgcgccctcaatccaaatctaatcatgttaggcgaaggttggagaacctatgccggtgatgaaaacatgcctactaaagctgctgaccaagattggatgaaacataccgatactgtcgctgtcttttcagatgacatccgtaacaacctcaaatctggttatccaaacgaaggtcaacctgcctttatcacaggtggcaagcgtgatgtcaacaccatctttaaaaatctcattgctcaaccaactaactttgaagctgacagccctggagatgtcatccaatacatcgcagcccatgataacttgaccctctttgacatcattgcccagtctatcaaaaaagacccaagcaaggctgagaactatgctgaaatccaccgtcgtttacgacttggaaatctcatggtcttgacagctcaaggaactccatttatccactccggtcaggaatatggacgtactaaacaattccgtgacccagcctacaagactccagtagcagaggataaggttccaaacaaatctcacttgttgcgtgataaggacggcaacccatttgactatccttacttcatccatgattcttacgattctagcgacgcagtcaacaagtttgactggactaaggctacagatggtaaaacttatcctgaaaatgtcaagagccgtgactatatgaaaggtttgattgcccttcgtcaatctacagatgccttccgacttaagagtctccaagatatcaaagaccgtgtccacctcatcactgtcccaggccaaaatggtgtggaaaaagaggatgtagtgattggctaccaaatcactgctccaaacggcgatatctacgcagtctttgtcaatgcggatgaaaaagctcgcgaatttaatttgggaactgcctttgcacatctaagaaatgcggaagttttggcagatgaaaaccaagcaggatcagtcggaattgccaacccgaaaggacttgaatggactgaaaaaggcttgaaattgaatgcccttacagctactgttcttcgagtctctcaaaatggaactagccctgagtcaactgcagaagagaaaccagactcaaccccttccaagcctgaacatcaagacccagctccagaagctagacctgattctactaaaccagatgccaaagtagctgatgcggaaaataaacctagccaagctacagctgattcacaagctgaacaaccagcacaagaagcacaagcatcatctgtaaaagaagcggttcaaaacgaatcggtagaaaactctagcaagaaaaatatacctgcaaccccagatagacaagctgaacttccaaatacaggaatcaaaaacgaaaacaaactcctatttgcaggaatcagcctccttgcgctccttggtctcggtttcttactaaaaaataaaaaagagaactaa

SEQ ID NO: 1423 - DNA, 924 bp, Streptococcus pneumoniae
ttggacgtatatgggattggcgagcaccatcgggcggattttgcagtatcagccccagagattgtcctggccgctggggcagtcaataccaagaaaatccgtttgaccagtgcagtcagcattctgtcaagcatggacccgattcgtttgttccaacagtatgccactatcgatgctttgtcaaatggacgatcggagattatggctggaaggggctctttcacggaatctttccctctgtttggttatgacttgaaagactacgactctctttttgatgagaaattagacttgcttcagttagtcaatgaaaagaccaagttagactggcaaggtcgattgactcaaacgattgctggtaaagaagtttatcctcgtccagttcaggacaaattgcccatgtggatagctacaggtggtcatgtcgaatcaacagtgaagattgctcaggctggtctaccgattgtatatgctattattggtggtaatccacgttattttaaaaagttgattcaggcttatcgtgagattggaagcgaagcgggtcatgctgacaaagacttgaaagtgggagcccattcttgggggtggattgcggaagatggtgagcaggcggtgaaagattatttccatccgactaagcaagtggtggatgctatttccaaagaccgtccgcactggcaggaattgcgttatgagcaatatttggagcaggtagggccaaatggcgccatgtttgttggcaatccagatcaggtggccgaaaaattgattcgcatgatagaggatttaggattggaccgcttcatgcttcatctaccgcttggttctatgcctcatgaccaggttctgagagctattgaactcttcggaacacaagttgcacccaaagtacgagcttattttgctatgaaagaggcttaa

SEQ ID NO: 1424 - DNA, 1809 bp, Streptococcus pneumoniae
atgtgtggaattgttggtgttgttggaaacacaaatgcaactgatattttgattcaagggcttgaaaagcttgaataccgtggctatgattctgcgggaatttttgtcctagatggtgctgataaccatttggtgaaggcggttggtcgtattgcagaattgtctgccaagacagctggtgttgagggaacaactggtatcggacatactcgttgggctactcacggaaaaccaactgaggacaatgctcacccacaccgctctgagacagaacgttttgtcttggtgcataatggggtgattgagaactatcttgaaatcaaggaagaataccttgcaggtcaccacttcaaggggcagacagatactgaaatagccgttcatttgattggaaaatttgcggaagaagaagggctctcagttcttgaagcctttaaaaaagctcttcatattatccgtggttcatatgcctttgccttgattgactctgaaaatccagatgtcatctatgtagcgaaaaacaaatctccacttttgattggtcttggggaaggctacaatatggtctgctcagatgctatggctatgattcgtgaaaccaaccaatacatggaaattcatgaccaagagttggtaatcgtcaaggctgatagcgtggaagttcaagactatgatggtaacagtcgtgaacgtgctagctatactgcggaacttgacttgtcagatatcggtaagggaacttatccttactacatgcttaaggaaattgatgagcaaccaactgttatgcgtaaactcattcaagcctacacggatgatgctggtcaagtagtggttgctcctgctatcattaaggctgttcaagacgcagaccgcatctacatccttgcagctggaacatcttaccatgcaggatttgcttctaagaaaatgttggaagaattgacagatacaccagttgaacttggaatctcatctgagtggggctacggtatgccacttctcagcaagaaaccactcttcatctttatcagccaatctggtgaaacagcggatagtcgtcaagttttggtcaaggctaatgaaatgggaattccaagcttaacagtgacaaatgttccaggttcaaccctctcacgtgaagccaactataccatgctccttcacgcaggacctgaaattgccgtggcatcaactaaagcctatacagcgcaaatcgcagcccttgccttccttgcaaaagcagtcggagaagcaaatggtaatgctaaagcgcaagcctttgacctggttcatgaattgtcaatcgtagctcagtctattgaatcaactctttcagagaaagaaaccattgaagccaaggttcgtgaacttcttgaaacaactcgtaacgccttttacatcggacgtggtcaagattactacgtagccatggaagcaagtctcaaactcaaagagatttcttatatccagtgtgaaggttttgcggcaggagaactcaagcacggaaccattgccttgattgaagaaggaacgcctgttttggctctcttgtcagatccagttcttgccaaccatactcgtggaaatatccaagaggtcgcagcccgtggtgccaaagtcctcactatcgcagaagagaatgtagccaaagataccgacgatatcgtccttacgaccgtacatccatacctctcaccaatttcaatggtcgtaccaacgcaattagtcgcttactttgcaaccctccaccgtggcctcgatgtggacaaaccacgtaaccttgccaagtcagtaacggtagaataa

SEQ ID NO: 1425 - DNA, 1380 bp, Streptococcus pneumoniae
atgctaagatttccaaaggattttgtctggggatcctctacttctggaccgcagacagaaggacgtgtagctggtgacggtaagggagacaatctctgggattactggttccaagtggagccaaatcgttactataatgggattggttcagataagacatcgactttttatgaaaattgggagcgggatattgagcttttgttagagactggtcacacagcctttcggacttctattcagtggtcacggatttttccacaaggctgtggaaaagtcaacactcaaggtgtggatttttatcgtaaggtctttgaggctattaaggctaaaggaattcgtctgttagtcaatctctatcattttgatttaccttttgcccttcaagaggatggtgatggttgggaaaataaggcgacagtctcagcctatgaagactatgctcgtttttgttttgagacttatggagatttagtggatcaatggattacctttaacgagcccatcgttcctgtagaatttggttatttttatgatgcccattatccacataaggtggatgcagagccagctgttaaggtagcctatcatacacaattggccagcagccgggctgttaaggcttgccatgaacttttgcctgattccaagattgggattgtcctcaacttgacaccggcttatccacgtagccagcatcctgctgatgtcaaggcagctcgtattgcggccctttttcaggcccaatctttcttagatccatctgtcttggggacttatccacaggagttggtagaaatcttgcatgaacacggtcttttacctgatgctacagaggaagagttggaactcattcgtgataatacggtggacttccttggtgtcaactactatcaacctttgcgtgttatggctcctcgatttgctaagcatccagagagtccactcttaccagaacatttttacgagccttatgtgatgcctggacgtaaaatcaattctcaccgtggttgggagatttatgagcaagggatttatgacatcgcccaaaatatcaaggaaaattatggcaatattgagtggatgttgactgagaatggtatgggtgttgaaggggaagaaaaattccgtcaagatggaatgattcaagatgattaccgtattgactttgtaaaaggtcatcttcgtgaacttcaccgtgccattgaagatggtgccaactgtaagggctacttgatttggacctttattgactgctggtcatggctcaacagctataaaaatcgctatggtttggtcgaattagacttggaaacgcaagaacgtcgtctgaagaaatcaggccactggttcaaagaattaagcgataataatggattttaa

SEQ ID NO: 1426 - DNA, 1041 bp, Streptococcus pneumoniae
aaatggcaacaaacgagtacaaaccaagcaaccgtgttgtcgctgaagaagaagttactcgtgttgcaacgccagatgttaaatcaattgatgaagttgcagccttcctcaatgttccagaagaacaaacgattaaaaccctcttctacattgcagatggcgagcttgttgcagccctttctagttggaaatgaccaactcaacgaagtcaagttgaaaaatcacttgggagcagatttctttgacgttgctagcgaagaagaagtggcgaatgttgttcaagcaggatttggttcacttggaccagttggtttgccagagaatattaaaattattgcagatcgtaaggtacaagatgttcgcaatgcagttgtcggtgctaacgaagatggctaccacttgactggtgtgaacccaggccgtgattttactgcagaatatgtggatatccgtgaagttcgtgagggtgaaatttccccagatggacaaggtgtccttaactttgcgcgtggtattgagatcggtcatattttcaaactcggaactcgctattcagcaagcatgggagcagatgtcttggatgaaaatggtcgtgctgtgccaatcatcatgggatgttacggtatcggtgtcagccgtcttctttcagcagtgatggagcaacacgctcgcctctttgttaacaaaacgccaaaaggtgaataccgttacgcttggggaatcaatttccctaaagaattggcaccatttgatgtgcatttgattactgtcaatgtcaaggatgaagaagcgcaagccttgacagaaaaacttgaagcaagcttgatgggagctggttatgaagtcttgacagatgaccgtaacgaacgtgtcggtgttaaatttagcgatagtgacttgattggtcttccaatccgtatcactgttggtaaaaaagcggccgatggcattgtagaagttaagatcaaggcaactggtgacaccattgaggttcatgcagataacgtgcttgaaacgcttgaaatcctaagcaagaaataa

SEQ ID NO: 1427 - DNA, 1008 bp, Streptococcus pneumoniae
atgaaacaaagtaaaatgcctatcccaacgcttcgcgaaatgccaagcgatgctcaagttatcagccatgctcttatgttgcgtgctggttatgttcgccaagtttcagcaggtgtttattcttatctaccacttgccaaccgtgtgattgaaaaagctaaaaacatcatgcgccaagaattcgaaaagattggtgctgttgagatgttggctcctgcccttcttagtgcagaattgtggcgtgaatcaggtcgttacgaaacctatggtgaagacctttacaaactaaaaaaccgtgaaaaatcagactttatcttaggtccaactcatgaagaaacctttacagctattgtccgtgattctgttaaatcttacaagcaattgccactcaacctttatcaaattcagcccaagtatcgtgatgaaaaacgcccacgtaatggacttcttcgtacacgtgagtttatcatgaaggatgcttatagtttccacgctaactatgatagtttggatagtgtttatgatgagtacaaagcagcctatgagcgtattttcactcgtagtggtttagacttcaaggctattattggtgacggtggagccatgggtggtaaggatagccaagaatttatggccattacatctgctcgtacagaccttgaccgctgggttgtcttggacaagtcagttgcctcatttgacgaaattcctgcagaagtgcaagaagaaatcaaggcagaattgctcaaatggatagtctctggtgaagataccattgcttactcaagtgagtctagctatgcagctaacttagaaatggcaacaaacgagtacaaaccaagcaaccgtgttgtcgctgaagaagaagttactcgtgttgcaacgccagatgttaaatcaattgatgaagttgcagccttcctcaatgttccagaagaacaaacgattaaaaccctcttctacattgcagatggcgagcttgttgcagccctttctagttggaaatga

SEQ ID NO: 1428 - DNA, 1260 bp, Streptococcus pneumoniae
atgctcggaattttaacctttattctggtttttgggattattgtagtggtgcacgagttcgggcacttctactttgccaagaaatcagggattttagtacgtgaatttgccatcggtatgggacctaaaatctttgctcacattggcaaggatggaacggcctataccattcgaatcttgcctctgggtggctatgtccgcatggccggttggggtgatgatacaactgaaatcaagacaggaacgcctgttagtttgacacttgctgatgatggtaaggttaaacgcatcaatctctcaggtaaaaaattggatcaaacagccctccctatgcaggtgacccagtttgattttgaagacaagctctttatcaaaggattggttctggaagaagaaaaaacatttgcagtggatcacgatgcaacggttgtggaagcagatggtactgaggttcggattgcacctttagatgttcaatatcaaaatgcgactatctggggcaaactgattaccaattttgcaggtcctatgaacaattttatcttaggtgtcgttgttttttgggttttaatctttatgcagggtggtgtcagagatgttgataccaatcagttccatatcatgccccaaggtgccttggccaaggtaggagtaccagaaacggcacaaattaccaagatcggctcacatgaggttagcaactgggaaagcttgatccaagctgtggaaacagaaaccaaagataagacggcaccgactttggatgtgactatttctgaaaaggggagtgacaaacaagtcactgttacacccgaagatagtcaaggtcgttaccttctaggtgttcaaccgggggttaagtcagattttctatccatgtttgtaggtggttttacaactgctgctgactcagctctccgaattctctcagctctgaaaaatctgattttccaaccggatttgaacaagttgggtggacctgttgctatctttaaggcaagtagtgatgctgctaaaaatggaattgagaatatcttgtacttcttggcaatgatttccatcaatattgggatttttaatcttattccgattccagccttggatggtggtaagattgtgctcaatatcctagaagccatccgccgcaaaccattgaaacaagaaattgaaacctatgtcaccttggccggagtggtcatcatggttgtcttgatgattgctgtgacttggaatgacattatgcgactcttttttagataa

SEQ ID NO: 1429 - DNA, 804 bp, Streptococcus pneumoniae
atgacccaggatttacagaaaagaaccttgtttgcagggattgccctggctattttcctaccaattttaatgattgggggcctcttgcttcagatagcaatcggaatcatagccatgctagccatgcatgaacttttgaagatgagaggtctagagaccatgacgatggagggcctcttgaccctctttgcaacctttgcattgaccattcccttggagaattacctgacttttttgccagttgatgggaatgtggttgcctatagtgttttgatttcaatcatgttaggaacgaccgtttttagcaagtcttatacgattgaggatgcggttttccctcttgctatgagcttctacgtgggctttggatttaatgctttactagatgctcgtgttgcaggtttggacaaggctctcttagccttgtgtatcgtctgggcgacagacagtggtgcctatcttgttgggatgaactatgggaaacgaaagttagcaccaagggtatcgcctaataaaacccttgagggtgccttgggtggtattttaggagcaattttagtaaccattatctttatgatagttgacagtacagttgctcttccatatggaatttacaagatgtcagtctttgctattttctttagcattgctggacaatttggtgatttactagaaagttcgatcaaacgtcattttggtgttaaggattctgggaaatttatccctggacatggtggtgttttggatcgtttcgatagtatgttgcttgtatttccaatcatgcacttatttggactcttttaa

SEQ ID NO: 1430 - DNA, 777 bp, Streptococcus pneumoniae
ttgaataggaataagatcatgtttggattttttaagaaagataaggctgtggaagtagaggttccgacacaggttcctgctcatatcggcatcatcatggatggcaatggccgttgggctaaaaaacgtatgcaaccgcgagtttttggacataaggcgggcatggaagcattgcaaaccgtgaccaaggcagccaacaaactgggcgtcaaggttattacggtctatgctttttctacggaaaactggacccgtccagatcaggaagtcaagtttatcatgaacttgccagtagagttttatgataattatgtcccggaactacatgcgaataatgttaagattcaaatgattggggagacagaccgcctgcctaagcaaacctttgaagctttaaccaaggctgaggaattgactaagaacaacacaggattgattcttaattttgctcttaactatggtggacgtgctgagattacacaggcgcttaagttgatttcccaggatgttttagatgccaaaatcaatccaggtgacatcacagaggaattgattggtaactatctctttacccagcatttgcctaaggacttacgagacccagacttgattatccgtactagtggagaattgcgtttgagcaatttccttccatggcagggagcctatagtgagctttattttacggataccttatggcctgattttgacgaagcggccttgcaggaagctattcttgcctataatcgtcgtcatcgccgatttggaggagtttag

SEQ ID NO: 1431 - DNA, 573 bp, Streptococcus pneumoniae
atgaatacagtgaaaaataagcaagaaatcttagaggcttttagagaaaatccagatatgatggccattctgacgatcatccgagaccttggtctgaaagactcgtggttggcagcaggttctgtcagaaatttcatttggaatcttttgtcagacaaatccccttttgatcatgaaacagatatagatgtgattttctttgatccagatttttcttatgaggaaaccttattactgaagaaaaagctgagagaggattttcctcagtaccagtgggaattgaaaaatcaggtctatatgcatcagcacagtcctcacactgcttcctataccagttctcgtgatgctatgagtaagtatccagaacggtgtacggcagttggactgcgcttgaatgaagaatcagattttgaactctatgtaccttatggtttggaggatattttgaattttcaagttcgtccaactcctcatttcttagaaaatgaagaccgaatggaactctatcaaacacgtttatccaagaaaaattggcaggagaaatggaaaaatttgatttttaaaaatacttaa

SEQ ID NO: 1432 - DNA, 999 bp, Streptococcus pneumoniae
atgagtagaattttagataatgagataatgggggatgaggagttagtagaacgcacgctccgtcctcagtatttacgtgaatatatcggacaggataaggtcaaggaccagctacaaatctttattgaagctgccaaaatgcgggatgaagcgctggatcatgtgctcttatttgggcctccaggtctcgggaaaacgaccatggcctttgttattgccaacgaactgggagtcaatcttaagcagacgtcgggtccagtcattgaaaaagccggagatctggtagctattttgaatgagttagagcctggggatgtactttttattgatgagatccatcgtttgccaatgtcagtggaagaggtgctttatagtgctatggaggacttctacatcgatattatgattggggctggtgagggtagtcgtagtgttcatttggagttaccaccttttaccttgattggtgcgacgactcgggctggtatgctctccaatccgctacgggcacgttttgggattacaggccatatggagtattatgcccatgctgacttgacagaaattgtcgagcggacggcagatatttttgagatggaaatcactcatgaggcagcatctgagttggccctacgtagtcgtgggacccctcgtattgccaatcgtctcctcaagcgcgtgcgcgattttgcccagataatggggaatggggtaattgatgatattattaccgataaggctttgactatgctggatgttgaccatgaaggtttggactatgtggatcaaaaaatccttcgtaccatgattgagatgtacagtggaggacctgttggtctaggaactctttctgtgaatatcgccgaagagcgtgagacagttgaagacatgtatgagccttacttgattcaaaaaggttttatcatgcggacacggtctggacgggtggcgactgctaaggcatatgagcacttaggttatgaatacagtgaaaaataa

SEQ ID NO: 1433 - DNA, 105 bp, Streptococcus pneumoniae
atgactggacccgacgtctgcttaagattgactcccagttcgttggcaataacaaaggccatggtcgttttcccgagacctggaggcccaaataagagcacatga

SEQ ID NO: 1434 - DNA, 417 bp, Streptococcus pneumoniae
atgattactattaaaaagcaagaaattgtcaagctagaggatgttttgcatctctatcaggctgtcggttggacaaattatacccatcaaccagagatgctggagcatgccttatcgcattcattagtaatttatctggcacttgatggtgatgctgtggtgggcttgattcgtttggttggagatggattctcatcagtttttgtacaggatttgattgttttaccaatctatcagcgtcaagggattggtagtgccctaatgaaagaggccttaaaagattacaaagatgcttatcaagtccagctggtgacagaagagacagaaaaaaacgtgggattttatcgttctatgggctttgaaatcttatccacctataattgtatagggatgacttgggcgaatcgagaaaaataa

SEQ ID NO: 1435 - DNA, 696 bp, Streptococcus pneumoniae
atgccagtaaatgaatatggtcagatgattggtgagtcaatggaaggttatacacccggtgcactgccttctattgatttcttagaagggcgttatgctaggatagaggctctctcggtagaaaaacatgcggaggatttgctagctgtttatggcccggatactcctcgggagatgtggacctatctttttcaggagccagtagcagatatgggggagctggttagccttttaaatcagatgttggctcgtaaggaccgtttttactatgcaatcatagacaaggcgactggtaaggctttgggaactttttctctcatgcgcattgaccagaataaccgagtaatagaagtcggagcagtcactttttctccagagctaaggggtacacggataggaactgaggctcagtatctcctagctcgctatatttttgaggagctaaactatcgtcgctacgagtggaaatgcgatgccttaaatctgccatccagacgagttgcggagcgtttgggatttgtctatgaaggaaccttccgccaggcggtggtttataaggggcgtacgagagatacggattggttgtctatgattgatatggactggcctcaagtcaaagatcgtttggaaacatggctgcgtcctgaaaattttgataaaaatggacagcagtacaagagcttgagagaactttaa

SEQ ID NO: 1436 - DNA, 192 bp, Streptococcus pneumoniae
aggattcctaccttatttcacaacgatattaacgagtttagttggctcaaacagtttgggaaactgtttgaggttggaaatcagcaaataaattggttattttacaacaatattaaccaatttatttggtacactaatcactttcacgatttccttaccgtcaatttctgctttgactttttcatccgctag

SEQ ID NO: 1437 - DNA, 2502 bp, Streptococcus pneumoniae
atgagtttttacaatcataaagaaattgagcctaagtggcagggctactgggcagaacatcatacatttaagacaggaacagatgcatcaaaacctaagttttatgcgcttgatatgttcccttatccgtctggagctggtctgcacgtaggacacccagaaggttatactgcaaccgatatcctcagtcgttacaaacgtgcgcaaggctacaatgtccttcacccaatgggttgggatgcttttggtttgcctgcagagcaatacgctatggatactggtaatgacccagcagaatttacagcggaaaacattgccaacttcaaacgtcaaatcaatgcgcttggattttcttatgactgggatcgtgaagtcaatacaacagatccaaactactacaagtggactcaatggattttcaccaagctttacgaaaaaggcttggcctatgaagctgaagtgccagtaaactgggttgaggaattgggaactgccattgccaatgaagaagtgcttcctgacggaacttctgagcgtggaggctatccagttgtccgcaaaccaatgcgccaatggatgctcaaaatcacggcttacgcagagcgcttgctcaatgacttagatgaactagattggtcagagtctatcaaggatatgcaacgcaactggattggtaaatcaactggtgccaatgtaactttcaaagtaaaaggaacagacaaggaatttacagtctttactactcgtccggacacacttttcggtgcgactttcactgtcttggctcctgaacatgaattagtagacgctatcacaagttcagagcaagcagaagctgtagcagactataaacaccaagccagccttaagtctgacttggctcgtacagaccttgctaaggaaaaaactggtgtttggacaggtgcctatgccatcaaccctgtcaatggtaaggaaatgccaatctggattgcggactatgttcttgctagttatggaacaggtgcggttatggctgtgcctgcccacgaccaacgtgactgggaatttgccaaacaatttgaccttccaatcgtcgaagtacttgaaggtggagatgtcaaagaagctgcctacacagaggatggcctgcatgtcaattcagacttcctagatgaactcaacaaagaagacgctattgccaagattgtggcttggttggaaaaaaaaggctgtggtcaggagaaggttacctaccgtctccgcgactggctctttagccgtcaacgttactggggtgagccaattccaatcattcattgggaagatggaacttcaacagctgttcctgaaactgaattgccgcttgtcttgcctgtaaccaaggatatccgtccttcaggtactggtgaaagtccactagctaacttgacagattggcttgaagtgactcgtgaagatggtgtcaaaggtcgtcgtgaaactaacaccatgccacaatgggctggttcaagctggtactacctccgctatattgacccgcacaatactgagaaattggctgatgaggacctcctcaaacaatggttgccagtagatatctacgtgggtggtgcggaacatgctgtacttcacttgctttatgctcgtttctggcataaattcctctatgacctcggtgttgttccgactaaggaaccattccaaaaactctttaaccaagggatgattttgggaacaagctaccgtgaccaccgtggtgctcttgtggcaaccgacaaggttgaaaaacgtgatggttccttctttcatatagaaacaggggaagagttggagcaagcgccagccaagatgtctaaatcgctcaagaacgttgttaacccagatgatgtggtggaacaatacggtgccgatacccttcgtgtttatgaaatgtttatgggaccactcgatgcttcgattgcttggtcagaagaaggtttggaaggaagccgtaagttccttgaccgagtttaccgtttgattacaagtaaagaaatccttgcggaaaacaatggtgctcttgacaaggcttacaacgaaacagtcaaagctgttactgagcaaattgagtctctcaaattcaacacagctattgcccaacttatggtctttgtcaatgctgctaacaaggaagataagctttatgttgactatgccaaaggctttattcaattgattgcaccatttgcacctcacttggcagaagaactctggcaaacagtcgcagaaacaggtgagtcaatctcttatgtagcttggccaacttgggacgaaagtaaactggttgaagacgaaatcgaaatcgttgtccaaatcaaaggtaaagtccgtgccaaactcatggtcgctaaagacctatcacgtgaagaattgcaagaaattgctctagcggatgaaaaagtcaaagcagaaattgacggtaaggaaatcgtgaaagtgattagtgtaccaaataaattggttaatattgttgtaaaataa

SEQ ID NO: 1438 - DNA, 1089 bp, Streptococcus pneumoniae
atgagaatttttgctagtccttctagatatattcagggggaaaatgccttgtttgaaaatgccaaatcaattttggatttgggaaattaccctattctattatgcgatcagttggtttatgatattgttggaaaacgatttgaagattacctacataggtatggtttccatattgttctggcgctatttaatggtgaagcttctgacaatgaaatcaatcgagttgttgccttggctgagaaagaaaattgtgatagtattatcggtcttggtgggggaaagacgattgatagcgcaaaagctattgcagatttgattgaaaagcctgttattattgctccaacaattgcatcgaccgacgcacctgtatctgctttatctgttatttatacagatgaaggtgcatttgatcattatctattttattctaaaaatccagatttagttttggttgatacaaaagttatttcacaagcccctaagcgtttattagcgtctggtattgcagatggtttagcaacttgggttgaggcgcgtgcggttatgcaggcaaatggaaaaactatgttgggacaacagcaaacattggctggagttgcaattgcgaagaaatgtgaagaaacgctgtttgcagatggtttacaggctatggcagcttgtgaagctaaagtggtgacaccagcattagaaaatattgttgaagctaatactttattgagtggtctaggttttgaaagtggaggattagctgcggcgcatgcaattcataatggttttactgcattgacaggtgacattcatcatttaacacatggtgaaaaagtagcttatggaactttagtacaactattattggaaaatagacctaaagaagaacttgataagtatattgagttttacaaaaaaattggtatgccaacaactctaaaagaaatgcatttggatcaagttggatatgatgatttaataaaagttggtaaacaagcaactatggagggtgagacaattcatcagatgccgtttaagatttcgccttcagatgttgctcaagctattatcgctgtagatgcctatgtaaattcaaaataa

SEQ ID NO: 1439 - DNA, 669 bp, Streptococcus pneumoniae
atggaatttatgcttgacacattaaatttagatgagattaaaaagtggtctgaaattttgccgctagctggggtaacttcaaatcccactattgcaaaaagagagggttctattaatttttttgaacgaatcaaagatgtaagagaattgattggctctacaccctctattcatgttcaggtgatttctcaagattttgaaggcatcttaaaggatgctcatgaaattcgaagacaagcaggagatgatatatttatcaaagtacctgttactccagctggattacgtgcaataaaggtgctaaaaaaagagggctaccatatcactgcaacagctatttatacagttattcagggattattagctatcgaagtaggagcggattacctagctccatattataatagaatggaaaatctgaacattgattcaaattctgtcattcgtcaattagctcttgctattgatagacagaactctcctagtaagattttagctgcatcctttaaaaatgtagcacaagtaaataatgctttagctgcaggtgcgcatgctgttacagcaggagcagatgtttttgaatcagctttcgccatgccatctatccaaaaggcggttgatgatttttctgacgattggtttgttattcaaaatagtcgttccatttag

SEQ ID NO: 1440 - DNA, 2448 bp, Streptococcus pneumoniae
gtgcttacgatggtaaatacagaagtagcaagaacaacaatcaagacagaatattttggcagccttactgaaaggatgaacaaatatcgagaagatgttttaaataaaaaaccttatattgatgctgagagagcagttctagcaacacgcgcctatgaacgatacaaggaacaacctaatgtcctaaaacgtgcatatatgctgaaagaaattttggaaaatatgactatctatattgaagaagaatctatgattgcgggaaatcaagcttcttccaataaagatgctcctatttttccggaatatacgctagaatttgttctcaatgagttggatctttttgaaaagcgtgatggagatgttttctatattacagaagaaacaaaagaacaacttagaagtattgctccgttttgggaaaataataatttacgtgctagagctggtgccttattacctgaagaagtgtctgtttatatggaaacaggattcttcggtatggaaggtaagatgaattctggagatgctcacttagcagttaactatcagaaacttttgcaatttggtttaagaggttttgaagagcgggctcgtaaagcgaaagtagctctagatttaacagatccagcaagtattgataaatatcatttttacgactctatatttattgtaatcgatgctattaaagtatatgcaaagcgctttgttgctcttgctaaaagtttagccgaaaatgcaaatcctaaacgtaagaaagaattacttgagattgcagatatttgctctagagtcccatatgaaccggcaactacttttgcagaagctattcaatcagtttggtttattcaatgtattttacaaattgaatctaatggccactctctttcatatggccgttttgatcaatatatgtatccatatatgaaggctgatttagaaagtggtaaagaaacagaagatagcattgttgaacgtctgacaaatctttggattaagacaattacaatcaataaggttcgcagtcaatcacatacattttcttcagcaggaagtcctctatatcaaaatgttacaattggtggacagactcgagataagaaggatgctgttaacccattatcttatttggtattaaaatcagttgcacaaacccatctaccgcaacctaatctaactgtacgttaccatgcaggtttagatgctcgtttcatgaatgagtgtattgaagtgatgaaacttggttttggtatgcctgcatttaataatgatgagattattattccttcttttattgcaaaaggagtattggaagatgatgcttatgattacagtgccattggatgtgttgaaacggcagttccagggaaatggggctatcgttgcacaggtatgagttatatgaacttccctaaggttctacttatcacgatgaatgatggaattgatccggcttcgggtaaacggtttgcaccaagctttggtcattttaaggatatgaagaacttttctgaattagaaaatgcttgggataaaacactaagatatttgacacgaatgagtgttattgttgaaaattctattgatttatcattggaacgagaagttcctgatattctatgttcagcattgactgatgattgtattggtcgtggaaaacaccttaaagaaggtggagcagtatatgattatatatcaggattgcaagttggaattgcaaatttgtcggattcattagctgcaattaaaaaattggtgtttgaggaagaacgtataagcccaagtcagctttggcatgcactggaaacagattatgccggagaagaaggtaaggtcattcaagaaatgttgattcatgatgcacctaagtatggtaatgatgatgattatgctgacaaattggttactgctgcttatgacatttatgttgatgaaattgctaaatatcctaatacacgttatggaagagggcctattggaggaattcgttattcaggaacatcttctatatcagccaacgtagggcagggacgtggaacattagcaactccagatggacgcaacgcgggtacaccgttagcagagggttgttcaccatcacataatatggatcaacacggccctacatctgttttaaaatctgtttcaaaattaccaacagatgaaatcgtaggtggggttctcttaaatcagaaagtaaatcctcaaacgttagccaaagaagaagataaattaaaactaattgctttgttacgaacattctttaatcgtttacatgggtaccatattcaatacaatgttgtttccagagagacgctgattgacgctcagaaacatcctgaaaaacacagagacttaattgttcgtgttgcaggatactctgcattcttcaatgttctttctaaggcaacccaagatgacattataggacgtactgagcatactttgtaa

SEQ ID NO: 1441 - DNA, 1281 bp, Streptococcus pneumoniae
cagaaaatcattgcaccgatgatgaagtttgtgaatatgcgtggcattatagctctaaaagatgggatgttagcaattttgccattgacagtagttggtagtttgttcttgattatgggacaattgccgttcgaaggattaaataagagcattgctagtgtttttggagctaattggacagagccgtttatgcaagtatattcaggaacttttgctattatgggtctaatttcttgtttttcaattgcctattcttatgctaagaatagcggagtagaggctttaccagctggagttctatctgtatctgcattctttattttgctaagatcatcttatatccctaaacaaggtgaggcgattggggacgctattagtaaagtttggtttggaggccaaggaattatcggtgctatcattataggtttggtagtaggaagtatttataccttctttataaagagaaaaattgttattaagatgccagaacaagttccacaagctattgccaaacagtttgaagcaatgattccagcatttgtaattttcttatcttctatgattgtatatattttagcgaagtcattgactaatggcggaacattcatagaaatgatttattctgctattcaagttccgttgcaaggtttaactggatctttgtatggtgctattggaattgcattctttatatcatttttgtggtggtttggtgttcatgggcaatcggtagtaaatggagtagtgacagctctgcttttatctaatcttgatgctaataaagctatgttagcctctgctaatctatcattagaaaatggtgcacatattgttactcaacaatttttagattcatttttaattctatcaggttcagggattacgtttggtcttgtagttgccatgctttttgcagcaaaatcaaaacaataccaagccttaggaaaagttgcagcttttccagcaatatttaacgtaaatgagccagttgtatttggatttccgattgtcatgaatccagttatgtttgtacctttcattcttgttcctgtacttgcagctgtgatagtatatggagctattgcaacaggtttcatgcagccattctcaggggtaacattgccttggagtacaccagctattttatcaggatttttggtgggtggatggcaaggagttattactcagctggtgatattagcgatgtctacattggtttattttccattctttaaagtacaggatcgtttagcttaccaaaatgaaatcaaacaatcttag

SEQ ID NO: 1442 - DNA, 309 bp, Streptococcus pneumoniae
atggtgaagattggtttgttttgtgcagcaggtttttctactggtatgcttgtaaataatatgaaaattgcagcgcaagctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaa

SEQ ID NO: 1443 - DNA, 321 bp, Streptococcus pneumoniae
atggaaattattgttccagatcaaattatcatgggtttaattttatatgctggcgatgcgaaacaacatatttataaagcattagattacataaagaacggtacatgtgaacgatgtgaagaagaaatccagttagctgatgccgccttattagaagctcataatctacaaacaaaattcttggcacaggaagcgtctggtacaaagacagaaattacagctctctttgttcattcacaagatcatctcatgactagtatgacggagattaatttaatcaaagaaattattagtttgagaaaagaacttcataaaaaataa

SEQ ID NO: 1444 - DNA, 981 bp, Streptococcus pneumoniae
atgaatcaagataggaataaactgctttctaaaattgcttatctgtattatattgaaaacttaaatcagtcacaaatagcagcaaaattaggaatttatagaacctctattagtagaatgttaacagaagcaaggaatgtaggaattgttaaaattgaaatagagaattttgatacaaatatgtttaagttggaaaattatgtaaaagaaaaatacagtttggaaagtttagaaattattccaaatgaatttgatgatactccaacaattttatctgaaagaatttctcaagttgcagcaggcgtccttaggaatctaattgatgataatatgaaaattggcttttcttgggggaaaagtttaagtaatttagtagatttaattcacagtaaaagtgtccgaaatgttcacttctatcctctagcaggtggtcctagtcacatacacgctaaataccatgtgaatacactgatttatgaaatatctagaaaatttcatggagagtgtacatttatgaatgcaacgattgtgcaagaaaataaattgttagcagatggtattttgcaatcaagatattttgaaaatttgaaaaatagttggaaagatttagatatagctgtagtcggaattggtgattttagcaataaaggaaaacatcaatggttagacatgcttacagaggatgactttaaagaattgaccaaagttaaaactgtaggagaaatttgttgtcgattttttgattcaaaaggtaaagaagtctatgaaaacttacaggaaagaacgatagcaatctctttggaagatttaaaaaatattcctcaaagtttagctgttgcttacggtgatacgaaagtatcttcgattctttctgtcttgcgtgctaatttagtaaatcatttgattacagataaaaatacaattttaaaagttttggaagaagatggtgatttgacttttagagagattctaggtgagtga

SEQ ID NO: 1445 - DNA, 747 bp, Streptococcus pneumoniae
atgaaaagattggaacaaattattaaattagtatcagaacatgaaaagatcgacgttaatacattatcggaaaaattaaatgtatcgaaagtaacgattagaaaagatttagataaattagagtcaaaaggtttattacacagagagcatggatatgctgtattaaatagtggagatgacttaaatgtacgtttgtcaattaactatgaaattaagagaaaaattgttcaggaagcagtaaaattggtgtcagataatgaaacaataatgatagaatctggatcgacctgtgctttacttgctgaggaaatttgcaagcaaaaaagaaatgttacgattgtaacaaattcattttttatagcaaattttgtgagagcttatgattcatgtcgtattattgttcttggtggagagtttcagaaggattcacaggttactgtgggacctttattaaaagaaatgatacagacttttcatgtgcgtcaagcttttgttgggacagatggctacgataaagagatgggctttacaggaaaagatttaatgcgcagtgaggtagttcaatatatttcagcagcgtcggataaagtcattgtactaactgactcaagtaaatttgataaaaggggtacagtaagaagatttgctttaagtcaagtctatgaagtaataacagacgaaaaactttctaaacaaaatatagctacattagaaaatgctgggataatggttaaggtagtttcgtaa

SEQ ID NO: 1446 - DNA, 777 bp, Streptococcus pneumoniae
atggaaatatctaaaggaattatttttaatattcaacacttttcaattcatgacggcccgggtattcgtacaactgtttttttaaaaggatgtcctctgcgctgtccatggtgttctaatcctgaatctcaaagaatgaaacctgaaaaaatgaaagatgctcaacgagagaaattcaccttagtcggtgaagaaaagactgtagaagaaattattacagaggtattaaaagacaaagaattttacgaagaatccggtggaggtttaactttatcaggaggtgaaatatttgctcagtttgaatttgctaaagccatcttaaaatcagctaaagaacatcacatacacactgccattgaaactactgcctttgttgatcatgaaaaatttattgatttaattcaatatgtggattttatctacacagacctaaaacattataattctataaaacataaaaaagtgactggggtttttaatcaaatgattattaaaaacattcattatgctttttctcaaaataaaactatcgttttaagaatcccagttattcctaattttaacaatagtttagaggatgcagaaaaattcgctactctatttaactcattaaatatcgaccaagttcaactactcccttttcatcaatttggtgaaaacaaatatcgtttattaaatcggaaatatgaaatggatggaatcaacgcacttcatcctgaagatcttattgattatcaaaaggtatttctgaaccaccatattaattgttatttctag

SEQ ID NO: 1447 - DNA, 249 bp, Streptococcus pneumoniae
ctatttgcagataacaagcatctatataaggttatcaaagaagacttccccatgactctaaatgaatatatcttacaatatcgcctgaaacaagctatagataagatggctgaatctcccaactcccctttaagcgctatctctgaccaagttggattttcagactataaatattttgccaaagtatttaaaaagcatctccatatttccccaaaggaattgaaattactcggaagaatagtaaaatag

SEQ ID NO: 1448 - DNA, 195 bp, Streptococcus pneumoniae
atgaacatcgaaggatatagcgaccttctcaaacctgaactaaaaggaaaaatcgcaactgctgacccagcaaactcttctagcgcctttgctcaattaacaaatatgctacaagctcaaggtggttacaaagatgataaggcttggtcttatgtaaaagatcttttcacacttattgatggtatagtaaaatga

SEQ ID NO: 1449 - DNA, 369 bp, Streptococcus pneumoniae
atgactgttggtctctcttatgaagatccagcagttaaactcttaaatgacggagctaacattaaggtagtctatccaaaagaaggaaccgtcttcctacctgctagtgctgctatcgttaaaaaatctaaaaatatggaaaatgccaagaaatttatcgattttattatctctcaagaagtacaagatacacttggtacaaccactactaaccgtcctgttcgtaaaaatgctaaaacaagcgaaaacatgaaaccaattgacaaaatcaaaacactcactgaagattatgattatgtcatcaagaataaatcagatatcgttaagaaatacaacgaagtctttacagatatccaatctaaacagtaa

SEQ ID NO: 1450 - DNA, 954 bp, Streptococcus pneumoniae
atgagtgagatcgaaattattaacgccaaaaaaatctaccacgatgtctctgttattgagaatttgaacattacaattccaaaaggaagtctctttacccttcttggagcttcaggatgtgggaaaacgacccttcttcgtatgattgcaggtttcaacagtatcaaagatggagaattttacttcgatgatacaaaaatcaataatatggaacccagcaaacgcaatatcgggatggttttccaaaactacgctattttcccacatttgactgtccgagacaacgttgcttttggtcttatgcaaaagaaggttccaaaagaagaattgattcaacagaccaacaagtatcttgaactcatgcaaattgctcaatatgcggatcgaaagcccgataaactcagtggtggacaacaacaacgtgtcaccttggcatgcgccttagcggttaatccaagtgttctcctcatggacgagccacttagtaatctggaggccaaacttcgcttggatatgcgtcaagccatccgagaaatccaacacgaagtgggaattacaactgtttatgtaacccacgaccaagaagaagccatggctatttcagaccaaattgctgttatgaaagatggggtgatccaacaaatcggccgaccaaaagaactctatcataaaccagctaatgagtttgtggcaacctttatcggacgcacaaatattatccctgccaatcttgaaaaacggagcgacggcgcttatatcgtcttttcagatggctatgcccttcgaatgccagctcttgatcaggttgaggagcaagctattcatgtaagcattcgtcccgaagagtttatcaaagatgaatctggagatattgaaggaactattagtgatagcgtctatcttggactaaatacgaagtatttcattgagacaggttttgcctcaaaaatttaa

SEQ ID NO: 1451 - DNA, 627 bp, Streptococcus pneumoniae
atggaatgtaaaaaactaaatatttggacagcttcctctttcttcatctttcttacctatcttgtctttctcgtttatcctatcgttaccgtgctaaagcaagcacttatacatgaaggacaattctcactagctaattttgtcactttctttagtaaagtctactactctgagacactagtcaacagtttcaaggtttccattaccgctactgtcacttccttagttgtaggaaccctattagcttatctcttctctatgtatgacttcaaggggaagaaatttctacaaatattgattatcattgcttccatgtcagctcctttcgtaggagcctactcctgggttctcttgctgggacgaaatggggtcatcactaaatttttgacaaatgcccttcatcttccagctatcgatatttatggattcaaaggaattgtacttgtctttacactgcaactattcccactggtatttctatatgttgctgaaacaatgaacagtattgacaattctctacttgaagctgctgaaagcatggggtccttcggatttaaacctatcgtaacggttgttttacctctcctagttccaaccttactagcagctccttgcttgtatttatga

SEQ ID NO: 1452 - DNA, 771 bp, Streptococcus pneumoniae
atggctgccatttatgcaacagtctacggaattatctttatctctgttttacctcaaatctacttaatttatacctctttcctaaaaacatcaggtatggtatttgttaaaggttattctccaaacagttacaagctagctttcaatcgtatgggatctgctattttcaataccattcgtatccctttgattgccttagttctagttgttctatttgcgacatttatctcctacctagccgttagaaaacggaatttgtttacaaacttaattgacaacctcagtatggtaccttatattgtaccaggaaccgttctagggattgccttcatttcttccttcaatactggtctatttggaagtggatttcttatgattacagggactgctttcatcttgattatgtctctatctgtcagaagattaccttatactattcgctcatctgttgctagcttacaacaaatagcaccaagtattgaagaagctgctgaaagcttaggaagtagtcgtctcaatacctttgctaagattacaactccaatgatgctatctggtatcatttctggagccatcttatcttgggtcacactgatttcagaactctctacttctatcctctatcctcctctacaatgtcaaaacaagaacaatgactgtagctatttatacagaggttctcagaggaaattacggtgtagccgcagccttgtcaactatcctgactgttctaacagtaggttccttgctcttgtttatgaaaatctctaa

SEQ ID NO: 1453 - DNA, 198 bp, Streptococcus pneumoniae
tttcagaactctctacttctatcctctatcctcctctacaatgtcaaaacaagaacaatgactgtagctatttatacagaggttctcagaggaaattacggtgtagccgcagccttgtcaactatcctgactgttctaacagtaggttccttgctcttgtttatgaaaatctctaaaagcaatagcattacactttag

SEQ ID NO: 1454 - DNA, 750 bp, Streptococcus pneumoniae
atgggtggcttttattttatcattcatgatataatagaagcaaacggaggacggaaaatggtaaaagtacgattgtatttggtacgtcatggcaagaccatgtttaacacgattggtcgcgcgcaaggttggagcgatactcccttaactgctgaaggtgaacgagggattcaagagttaggaatcggtttgcgagaatctgatctacagtttgagcgcgcttattcgagtgattctggtcgtaccattcagaccatgggaattatacttgaagaacttggcttgcaggggaaaatcccttatcgcatggacaagcgtatcagagaatggtgtttcggtagttttgatggagcctatgatggcgatcttttcatgggcattattcctcgtatctttaatgtggaccacgttcaccaattgtcttatgctgaactggctgagggcttggtagaggtcgatacagctggttgggctgaaggttgggaaaaactcagtggccgaatcaaggaaggctttgaaataattgcaaaagaaatggaagatcaaggtggaggtaacgcccttgttgtcagccatggaatgactattggaaccattgtttatctgattaatggcatgcatccgcatggtctagataatggtagcgtgacgattcttgaatatgaggacggtcagtttagggttgaagttgtcggtgaccgtagttaccgagagctaggacgtgagaagatggaagaaggctctatttaa

SEQ ID NO: 1455 - DNA, 1338 bp, Streptococcus pneumoniae
atggatattagacaagttactgaaaccatcgccatgattgaggagcaaaacttcgatattagaaccattaccatggggatttctcttttggactgtatcgatccagatatcaatcgtgctgcggagaaaatctatcaaaaaattacgacaaaggcggctaatttagtagctgttggtgatgaaattgcggctgagttgggaattcctatcgttaataagcgtgtatcggtgacacctatttctctgattggggcagcgacagatgcgacggactacgtggttctggcaaaagcgcttgataaggctgcgaaagagattggtgtggactttattggtggtttttctgccttagtacaaaaaggttatcaaaagggagatgagattctcatcaattccattcctcgcgctttggctgaaacggataaggtctgctcgtcagtcaatatcggctcaaccaagtctggtattaatatgacggctgtggcagatatgggacgaattatcaaggaaacagcaaatctttcagagatcggagtggccaagttggttgtattcgctaatgctgttgaggacaatccatttatggcgggtgcctttcatggtgttggggaagcagatgttatcatcaatgtcggagtttctggtcctggtgttgtgaaacgtgctttggaaaaagttcgtggacagagctttgatgtagtagccgaaacagttaagaaaactgcctttaaaatcactcgtatcggtcaattggttggtcaaatggccagtgagagactgggtgtggagtttggtattgtggacttgagtttggcaccaacccctgcggttggagactctgtggcacgtgtccttgaagaaatggggctagaaacagttggcacgcatggaacgacggctgccttggccctcttgaacgaccaagttaaaaaaggtggagtgatggcctgtaaccaggtcggtggtctatctggtgcctttatccctgtttctgaggatgaaggaatgattgctgcagtgcaaaatggctctcttaatttagaaaaactagaagctatgacggctatctgttctgttggattggatatgattgccatcccagaagatacgcctgctgaaactattgcggctatgattgcggatgaagcagcaatcggtgttatcaacatgaaaacaacagctgttcgtatcattcccaaaggaagagaaggcgatatgattgagtttggtggtctattaggaactgcacccgttatgaaggttaatggggcttcgtctgtcgacttcatctctcgcggtggacaaatcccagcaccaattcatagttttaaaaattaa

SEQ ID NO: 1456 - DNA, 360 bp, Streptococcus pneumoniae
ttgagtattttcgttagaattatgctatactatttgaaaagaatcctgtttaatgttaaggtttcttattttaagaagaattggagtttgcttatgaaagcgattataactgttgttggtaaagataaatctggaattgttgcaggtgtttctggtaaaattgcagaattaggattgaatattgacgatatctctcaaactgtcttggatgaatattttacgatgatggctgttgtatctagtgatgaaaagcaagattttacctatcttcgtaatgaatttgaagcttttgggcaaactttgaatgtaaaaatcaatattcagagtgcagcgattttcgaagctatgtataatatctag

SEQ ID NO: 1457 - DNA, 387 bp, Streptococcus pneumoniae
atggcttaccgtaaactaggacgcactagctcacaacgtaaagcaatgcttcgcgatttgacaactgaccttttgatcaacgaatcaatcgtgacaactgaagctcgtgctaaagaaatccgtaaaactgttgaaaaaatgattactctaggtaaacgtggtgatttgcatgcacgtcgtcaagcagctgctttcgtacgtaatgaaatcgcatctgaaaactatgatgaagcaactgataagtacacttctactacagcacttcaaaaattgttctcagaaatcgcacctcgttatgctgaacgtaacggtggatacactcgtatccttaaaactgaaccacgtcgtggtgatgcagcgccaatggcgatcatcgaattagtataa

SEQ ID NO: 1458 - DNA, 936 bp, Streptococcus pneumoniae
atgatcgagtttgaaaaaccaaatataacaaaaattgatgaaaataaagattatggcaagtttgtaatcgaaccacttgaacgtggctacggtacaactcttggtaactctcttcgtcgtgtacttctagcttctctaccaggagcagctgtgacatctatcaacattgatggtgtgttacatgagtttgacacagttccaggtgttcgtgaagacgtgatgcaaatcattctgaacattaaaggaattgcagtgaaatcgtacgttgaagacgaaaaaatcatcgaactggatgttgaaggtcctgctgaagtaacagctggtgacattttgacagatagcgatattgaaattgtaaatccagatcattatctctttacaattggtgaaggttcttctctaaaagcgactatgactgttaacagtggtcgtggatatgtacctgctgatgaaaataaaaaggataatgcaccagttggaacacttgctgtagattctatttatacaccagttacaaaagtcaactatcaagtggaacctgctcgtgtaggtagcaatgatggtttcgacaaattaacccttgaaatcttgacaaatggaacaattattccagaagatgctttagggctttcagcacgtattttgacagaacatcttgatttgtttacaaatcttactgagattgctaagtcaactgaagtgatgaaagaagctgatactgaatctgacgaccgtattttagatcgtacgattgaggaactggacttgtctgtgcgttcatacaactgtttaaaacgtgccggtatcaatactgtgcatgatttgacagaaaaatctgaagcagagatgatgaaagtacgaaatcttggacgcaagagtttggaagaagtgaaactcaaactcattgatttgggtcttggattaaaagataaataa

SEQ ID NO: 1459 - DNA, 402 bp, Streptococcus pneumoniae
atgtcacagctgctcctggtagagaagctagaagtacacgacgaagagagttaccaagagttgtaccgtagccacgttcaagtggttcgattacaaacttgccataatctttattttcatcaatttttgttatatttggtttttcaaactcgatcatttagttactccctcttaaacgaaaagcagtgtaatgcgatgattatacacggcgacgttttggaggacgagcaccattgtgtgggcactggagtcacatcacgaattgctgttacttcaagaccagcggcagcaagcgcacgaatagctgactcacgaccagaacctggaccttttacagtaacttcaactgatttaagaccgtgttcttgtgcagatttagcagcagcttcagaagccatttga

SEQ ID NO: 1460 - DNA, 423 bp, Streptococcus pneumoniae
ttggctaaaccaacacgtaaacgtcgtgtgaaaaagaatatcgaatctggtattgctcatattcacgctacatttaataacactattgttatgattactgatgtgcatggtaatgcaattgcttggtcatcagctggtgctcttggtttcaaaggttctcgtaaatctacaccattcgctgctcaaatggcttctgaagctgctgctaaatctgcacaagaacacggtcttaaatcagttgaagttactgtaaaaggtccaggttctggtcgtgagtcagctattcgtgcgcttgctgccgctggtcttgaagtaacagcaattcgtgatgtgactccagtgcccacacaatggtgctcgtcctccaaaacgtcgccgtgtataatcatcgcattacactgcttttcgtttaagagggagtaa

SEQ ID NO: 1461 - DNA, 366 bp, Streptococcus pneumoniae
atggctcgtattgctggagttgatattccaaatgacaaacgcgtagtaatctcattgacttatgtcaacggtatcggacttgcaacatctaagaaaattttggctgctgctggaatctcagaagatgtttgtgtacgtgatcttacatcagatcaagaagatgctatccgtcgtgaagtggatgcaatcaaagttgaaggtgaccttcgtcgtaaagtaaacttgaacatcaaacgtttgatggaaatcggttcataccgtggtatccgtcaccgtcgtggacttcctgtccgtggacaaaacactaaaaacaacgctcgcactcgtaaaggtaaagctgttgcgattgctggtaagaaaaaataa

SEQ ID NO: 1462 - DNA, 165 bp, Streptococcus pneumoniae
gtggcaaaagactatgtgattgaagttgaaggcaaagtagttgatacaatgccgaatgcaatgtttacggttgaacttgaaaatggacatcagattttagcaacagtttctggtaaaatgcgtaaaaactatattcgtgttttagcgggagatcgtgttactgtc

SEQ ID NO: 1463 - DNA, 639 bp, Streptococcus pneumoniae
atgaatcttttgattatgggcttacctggtgcaggtaagggaactcaagcagcaaaaatcgtagaacaattccatgttgcacatatctcaacaggtgatatgttccgcgctgcaatggcaaatcaaactgaaatgggtgttcttgctaagtcatatattgacaagggtgaattggttcctgacgaagttacaaatggaatcgtaaaagaacgcctttcacaagatgatattaaagaaacaggattcttattggatggttacccacgtacaattgaacaagctcatgccttggacaaaacattggctgaacttggcattgaactagaaggtgttatcaatattgaagtgaaccctgacagcctcttggaacgtttgagtggccgtatcatccaccgcgtaactggagaaactttccacaaggtctttaacccaccagttgactataaagaagaagattactaccaacgtgaagatgataagcctgagacagtaaaacgtcgtttggatgttaatattgctcaaggagaaccaatcattgctcactaccgtgccaaaggtttggttcatgacatcgaaggtaatcaagatatcaatgatgtcttctcagatattgaaaaagtattgacaaatttgaaataa

SEQ ID NO: 1464 - DNA, 1311 bp, Streptococcus pneumoniae
atgttttttaaattattaagagaagctcttaaagtcaagcaggttcgatcaaaaattttatttacaatttttatcgttttggtctttcgtatcggaactagcattacagttcctggtgtgaatgccaatagcttgaatgctttaagtggattatccttcttaaacatgttgagcttggtgtcggggaatgccctaaaaaacttttcgatttttgccctaggagttagtccctatatcaccgcttctattgttgtccaactcttgcaaatggatattttacccaagtttgtagagtggggtaaacaaggggaagtaggtcgaagaaaattgaatcaagctactcgttatattgctctagttctcgcttttgtgcaatctatcgggattacagctggttttaataccttggctggagctcaattgattaaaactgctttaactccacaagtttttctgacgattggtatcatcttaacagctggtagtatgattgtcacttggttgggtgagcaaattacagataagggatacggaaacggtgtttccatgattatctttgccgggattgtttcctcaattccagagatgattcagggcatctatgtggactactttgtgaacgtcccaagtagccgtatcacttcatctatcattttcgtaatcattttgattattactgtattgttgattatttactttacaacttatgttcaacaagcagaatacaaaattccaatccaatatactaaggttgcacaaggtgctccatctagctcttaccttccgttaaaggtaaaccctgctggagttatccctgttatctttgccagttcgattactgcagcgcctgcggctattcttcagtttttgagtgccacaggtcatgattgggcttgggtaagggtagcacaagagatgttggcaactacttctccaactggtattgccatgtatgctttgttgattattctctttacattcttctatacgtttgtacagattaatcctgaaaaagcagcagagagcctacaaaagagtggtgcctatatccatggagttcgtcctggtaaaggtacagaagaatatatgtctaaacttcttcgtcgtcttgcaactgttggttccctcttccttggtgtgatttccattttaccgattgcagctaaagatgtatttggtctttctgatgttgttgcctttggtggaacaagtctcttgatcattatctctacaggtatcgaaggaatcaagcaattggaaggttacctattgaaacgtaagtatgttggtttcatggacagaacagaataa

SEQ ID NO: 1465 - DNA, 441 bp, Streptococcus pneumoniae
atgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagtaactccagttgttcttatcgaagcaggaattgttaaagctgaaaagtcaggtattaaaattcttggtaacggtgagttgactaagaaattgactgtgaaagcagctaaattctctaaatcagctgaagaagctatcactgctaaaggtggttcagtagaagtcatctaa

SEQ ID NO: 1466 - DNA, 183 bp, Streptococcus pneumoniae
atggctcaaattaaaattactttgactaagtctccaatcggacgcattccatcacaacgtaaaactgttgtagcacttggacttggcaaattgaacagctctgttattaaagaagataacgctgctatccgtggtatgattacagcagtatctcacttagtaacagttgaagaagtaaactaa

SEQ ID NO: 1467 - DNA, 495 bp, Streptococcus pneumoniae
atggcatttaaagacaatgcagttgaattagaagaacgcgtagttgctgtcaaccgtgttacaaaagttgttaaaggtggacgtcgtcttcgtttcgcagctcttgttgttgttggtgaccacaatggtcgcgtaggatttggtactggtaaagctcaagaagttccagaagcaatccgtaaagcagtagatgatgctaagaaaaacttgatcgaagttcctatggttggaacaacaatcccacacgaagttctttcagaattcggtggagctaaagtattgttgaaacctgctgtagaaggttctggagttgccgctggtggtgcagttcgtgccgttgtggaattggcaggtgtggcagatattacatctaaatcacttggttctaacactccaatcaacattgttcgtgcaactgttgaaggtttgaaacaattgaaacgcgctgaagaaattgctgcccttcgtggtatttcagtttctgatttggcataa

SEQ ID NO: 1468 - DNA, 357 bp, Streptococcus pneumoniae
gtgatttcaaaaccagataaaaacaaactccgccaaaaacgccaccgtcgcgttcgcggaaaactctctggaactgctgatcgcccacgtttgaacgtattccgttctaatacaggcatctacgctcaagtgattgatgacgtagcgggtgtaacgctcgcaagtgcttcaactcttgataaagaagtttcaaaaggaactaaaactgaacaagccgttgctgtcggtaaactcgttgcagaacgtgcaaacgctaaaggtatttcagaagtggtgttcgaccgcggtggatatctatatcacggacgtgtgaaagctttggctgatgcagctcgtgaaaacggattgaaattctaa

SEQ ID NO: 1469 - DNA, 525 bp, Streptococcus pneumoniae
atgtcacgtattggtaataaagttatcgtgttgcctgctggtgttgaactcgctaacaatgacaacgttgtaactgtaaaaggacctaaaggagaacttactcgtgagttctcaaaagatattgaaatccgtgtggaaggtactgaagtaactcttcaccgtccaaacgattcaaaagaaatgaaaactatccacggaactactcgtgcccttttgaacaacatggttgttggtgtatcagaaggattcaagaaagaacttgaaatgcgtggggttggttaccgtgcacagcttcaaggatctaaacttgttttggctgttggtaaatctcatccagacgaagttgaagctccagaaggaattacttttgaacttccaaacccaacaacaatcgttgttagcggaatttcaaaagaagtagttggtcaaacagctgcttacgtacgtagccttcgttcaccagaaccatataaaggtaaaggtatccgttacgttggtgaattcgttcgccgtaaagcaaggtaa

SEQ ID NO: 1470 - DNA, 399 bp, Streptococcus pneumoniae
atggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcatcgaagatgacaaacaaggcgtcatccgtgtatttcttaaatacggaccaaatggtgaaaaagttatcactaacttgaaacgtgtttctaaaccaggacttcgtgtctacaaaaaacgtgaagaccttccaaaagttcttaacggacttggaattgccatcctttcaacttctgaaggtttgcttactgataaagaagcacgccaaaagaatgttggtggtgaggttatcgcttacgtttggtaa

SEQ ID NO: 1471 - DNA, 237 bp, Streptococcus pneumoniae
gatatcaagggcgtcaaaactccaagtaaaaataggaaacttgacgaagaaactaaagtttctaggaaagtttatctttttcacacagagtttagcccgggttcaattgggcttgccaatttgaacacgagctacagctttggcaaaaaagaccaatttgctttggagcattgcttctgcattaaattgtctatttttgctcgtgctgttacgctctttgtatcatgtattaactag

SEQ ID NO: 1472 - DNA, 270 bp, Streptococcus pneumoniae
atggctaaaaaatcaatggtagctagagaggctaaacgccaaaaaattgttgaccgttatgctgaaaaacgtgctgcattaaaggcggcaggggactacgaaggtttatctaaattacctcgcaacgcttcaccgactcgtttacataatcgttgtagagttacggggcgcccacattcagtttaccgcaaatttggtctgagtcgtatcgcttttcgcgaacttgcgcataaaggtcaaattcctggtgtaacaaaagcatcttggtaa

SEQ ID NO: 1473 - DNA, 543 bp, Streptococcus pneumoniae
atggcaaatcgtttaaaagaaaaatatcttaatgaagtagttcctgctttgacagaacaattcaactactcatcagtgatggctgtgcctaaagtagataagattgttttgaacatgggtgttggtgaagctgtatcaaacgctaaaagccttgaaaaagctgctgaagaattggcacttatctcaggtcaaaaaccacttatcactaaagctaaaaaatcaatcgccggcttccgtcttcgtgaaggtgttgcgatcggtgcaaaagttacccttcgtggtgaacgtatgtacgaattcttggataaattggtatcagtttcacttccacgtgtacgtgacttccacggtgttccaacaaaatcatttgatggacgcgggaactacacacttggtgtgaaagaacaattaatcttcccagaaatcaacttcgatgacgttgacaaaactcgtggtcttgacatcgttatcgtaacaactgctaacactgacgaagagtcacgtgcattgcttacaggccttggaatgccttttgcaaaataa

SEQ ID NO: 1474 - DNA, 306 bp, Streptococcus pneumoniae
atgtttgtaaaaaaaggcgacaaagttcgcgtaatcgctggtaaagataagggaacagaagctgttgtccttactgcccttccaaaagtaaacaaagttatcgttgaaggtgttaacattgttaagaaacaccaacgtccaactaacgagcttcctcaaggtggtatcatcgagaaagaagcagctatccacgtatcaaacgttcaagttttggacaaaaatggtgtagctggtcgtgttggttacaaatttgtagacggtaaaaaagttcgctacaacaaaaaatcaggcgaagtgcttgattaa

SEQ ID NO: 1475 - DNA, 369 bp, Streptococcus pneumoniae
atgattcaaacagaaactcgtttgaaagtcgcagacaacagcggtgctcgcgaaatcttgactatcaaagttcttggtggttcaggacgtaaatttgcaaacatcggtgatgttatcgtggcatctgtaaaacaagctactcctggtggtgcggttaaaaaaggtgacgttgttaaagcagttatcgttcgtactaaatcaggtgctcgtcgtgctgatggttcatacatcaaatttgacgaaaacgcagcagttatcatccgtgaagacaaaactcctcgcggaacacgtatctttggcccagttgcacgtgaattgcgtgaaggtggcttcatgaagatcgtgtcacttgctccagaagtactttaa

SEQ ID NO: 1476 - DNA, 330 bp, Streptococcus pneumoniae
atgaagccaccttcacgcaattcacgtgcaactgggccaaagatacgtgttccgcgaggagttttgtcttcacggatgataactgctgcgttttcgtcaaatttgatgtatgaaccatcagcacgacgagcacctgatttagtacgaacgataactgctttaacaacgtcaccttttttaaccgcaccaccaggagtagcttgttttacagatgccacgataacatcaccgatgtttgcaaatttacgtcctgaaccaccaagaactttgatagtcaagatttcgcgagcaccgctgttgtctgcgactttcaaacgagtttctgtttga

SEQ ID NO: 1477 - DNA, 261 bp, Streptococcus pneumoniae
atggaacgcaataatcgtaaagttcttgttggacgtgttgtatctgacaaaatggacaagacaatcacagttgtagttgaaacaaaacgtaaccacccagtctatggtaaacgtattaactactctaaaaaatacaaagctcatgatgaaaacaatgttgccaaagaaggcgatatcgtacgtatcatggaaactcgcccgctttcagctacaaaacgtttccgtcttgtagaagttgttgaagaagcggtcatcatctaa

SEQ ID NO: 1478 - DNA, 399 bp, Streptococcus pneumoniae
ttgaactgttttgatacgagcgatttgttttttaacttctttcaagcgagctgtttgttccaattgaccagtagcagcttggaaacgaagttcaaacaattcttttttcaattcgttttcgcgcttcgcgagttcttcttgagaaagaccacgaagttctttaacaaattcttttacttcattaagtttcatgccttctccttattttgcttcacgttttacgaatttacatttaactggcaatttgtggctagcaagtcgaagcgcttcacgtgcaatctcttcagatacaccagcgatttcgaacatcactttaccacgtttaactggtgctacccaaccttcaggtgcccctttaccagatcccatacgcacaccgatagctttagcagtgtatga

SEQ ID NO: 1479 - DNA, 207 bp, Streptococcus pneumoniae
atgaaacttaatgaagtaaaagaatttgttaaagaacttcgtggtctttctcaagaagaactcgcgaagcgcgaaaacgaattgaaaaaagaattgtttgaacttcgtttccaagctgctactggtcaattggaacaaacagctcgcttgaaagaagttaaaaaacaaatcgctcgtatcaaaacagttcaatctgaagcgaaataa

SEQ ID NO: 1480 - DNA, 414 bp, Streptococcus pneumoniae
atgttagtacctaaacgtgttaaacaccgtcgtgagttccgtggaaaaatgcgcggtgaagcaaaaggtggaaaagaagtagcattcggtgaatacggtcttcaagctacaactagccactggatcactaaccgccaaatcgaagctgctcgtatcgccatgactcgttacatgaaacgtggtggtaaagtttggattaaaatcttcccacacaaatcatacactgctaaagctatcggtgtgcgtatgggatctggtaaaggggcacctgaaggttgggtagcaccagttaaacgtggtaaagtgatgttcgaaatcgctggtgtatctgaagagattgcacgtgaagcgcttcgacttgctagccacaaattgccagttaaatgtaaattcgtaaaacgtgaagcaaaataa

SEQ ID NO: 1481 - DNA, 627 bp, Streptococcus pneumoniae
atgcgtgtcggcatcatccgtgattgggatgccaaatggtatgctgaaaaagaatacgcggattaccttcatgaagatcttgcaatccgtaaattcgttcaaaaagaacttgctgacgcagcagtttcaactattgaaatcgaacgcgcagtaaacaaagttaacgtttcacttcacactgctaaaccaggtatggttatcggtaaaggtggtgctaacgttgatgcactccgtgcaaaacttaacaaattgactggaaaacaagtacacatcaacatcatcgaaatcaaacaacctgatttggatgctcaccttgtaggtgaaggaattgctcgtcaattggagcaacgtgttgctttccgtcgtgcacaaaaacaagcaatccaacgtgcaatgcgtgctggagctaaaggaatcaaaactcaagtatcaggtcgtttgaacggtgcagatatcgcccgtgctgaaggatactctgaaggaactgttccgcttcacacacttcgtgcagatatcgattacgcttgggaagaagcagatactacatacggtaaacttggtgttaaagtatggatctaccgtggtgaagttcttccagctcgtaaaaacactaaaggaggtaaataa

SEQ ID NO: 1482 - DNA, 225 bp, Streptococcus pneumoniae
acattcactctaaacaaagctgctgaaatcatcttgaaagttttgaactcagctgtagctaacgctgaaaacaactttggtttggataaagctaacttggtagtatctgaagcattcgcaaacgaaggaccaactatgaaacgtttccgtccacgtgcgaaaggttcagcttcaccaatcaacaaacgtacagctcacatcactgtagctgttgcagaaaaataa

SEQ ID NO: 1483 - DNA, 246 bp, Streptococcus pneumoniae
ttgttgattggtgaagctgaacctttcgcacgtggacggaaacgtttcatagttggtccttcgtttgcgaatgcttcagatactaccaagttagctttatccaaaccaaagttgttttcagcgttagctacagctgagttcaaaactttcaagatgatttcagcagctttgtttagagtgaatgttcaagattgcgattgcatcggctacgcttttaccacggatgttatcaagaacaagacgtga

SEQ ID NO: 1484 - DNA, 282 bp, Streptococcus pneumoniae
atgggacgcagtcttaaaaaaggacctttcgtcgatgagcatttgatgaaaaaagttgaagctcaagctaacgacgaaaagaaaaaagttattaaaacttggtcacgtcgttcaacgatcttcccaagtttcattggttacactattgcagtttatgacggacgtaaacacgtacctgtttacatccaagaagacatggtaggccacaaacttggtgaatttgcaccaactcgtacttacaaaggtcacgctgcagacgacaagaaaacacgtagaaaataa

SEQ ID NO: 1485 - DNA, 834 bp, Streptococcus pneumoniae
gtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaataaagacaacgttgaagcagttgttaaaacaatcgagtacgatccaaaccgttctgcaaacatcgctcttgtacactacactgacggtgtgaaagcatacatcatcgctccaaaaggtcttgaagtaggtcaacgtatcgtttcaggtccagaagcagatatcaaagtcggaaacgctcttccacttgctaacatcccagttggtactttgattcacaacatcgagttgaaaccaggtcgtggtggtgaattggtacgtgctgctggtgcatctgctcaagtattgggttctgaaggtaaatacgttcttgttcgtcttcaatcaggtgaagttcgtatgattcttggaacttgccgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaggcaccagttggtcgtaaagcaccatctactccatggggcaaacctgctcttggtcttaaaactcgtaacaagaaagcgaaatctgacaaacttatcgttcgtcgtcgcaacgagaaataa

SEQ ID NO: 1486 - DNA, 297 bp, Streptococcus pneumoniae
atgaatgtgtatgatgttatcaaaaaacctgtcatcactgacagctcaatggctcaacttgaagcagggaaatatgtatttgaagttgacactcgtgcaaacaaacttttgatcaagcaagctgttgaagctgctctcgaaggtgttaaagttgccaatgttaacacaatcaacgtaaaaccaaaagctaaacgtgttggacgttacactggttttactaacaaaactaaaaaagctatcatcacacttacagctgattctaaagcaatcgagttgtttgctgctgaagctgaataa

SEQ ID NO: 1487 - DNA, 624 bp, Streptococcus pneumoniae
atggcaaacgtaacattatttgaccaaactggtaaagaagctggccaagttgttcttagcgatgcagtatttggtatcgaaccaaatgaatcagttgtgtttgatgtaatcatcagccaacgcgcaagccttcgtcaaggaacacacgctgttaaaaaccgctctgcagtatcaggtggtggacgcaaaccatggcgtcaaaaaggaactggacgtgctcgtcaaggttctatccgctcaccacaatggcgtggtggtggtgttgtcttcggaccaactccacgttcatacggctacaaacttccacaaaaagttcgtcgcctagctcttaaatcagtttactctgaaaaagttgctgaaaacaaattcgtagctgtagacgctctttcatttacagctccaaaaactgctgaatttgcaaaagttcttgcagcattgagcatcgattctaaagttcttgttatccttgaagaaagaaatgaattcgcagctctttcagctcgtaaccttccaaacgtgaaagtcgcaactgctacaactgcaagtgttcttgacatcgcaaatagcgacaaacttcttgtcacacaagcagctatctctaaaatcgaagaagtacttgcataa

SEQ ID NO: 1488 - DNA, 627 bp, Streptococcus pneumoniae
atgacaaaaggaatcttagggaaaaaagtgggaatgactcaaatcttcactgaagctggcgaattgatccctgtaacagttattgaagcaactccaaacgttgttcttcaagttaaaactgttgaaacagacggatacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggtgctgaaattacagttgaaacattcgcagctggagacgttgttgacgtaactggtacttctaaaggtaaaggtttccaaggtgttatcaaacgccacggacaatcacgtggaccaatggctcacggttctcgttaccaccgtcgtccaggttctatgggacctgttgcacctaaccgcgtattcaaaggtaaaaaccttgcaggacgtatgggtggtgaccgcgtaacaattcaaaatcttgaagttgtacaagttgttccagaaaagaacgttatccttatcaaaggtaacgtaccaggtgctaagaaatctcttatcactatcaaatcagcagttaaagctggtaaataa

SEQ ID NO: 1489 - DNA, 309 bp, Streptococcus pneumoniae
atggcaaacaaaaaaatccgtatccgtttgaaagcttacgaacaccgtacgcttgacacagcggctgcaaaaatcgtagaatcagctactcgtacaggtgcacaagttgcgggtccaatcccacttccaactgaacgtagcctctacacaatcattcgtgcgactcacaaatacaaagactctcgcgaacaatttgaaatgcgtacacacaaacgtttgatcgatatcgttaacccaactcaaaaaacagttgatgccttgatgaaattggatcttccaagtggtgtaaacgtagaaatcaaactttaa

SEQ ID NO: 1490 - DNA, 618 bp, Streptococcus pneumoniae
atgaagaaaaaagacttagtagaccaactagtctcagagatcgagacggggaaagtcaggacactgggaatatacggtcatggagcttcaggtaaatcaacctttgcacaggaattgtaccaagctttagattctactacagtaaatttgctagagacagatccttatatcacctcaggacgccatctggtagtacccaaggacgcgccgaatcaaaaggtgacagccagtctgccagtggcgcatgaactggagagtttgcagagagatatccttgccttgcaggcgagtatggatgtcttgacaattgaagaaccttggaaggctagtgaggtcttgtctggagccaaaccaattttgattgtcgaagggatgtctgttggctttctacccaaggaactctttgaaaaaaccatctgtttctacacggatgaggagaccgaattaaagcgacgccttgctagagatacgactgtgagaaatcgcgatgcatcctttatattggctagccatcagatgagacgggagcagtatctgcgatactataaagaaactgagtctaaggcggatatcttagtggaccaatcagaagataaatttgatgtcaagaggacttaa

SEQ ID NO: 1491 - DNA, 591 bp, Streptococcus pneumoniae
atgaataatccaaaaccacaagaatggaaaagcgaggaacttagtcaaggtcgtatcattgactacaaggcctttaactttgtggacggcgaaggcgtgcgtaactctctctatgtatcaggctgtatgtttcactgcgagggatgttataatgttgcgacttggtcttttaatgctggcattccctatacagcagaattagaagagcagatcatggcagatcttgctcagccctatgttcaaggtttgactttgttgggaggggagccttttcttaatactgggattctcttgccacttgttaagcggattcggaaggaattgccagacaaggacatctggtcctggaccggctacacttgggaagaaatgatgttggaaactccagataaactggaattcttgtcactgattgacattcttgtcgatggaagatatgatcgaactaagagaaatcttatgctccagtttcgaggttcgtctaaccaacgaattatcgatgtgcaaaaatcgctcaaaagtgggcaagtagtgatttgggacaagctcaatgacggaaaagaaagctatgaacaggtgaagagagaatga

SEQ ID NO: 1492 - DNA, 207 bp, Streptococcus pneumoniae
caagaattccagtttatctggagtttccaacatcatttcttcccaagtgtagccggtccaggaccagatgtccttgtctggcaattccttccgaatccgcttaacaagtggcaagagaatcccagtattaagaaaaggctcccctcccaacaaagtcaaaccttgaacatagggctgagcaagatctgccatgatctgctcttctaa

SEQ ID NO: 1493 - DNA, 507 bp, Streptococcus pneumoniae
atggaattacgcagaccaagattagcggataagaaagctgttttagatatgatgacagagtttgaaaagagccaatcagcccatgatggaggattttgggatgttgaggatttttcttacgaggagtggctagaaggtaaccgtaataaagaaatgggaatatggctacctgaaaatcgcgttccatcgatacagttcgtattgtttggtgaatcaggttgtgctctaggatttttgaatctgcgattgagactgaatgaggggttactgaattatgctggccacattggctactccatccgtccatctgaaagaggcaagggttatgcaaaagagactctccgtcagggcttgcaagttgctaaggaaaagaacatcaagaaagctctggtgacctgtagcgtgaataatcttgctagcagagcagtcattctagcaaatggtggaatatttgaggatgctcgcaatggagtcgagcgttattggatagaggtagcgaatgaataa

SEQ ID NO: 1494 - DNA, 465 bp, Streptococcus pneumoniae
ttgcataacccttgcctctttcagatggacggatggagtagccaatgtggccagcataattcagtaacccctcattcagtctcaatcgcagattcaaaaatcctagagcacaacctgattcaccaaacaatacgaactgtatcgatggaacgcgattttcaggtagccatattcccatttctttattacggttaccttctagccactcctcgtaagaaaaatcctcaacatcccaaaatcctccatcatgggctgattggctcttttcaaactctgtcatcatatctaaaacagctttcttatccgctaatcttggtctgcgtaattccatccttacctcccactatgagaaaagcgagagctggctctcacttttattttttcttgttcttgtttaaaaattgttctctgaagctaagcaagcgttctttcttaccagctccacctttagagtgtttctcgtga

SEQ ID NO: 1495 - DNA, 2214 bp, Streptococcus pneumoniae
atgcatatgattgcactagaagaaaaaattacaattttgccaactctcttcgtcgagaaacgagatgggagacgtgttgtatttgatgtggacaagattgacaaggctctccacaaggcggctgacaaggttatggatgtgacacccctggttgaaaaacgcctcaatgatctgactgagcgaattattacagaaattcatagtcgctttccacagggaattaagatttacgaaattcaaaatatcgtagaacatgaactccttgaagccaaagaatatgcgctggctgaggagtatattacttatcggacacagagggattttgagcgctcaaaagcgacggatatcaactttagtattcataaacttctcaacaaagaccagacagttgtcaatgaaaacgctaataaagacagtgatgtctttaacactcagcgtgatttgacagcagggattgttgggaaatcaatcggactgcaaatgcttcctaagcacgtagccaatgcccaccaaaagggggatatccactatcacgatttggactacagtccctatacccctatgaccaactgctgtttgattgattttaagggtatgttggaaaatggttttaagattggaaatgcagaggtagagagtcccaagtctatccagactgcgacagcacagatttctcaaatcattgccaacgttgcttctagccagtacggtggctgttcagctgaccgtatcgatgaaattttggcgccttatgcagagaagaattatcaaaaacatctcaaagatgcagaagagtgggtattgcctgaaaaacgggaagattacgcttggaagaaaacgcaaaaggacatctacgatgccatgcaatctcttgagtatgaaatcaatactctcttcacttcaaatggacaaacaccttttacttcgttaggttttggtctgggaaccagtcgttttgaacgagaaattcaaaaagctattttaaacattcgcatcaagggtcttggttcagaacaccgtacggctatctttcctaaacttattttcactctgaaaagaggccttaatttagaggaaggaactcccaactacgacatcaagcagttggctcttgagtgtgcaaccaaacggatgtatccagatgttttatcttacgataagattgttgacttgacaggatccttcaaggtgcctatgggttgccgttctttcctccaaggatggaaggatgaaaatggtgtagaagtcaattcaggtcgcatgaatctgggtgttgtgacggttaatctgcctcgtattgctcttgagtctgaaggtgatatgaataagttctgggaaatcttcaacgagcgaatgaatatcgcagaagatgctcttgtttaccgtgtcgaacgcactaaagaggcgacaccagcaaatgctcctattctttatcagtacggtgcttttggccatcgtctaggtaaagaagaaagtgttgaccagctctttaagaatcgtcgtgctaccgtttcgctgggctatatcggcttgtatgaagtagcgacagttttctttggtaacagctgggaaagtaatccagatgctaaggaattcacgctagacatcattcacgatatgaaacgccgtgtagaagagtggtcagaccaatatggctaccatttctctatctactcaacaccatccgaaagtctgacagaccgtttctgccgactagatatagacaagtttggctctattcctgatatcacagacaaggaatactacaccaactctttccactacgatgttcgtaaaaatccaacaccgtttgaaaaattggactttgagaaagtctatccagaagcaggtgcgtcaggtggtttcatccattattgtgagtatccagtccttcagcaaaatccaaaggccttggaagctgtctgggattatgcttatgaccgtgtaggctatctaggcaccaatactccgattgaccgttgctacaagtgtgactttgaaggggattttgaaccaactgagagagggtttgcttgtccaaactgtggcaatagcgaccctaaaacagtagatgtggtgaagcgaacttgtggctacctaggtaatcctcaagcaagaccgatggtcaacgggcgtcacaaggaaatcgctgcgcgtgtcaaacatatgaatggttcaacgattaaaatagctgggcatcaagtaacaaattag

SEQ ID NO: 1496 - DNA, 1557 bp, Streptococcus pneumoniae
ttgaacaggagaaacgatatgagtgtgtatggtagagtagaagaagttcataaggagaatcgtgaacctctagaataccaaatcgaacaagaatcgcatcatcgtgaatcaagtcgtcttcctttggtgaaaattttactatggagtacgcttgtaacggggataactctaggagtaccgctattactcgacttaatgagtgcacaagaagtgcaggatttttatgcaggttgggcgcttcatcagacagggaagatttacagcgactattatggaagtcaaggtttgctttattatttgctgacttacgtgagtcagggcggatttttctttgccatctttgagtggttagccttggtagcaggaggatttttcctttttagatcagcggacaccttgacagagcaaggagaccaagctggacatctggtgactattttttacatgctagttacaggtcttgcttttggtggaggctatgcgactcttttagcgcttcctttcttattcgcagcctttagtttagttgcggcttacctaagcaatccaagccatgataagggatttgtacggattgggctagctttggcaggcggatttttctttgctcccttatcatcgctcctgtttattgctgtagtgagtttaggcttgttggtctttaaccttgggcatagacgctttgcgcatgggttttatcagtttcttgcagtggctttaggtttttcacttgtcttttatccaactgcctactatagtgctgcaacaggaagttttggggatgcgattagtggtattcgttatcctattgacagtattcgctttgattttacttctaaaattttagagaatatgtttttttatggcttgttgtcccttggtttgggatttgtggtttgtatctttttaggtctctttcaatccaaaccctttaaactatacgtcatttcggttcctgcaagtcttgtggtaattttaggtttgattttacttttcttttcacaagagcctctgcacgcttcttatttgatggtcgtcttccctgttttcctacttttattggtaaccaatattaagagtcaacagagggggcgtagtgctagaagaaaccgaagagaaacgccagttagcctatggagtcgtttcttcaaaggaaatctatatctgctagtttttgagtttgtctatcttttgtctgttccttttttgatgaagtttgtcctttatccagtaccttatcaagaacgtaatcgtcttgctgatttggtaaaagaggagacaaatacggaagatgctatctatgcatgggatgatactgcgactctttatcgtaagagtgagcgcttgtcgccatcggcgattttgtccccgttgcactatacagcaactgaggaaaatcgtaataagttacttaatgacttgaaagaaaaacaacctaaggtgattgtggtaaatgataaggtggtagtctggtctgaagtggaaacactcttaaaagaaaattaccaacaagtaaagactgattactcagagtttaaagtctataaaattaaataa

SEQ ID NO: 1497 - DNA, 1476 bp, Streptococcus pneumoniae
atgctacttgaactttgtcttgtttttggtctctttctttatttaggacgcatggctcccattttatggattactgtcctcattctactgagtatcatcacaatcatttcgatagtcaaccgtaatacgactcctgagaataaggtaacctggttgttagtagcctttgtgccagtatttggtcccttgctctatctgatgtttggtgaaaggcgattgtccaaaaaagaaatcaaacaactgaagaagctaggctctatgcatttccaagaagcaaatagccagctactaaaagagaaattaaaagaaagtgacaaggcagcttatggagtcatcaagtccttattgagtatggataccaatgctgacatctatgatcaaactgcctctacattttttcctaacggagaagctatgtggaaaaagatggtagaagatcttaaaaaggctgagaaatttattttcttggaatattacattatagaagaaggtttgatgtggaatcgcatactagatatactagagcaaaaggtagctcagggtgtagaggttaagatgctctatgatgatatcggctgtatggctactttaacaggagattatgcacatcgacttcgtcagctgggcatcgaggcccataaattcaataaagttattcctcgtttgacagtggcttataataacagagatcatagaaaaatattgattgttgatggtcagatagcctatactggtggggtcaatctggcagatgagtacattaaccacgtcgagagatttggttattggaaggatagtggaattcgcttagacggactagcagtaaaagccctgacacgcttatttttgaccacttggtacattaatcgaggagaaattagtgattttgatcaatatcatttagaaaatcattctatcccgagtgacggtttaaccattccatacggaagtggacccaagccaatttttcgagcgcaggtagggaaaaaagtttatcagagtttaatcaatcaagcaacagaatcggtctatattacgacaccttatttgattatagattatgatttaacagagacaatcaaaaatgcagctatgagaggggtcgatgttcgaattatcaccccttacataccagataagaagttcattcagttagtcacgagaggagcttatcccgaccttctttctgctggtgttcggatttatgagtatagtccaggttttattcatagtaagcagatgttggtagacgaagattttgcggtggtggggacaatcaatctcgactaccggagcttggtacaccattatgaaaatgcagtcttactctataaaactccttctataagggaaatcgcccgagattttcgaaatatatttgcagattctcaggaagtctatcctcattctatcaaaacgagctggtatcaaaagcttgtaaaagaaatcgcccagctattcgcccctatcttataa

SEQ ID NO: 1498 - DNA, 558 bp, Streptococcus pneumoniae
ttgacccccttgtttgaacttgttatactaggggaattgctggttagagaaaatttctctaaattggtagcagaaaggaaattcatcatgaaattaaaaagattcacactttctcttgcttctctagcaagttttagtctcttagtagcttgttcacaaagagctcaacaggttcaacagcctgttgctcagcagcaggtccaacagcctgctcaacaacctgctcaacagaataccaatactgcaaatgcaggaggtaaccaaaatcaagcggctccagtacaaaaccaacctgttgctcaaccgaccgatattgatgggacttatactggtcaggatgacggagaccgtatcactttagtggtaactggaacgactggtacatggactgagctcgaatctgacggggatcagaaagtcaaacaggttacatttgattcagcaaatcaacgcatgattattggcgatgatgtcaaaatttacactgtaaacggtaatcaaatcgtcgtagatgatatggatagagacccatcggaccaaatcgttttaactaaataa

SEQ ID NO: 1499 - DNA, 210 bp, Streptococcus pneumoniae
gctctttgtgaacaagctactaagagactaaaacttgctagagaagcaagagaaagtgtgaatctttttaatttcatgatgaatttcctttctgctaccaatttagagaaattttctctaaccagcaattcccctagtataacaagttcaaacaagggggtcaatttatctgctcacggtccagcaggtagccccgtacttctgagataa

SEQ ID NO: 1500 - DNA, 390 bp, Streptococcus pneumoniae
ttggagcgtattcgcccacagatttacttggatggtgctcataacctccctgccttgactcgcttggttgagtttatcaaagaaaaagagcaggaaggttatcgtcctcaaatcctttttggagccttgaaacggaaggattatcaagggatgttaggttacctgactgaaaaattgcctcaggtggaactcaaggtgaccggctttgactatcagggggctttggacgaaagggatgtgacaggttacgatatagtttcttcttaccgagaatttatcagcgattttgaagaaagagcagatgctcaggatttgctgttcgttacagggtctctctattttatctcagaagtacggggctacctgctggaccgtgagcagataaattga

SEQ ID NO: 1501 - DNA, 483 bp, Streptococcus pneumoniae
ttggtggcttacttgacacgaccaatgtgggtaactggagagcttgctgtcatcacctccattgggcttgaccatcaagaaaccttgggtgatagtctagaagcaattgcagagcagaaagctggtattttcaaggctggtaagaaggcagtgattgcgaaattgcctccagaagctaggcttgtctgtcagaaaaaagccgaatctttagctgttaacctttatcaggcaggtcaagattttttaatgctgaatggtgatttttcaagctctttactaaatctttcacagctgaacataggcttagaaggagtctatcagcaggagaatgcagccttggcgttgcaaacttttcttctttttatgggagaaggaaaggaagctgttgatgaacaggctgtaagaaaggccttggaacagacccattggggctggtcgcttggagcgtattcgcccacagatttacttggatggtgctcataa

SEQ ID NO: 1502 - DNA, 492 bp, Streptococcus pneumoniae
atgtttgaagtagaagaatggctccatagtcggattggtttgaattttcgatcatgtttgggccgaatgcagcaagcggtggatttgttaggaaatcctgagcagtcttaccctattatccacgtaacagggactaatgggaaaggatctaccattgcttttatgagggaattatttatggggcatggcaaaaaagttgcgacctttacctcccctcatatcgtctctatcaatgaccgaatctgcattaatgggcaacctatagcagacgcagactttatccgtttgactgatcaggtcaaggagatggagaaaacgcttctgcaaactcctgcccagttgtccttttttgaattgctgaccttagttgcttttctttattttagggagcaagaggtggatttggttttattagaagtgggaattggtggcttacttgacacgaccaatgtgggtaactggagagcttgctgtcatcacctccattgggct

SEQ ID NO: 1503 - DNA, 306 bp, Streptococcus pneumoniae
atgtcacacgatcataaccacgaccacgaagaacgtgaactaatcacactagtagatgagcaaggaaatgaaaccttgtttgaaatccttttgacaattgatggaaaagaagaatttggtaaaaactatgttcttctagtaccagttaacgcagaagaagacgaagacggacaagttgaaatccaagcttactcattcattgaaaatgaagatggaacagaaggcgaattgcaaccaatcccagaagactcagaagacgaatggaacatgattgaagaagtcttcaacagctttatggaggagtaa

SEQ ID NO: 1504 - DNA, 420 bp, Streptococcus pneumoniae
atgagaattatgggattggacgtcggttcaaaaacggtaggggtggcgattagcgatccgcttggttttacagctcaagggcttgaaatcatccagataaatgaagaacaaggccaatttggttctgaccgcgttaaggaattggttgatacttacaaggtggaacgatttgtagtgggcttgcctaaaaacatgaacaatacaagtggaccgcgcgtagaagctagtcaagcctacggagcaaagctagaagagttttttggtttaccagtagactatcaggatgaacgcttgacaacagtggctgctgagcgcatgttgattgaacaagcagatatcagtcgcaataagcgcaagaaagtcattgataagttagcagctcagctgattttacaaaattatttagatagaaaattttaa

SEQ ID NO: 1505 - DNA, 267 bp, Streptococcus pneumoniae
atgggatttactgaagaaacagtacgttttaaattggacgattccaataaaaaagaaattagcgaaactttgacagatgtttatgcttcgttgaacgataagggttacaacccaattaaccaaatcgtaggttacgtattgagtggagaccctgcctacgttcctcgttataataatgcacgaaatcaaatccgtaagtatgagcgtgatgaaatcgttgaggaattggttcgctactacctcaaaggacaaggagtcgatctataa

SEQ ID NO: 1506 - DNA, 570 bp, Streptococcus pneumoniae
atgaaaaaaatagttcttgttagtctagctttcctttttgtcctggttggttgcggacagaaaaaagaaactggaccagctacaaaaacagaaaaagatacgcttcagtcggcattgccagttattgaaaatgctgagaagaatacagttgtaactaagactttggtcttgcccaagtcagatgatggtagccagcagacacaaacaattacttacaaagacaagacttttttgagtctaactatccaacaaaaacgtccagtctctgatgagttgaagacttatattgaccaacatggagtggaggaaactcaaaaagctcttcttgaagcggaggagaaggataagtctatcattgaagctcgtaaattggcaggtttcaaacttgaaacaaaactattgagcgcaacggaacttcaaacaacgactagttttgattttcaagttctggatgtcaagaaggcttcccagttggaacatctgaagaatattggtttggaaaatcttttgaaaaatgaaccaagcaaatatatttcagatagattggcaaatggcgcgacagaacaatag

SEQ ID NO: 1507 - DNA, 399 bp, Streptococcus pneumoniae
atgattaaaatttatacagtctcaagttgtactagctgtaaaaaagcaaaaacctggctcaatgcccaccagttaagttataaagaacaaaaccttggtaaagaaggaattacgagagaagaattactggatattctaaccaaaacagataacggaatagccagcatcgtttcgtctaaaaatcgctatgccaaagcccttggagtggatattgaagatttgagtgtcaatgaagttctcaatctgattatggaaacaccgagaattttaaagagcccaatccttgtagatgaaaaacgcctgcaagttggctacaaggaagacgatattcgtaccttcctaccacgctctgtccgtaatgtagaaaatgcagaagcacgtttgcgtgcagctctataa

SEQ ID NO: 1508 - DNA, 378 bp, Streptococcus pneumoniae; identical to SEQ ID NO: 512

SEQ ID NO: 1509 - DNA, 315 bp, Streptococcus pneumoniae
  unsure (305): n at each above location is unknown.
atgatggttaacaagaagcaagtgaaagttggtatttcaaccatctactactggtttcataatggtcatttaggattgacgaaggccgacatgctttatcccagaaaaaggaaaggtgtcaagaagcaagctagtccgaactttaagccggcaggtaaatctatcgaagaacgtcctgacgttattaatcttcgcttggaaaatggtcattatgaaattgataccgtcctactgactaagataaaaaattattgcctgttagtcttaaccgaccggcggagcatacagcgaattgtcaggtcgtntatcatctct

SEQ ID NO: 1510 - DNA, 888 bp, Streptococcus pneumoniae
ttggttacaattggggcgacagaggctttatctgcgactttgacggctattttggaagagggcgacaaggtacttttgccagctcctgcttatccaggctatgaaccgattgttaacttagttggggcagaaattgttgagattgatacgactgaaaatggttttgtcttgactcctgagatgttggagaaggccattttggagcagggtgataagctcaaggcggttattctcaactatccagccaatccgacaggaattacctacagtcgagagcagttagaggccttggcagctgttttacgcaagtacgaaatttttgttgtctgtgatgaggtttactcagaattgacctacacaggcgaagcccatgtgtctctaggaacgatgttgagagaccaggctattattatcaatggtttgtctaaatcgcatgccatgacaggttggcgtttggggctgattttcgctcctgcggccttcacagcccagttaatcaagagtcaccaatacttggtcactgccgcaaataccatggcgcaacatgctgcggtagaagccttgacggctggtaaaaatgatgcggagcccatgaagaaggaatatatccagcgtcgggactatatcatcgaaaaaatgactgctcttggttttgagattatcaaaccagacggtgccttctatatttttgctaaaattccagcgggctacaatcaagactcctttgcttttctgaaggattttgctcagaagaaggccgttgcctttatccctggtgcagcctttggacgttacggggaaggctacgtccgcctatcttatgcagccagcatggagactatcaaagaagccatgaaacgacttgaggagtacatgagagaagcatga

SEQ ID NO: 1511 - DNA, 186 bp, Streptococcus pneumoniae
gtgtttgacaaaaaacatgcgtttgccaacctgctctgtaaaaattttgacgagcttgtcatcctcacgaaaattgcgattgtaaagcaccaagccttgactcgtgatagactgaatcatgcttctctcatgtactcctcaagtcgtttcatggcttctttgatagtctccatgctggctgcataa

SEQ ID NO: 1512 - DNA, 771 bp, Streptococcus pneumoniae
atgattcagtctatcacgagtcaaggcttggtgctttacaatcgcaattttcgtgaggatgacaagctcgtcaaaatttttacagagcaggttggcaaacgcatgttttttgtcaaacacgctggtcagtctaagctggcgcctgttattcagcccttggtgctggcacgatttctattgcgaatcaatgatgacggactcagttacatcgaagactatcatgaggtcatgacttttcccaagattaatagtgacctctttgtcatggcctatgcgacctatgtggcagctcttgcagatgctagtttgcaggacaatcagcaggatgctcccttgtttgcttttttgcaaaagactttggagttgatggaagcaggcttggattatcaggttttgaccaatatttttgaaattcaaattttgactcgatttggaatcagcctcaattttaatgagtgtgtcttctgccatcgggttggtcaggcttttgacttttctttcaaatatggagcctgcctctgtccagagcattatcatgaggataagagacgttgtcatctcaatcccaatatcccctatctgctcaatcaatttcaagctattgattttgagactttggagaccatttcgctcaagcctggaatcaagcaagagctacgccaatttatggatcaactatatgaagagtacgttgggattcacctaaaatcaaagaaatttattgattccctagcagactggggacaattactaaaagaggaaaagaaatga

SEQ ID NO: 1513 - DNA, 993 bp, Streptococcus pneumoniae
atgaaaaaaatcgcagtagatgccatggggggcgattacgcacctcaggccattgttgagggtgtcaatcaagccctatctgacttttcagatatcgaggttcaactttacggagatgaagctaaaatcaagcaatatctgacagcgacagagcgcgtcagcattatccatacggatgagaagattgattcggatgatgaacctacgagagctattaggaataagaaaaatgccagtatggtattggcagccaaggctgtcaaagatggtgaagcagacgctgtcctttcggctgggaatacaggtgccttgttggctgctggattcttcatcgtgggtcgtatcaagaatatcgaccgtcctgggcttatgtcgactttgccgactgtagatgggaagggatttgacatgctagacctcggtgccaatgcggaaaatacagcccagcacctccatcaatacgcggttctaggatccttctatgctaaaaatgttcgtggcattgcgcaaccacgtgttggcttgctcaataacggaacagagagtagcaagggcgatccgcttcgtaaggaaacttatgaattactagtggctgatgaaagtttgaactttatcggaaatgtggaagcgcgtgatttgatgaatggtgttgcagatgttgttgtggcagatggtttcacgggaaacgctgtgctcaaatccatcgaagggacagctatgggaatcatgggcttgctcaagacagctattacaggtggtggtcttcgagcgaaactaggtgccctccttctcaaggacagcctcagaggtttgaaaaaacagctcaattattcagatgttggtggagcggtcttgtttggtgttaaggcacctgttgtcaagactcatggctcaagcgatgccaaggctgtttatagtacgattcgccagattcgtaccatgctagaaacagacgtagttgcccagactgcgcgtgaattttcaggagaataa

SEQ ID NO: 1514 - DNA, 336 bp, Streptococcus pneumoniae
ttggaactccgattgctattttccttgaatgattttaaccacatctcctacgttttggagttggtcaatttcttcatcgctgatttcgatactaaattcatcttccagagtcaagataaactccatcaagtcaacagaatccgcatccaaatcgtctttcagactcaaggattctgtcacgacaaagtcctctccctgtcgctcttggataatggtcacaatacggtcaaaaatttctttttctgtcatctcttttattctcctgaaaattcacgcgcagtctgggcaactacgtctgtttctagcatggtacgaatctggcgaatcgtactataa

SEQ ID NO: 1515 - DNA, 234 bp, Streptococcus pneumoniae
atgacagaaaaagaaatttttgaccgtattgtgaccattatccaagagcgacagggagaggactttgtcgtgacagaatccttgagtctgaaagacgatttggatgcggattctgttgacttgatggagtttatcttgactctggaagatgaatttagtatcgaaatcagcgatgaagaaattgaccaactccaaaacgtaggagatgtggttaaaatcattcaaggaaaatag

SEQ ID NO: 1516 - DNA, 294 bp, Streptococcus pneumoniae
atgagaaatatcggacaagctggtaaaatcttggctgacagtggttatcaagggctcatgaagatatatcctcaagcacaaactccgaggaaatcaagtaaacttaagccattaactcttgaagataaagcctgtaatcatgcgctatctaaggagagaagcaaggttgagaatatctttgccaaagtaaaaacgtttaaaatgttttcaacaacctatcgaaatcatcgtaaacgcttcggattacgaatgaatttgattgctggtattatcaatcatgaactaggattctag

SEQ ID NO: 1517 - DNA, 231 bp, Streptococcus pneumoniae
atgaatacaaaaaagatgtcacaatttgaaattatggatactgagatgcttgcttgcgttgaaggtggcggatgcaattggggagattttgccaaagcaggtgttggaggaggagtagcacgaggtcttcagctaggaattaaaacaagaacatggcaaggtgcagcaactggtgctgcgggaggagctatacttggaggtgtggcctatgcagcgacatgttggtggtaa

SEQ ID NO: 1518 - DNA, 207 bp, Streptococcus pneumoniae
atggcaaggtgcagcaactggtgctgcgggaggagctatacttggaggtgtggcctatgcagcgacatgttggtggtaattatggattttaaaagttttattattggtttagtagttggtatatttggtccttatatggatgatttaattagaaaaaaatttttaaagtcttcggagaagaaaacagaaaaatctattaaaaaataa

SEQ ID NO: 1519 - DNA, 2160 bp, Streptococcus pneumoniae
atgaatatgaaatttgggaaacgtcactatcgtccgcaagtggatcagatggactgcggtgtagcttcattagccatggtttttggctactatggtagttattattttttggctcacttgcgagaattggctaagacgaccatggatgggacgacggctttgggcttggtcaaggtggcagaggagattggttttgagacgcgagccattaaggcggatatgacgctttttgacttgccggatttgacttttccttttgttgcccatgtgcttaaggaagggaaattgctccactactatgtggtgactgggcaggataaggatagcattcatattgccgatccagatcccggggtgaagttgactaaactgccacgtgagcgttttgaggaagaatggacaggagtgactctttttatggcacctagtccagactataagccttataaggaacaaaaaaatggtctgctctcttttatccctatattagtgaagcagcgtggcttgattgccaatatcgttttggcaacactcttggtaaccgtgattaacattgtgggttcttattatctgcagtctatcattgatacctatgtgccagatcagatgcgttcgacactagggattatttctattgggctagtcatcgtctacatcctccagcaaatcttgtcttacgctcaggagtatctcttgcttgttttggggcaacgcttgtcgattgacgtgattttgtcctatatcaagcatgtttttcacctccctatgtcctttttcgcgacacgcaggacaggggaaattgtgtctcgtttcacggatgctaacagtattatcgatgcgctggcttcgaccattctttcgattttcctagatgtgtcaacagttgtcattatttcccttgttttattttcacaaaataccaatctctttttcatgactttattggcgcttcctatctacacagtgattatctttgcctttatgaagccgtttgaaaagatgaatcgggacaccatggaagccaatgcggttctgtcttcttctatcattgaggacatcaacggtattgagactatcaagtccttgaccagtgaaagtcagcgttaccaaaaaattgacaaggaatttgtggattatctgaagaaatcctttacctatagtcgagcagagagtcagcaaaaggctctgaaaaaggttgcccatctcttacttaatgtcggcattctctggatgggggctgttctggtcatggatggcaagatgagtttggggcagttgattacctataataccttgctggtttactttaccaatcctttggaaaatatcatcaatctgcaaaccaagcttcagacagcgcaggttgccaataaccgtctaaatgaagtgtatctagtagcttctgagtttgaggagaagaaaacagttgaggatttgagcttgatgaagggagatatgaccttcaagcaggttcattacaagtatggctatggtcgagacgtcttgtcggatatcaatttaatcgttccccaagggtctaaggtggcttttgtggggatttcagggtcaggtaagacgactttggccaagatgatggttaatttttacgacccaagtcaaggggagattagtctgggtggtgtcaatctcaatcagattgataaaaaagccctgcgccagtacatcaactatctgcctcaacagccctatgtctttaacggaacgattttggagaatcttcttttgggagccaaggaggggacgacacaggaagatatcttacgggcggtcgaattggcagagattcgagaggatatcgagcgcatgccactgaattaccagacagaattgacttcggatggggcagggatttcaggtggtcaacgtcagagaatcgctttggcgcgtgctctcttgacagatgcgccggtcttgattttggatgaggcgactagcagtttggatattttgacagagaagcggattgtcgataatctcatggctttggacaagaccttgattttcattgctcaccgcttgactattgctgagcggacagagaaggtagttgtcttggatcagggcaagattgtcgaagaaggaaagcatgctgatttgcttgcacagggtggcttttacgcccatttggtcaatagctag

SEQ ID NO: 1520 - DNA, 1350 bp, Streptococcus pneumoniae
atgaaaccagaatttttagaaagtgcggagttttataatcgtcgttaccataatttttccagtagtgtgattgtacccatggcccttctgctcgtgtttttacttggctttgcaactgttgcagaaaaggagatgagtttgtccactagagctactgtcgaacctagtcgtatccttgcaaatatccagtcaactagcaacaatcgtattcttgtcaatcatttggaagaaaataagctggttaagaagggggatcttttggttcaataccaagaaggggcagagggtgtccaagcggagtcctatgccagtcagttggacatgctaaaggatcaaaaaaagcaattggagtatctgcaaaagagcctgcaagaaggggagaaccactttccagaggaggataagtttggctaccaagccacctttcgcgactacatcagtcaagcaggcagtcttagggctagtacatcgcaacaaaatgagaccatcgcgtcccagaatgcagcagctagccaaacccaagccgaaatcggcaacctcatcagtcaaacagaggctaaaattcgcgattaccagacagctaagtcagctatggaaacaggtgcttccttggccagtcagaatctagcctactctctttaccagtcctacaagtctcagggcgaggaaaatccccaaactaaggttcaggcagttgcacaggttgaagcacagatttctcagttagaatctagtcttgctacttaccgtgtccagtatgcaggttcagctacccagcaagcctatgcgtcagggttaagcagtcaattggaatcccttaaatcccaacatttggcaaaggttggtcaggaattgacccttctagcccagaaaatcttggaggcagagtcaggtaagaaggtacagggaaatcttttagacaaggggaaaattacggcgagtgaggatggggtgcttcatcttaatcctgagaccagtgattctagcatggttgcagaaggtgccctactagcccaactttatccatctttggaaagagaagggaaagccaaactcacagcctatctaagttcaaaagatgtagcaagaatcaaggtcggtgattctgttcgctatactacgactcatgatgccgggaatcaacttttcctagattctactattacaagtattgatgcgacagctactaagactgagaaagggaatttctttaaaatcgaggcggagactaatctaacttcggagcaggctgaaaaacttaggtacggggtggaaggccgcttgcagatgattacgggcaagaaaagttatctacgttattatttggatcaatttttgaacaaagagtaa

SEQ ID NO: 1521 - DNA, 750 bp, Streptococcus pneumoniae
gtggtaaaatgtgctcaagtaatacgaaaggcgaactttaaaatgtcaaaacaattgatctattcgggaaaagctaaagatatctatacaactgaggatgaaaatcttattatttcaacttacaaggaccaggcgactgctttcaatggtgtcaagaaggagcagattgcaggtaagggagtcttgaataatcagatctcatcttttatttttgagaaattaaatgcggctggtgtggcgactcactttgtggagaaactttcagacacggaacaactcaataaaaaggttaagattattcctttggaagtcgtgctccgcaactatactgctggttccttttcaaaacgttttggtgtggatgagggaatcgccttggagactccgattgtcgaattttactacaaaaatgatgatttggatgatccatttatcaatgatgagcatgtgaaattcctacagattgcgggtgaccagcagattgcctacttgaaggaagaaacgcgtcgtatcaatgaactattgaaagtctggtgtactgagattgggcttaaattgattgactttaagctagagttcggttttgacaaggatggcaagattatcttggcagacgaattttcaccagataactgccgcttgtgggacgctgatggcaaccacatggataaggatgttttccgtagaggattgggagaactaaccgacgtttatgagattgtttgggaaaagttgcaggaattgaaataa

SEQ ID NO: 1522 - DNA, 762 bp, Streptococcus pneumoniae
atggataaacgtatttttgttgaaaaaaaggctgattttcaggtcaagtcagagagtttggttagagagctccagcacaacttgggactgtcaagcttgaaaagtattcgtattgtgcaagtatatgatgtatttgacttggctgaggacttgtttgcacctgcagagaagcacattttctctgagcagggaaccgaccatgttttagatgaagtatctgtgcaggcggatcttgctaactatgctttctttgccattgaaagtctgccagggcagtttgaccagcgtgcagcttcgtcacaggaagccttgcttttgttgggaagttcgagtgacgtgacagtcaacacagcccaactttacttggtgaataaagatattgatgcgactgagttggaagctgtcaaaaactacctgctcaatccagttgattctcgtttcaaggatatcacgacagggattgccaagcaggagttttcagagtcagacaagaccattccaaaattgactttctttgaaagctatacagcagaagactttgctcgctacaaggccgagcaagggatggccatggaagtggatgatttgctctttatccaagactactttaagtcaatcgggcgcgtgccaactgacactgaactcaaggttttggacacttactggtctgaccactgccgtcatacaactttggagacagagttgaaacacatcgacttttcagcttttaaatttccaaagcaattggcaggcaacctatga

SEQ ID NO: 1523 - DNA, 285 bp, Streptococcus pneumoniae
ctcttccagagcaagacgctttcactcttggttacactatctacttcttcgaattggcaattggccctttcaggttacttgaatgctatcaacccatttgacccacccagtgttgaagcttataaacgtaacctgttggcccttctgggaaaaccaggaatggagaattggagcaaaggactaaccgcacgtctattattaaaaaaaaaaggggttggccccctctttttaatttttttttcccttagaaattggactcacccaggctttgtgatttatttttga

SEQ ID NO: 1524 - DNA, 1371 bp, Streptococcus pneumoniae
gtggcattttacgcaaacgtgggaattctgataaaaattggagaaattcgacaaaaaaacttgaaaaaaacgaaggtaagcgttatgatagaaaagaagaaatattggaggaagaacatgtcacatattaaatttgattattcaaaagttttagacaaatttgttgcaccacatgaagtggaatacatgcaatcacaagtaacagcagcagatgaattaatccgtaaaggaactggtgctggtagcgacttcttgggatggttggaccttcctgaaaaatacgaccgcgaagaatttgaccgcatcttgaaagctgctgagcaaatcaagtcagacagcgatgttttggttgtgatcggtattggtggatcttaccttggtgcaaaagcagcaatcgacttcttgaatcaccattttgctaacttgcaaacaaaagaagaacgcaaagctccacaaatcctttacgcaggaaactcaatctcatctacttaccttgctgacttggtagagtatgttgcagacaaagacttctcagtaaacgtaatttctaaatcaggtacaacaactgaaccagcgattgctttccgtgtctttaaagaactcttggttaagaaatacggtcaagaagaagctaacaaacgtatctatgcaacaactgaccgccaaaagggtgctgttaaggttgaagcagacgctaacggttggggaacatttgttgttccagatgatatcggtggacgcttctcagtattgacagccgttggtttgcttccaatcgcagcatcaggagctgacatcaaagctcttatggaaggtgcgaatgcagctcgcaaagactacacttcagacaaaatctctgaaaacgaagcttaccaatacgcagctgttcgtaacatcctttatcgtaaaggctatgcaactgagatcttggtaaactatgagccatcacttcaatacttctcagaatggtggaaacaattggctggtgaatcagaaggaaaagaccaaaaaggtatctacccaacttcagccaacttctcaactgacttgcactcacttggtcaatttatccaagaaggaactcgtatcatgtttgaaacagttgtccgtgttgacaaacctcgtaaaaacgtgcttattcctactttggaagaagaccttgacggacttggttaccttcaaggaaaagacgttgactttgtaaacaaaaaagcaactgacggtgttcttcttgcccacacagatggtgatgtaccaaacatgtatgtgactcttccagagcaagacgctttcactcttggttacactatctacttcttcgaattggcaattggccctttcaggttacttgaatgctatcaacccatttga

SEQ ID NO: 1525 - DNA, 738 bp, Streptococcus pneumoniae
ttgagtgatatgataggactatcgttagcattcgaaaggagaggcatcatggctagaacggttgtaggagttgctgcaaatctatgtcccgtagacgcagaaggcaaaatcattcattcatctgtatcttgtagattcgcagagatcattcgtcaagtcggtggtctccctttagtcattcctgttggtgatgagtcagttgtacgtgattatgtggaaatgattgacaaactcattttgacaggaggccaaaatgttcatcctcagttttatggagagaaaaagaccgtcgagagcgatgattacaatctggtccgtgacgaatttgaattggcactcttgaaggaagcgcttcgtcagaataaaccaattatggcaatctgtcgcggtgtccaacttgtcaatgttgcctttggtggaaccctcaatcaagaaatcgaaggtcactggcaaggactacctttcgggacatctcactctattgagacagtagaaggaagcgtggtggctaagctatttgggaaagaaagtcaggtcaactcagtccatcgtcaaagcattaaagatttggcacctaatttccgtgtaactgctattgattcaagagaccaaactattgaagcgattgagtctatcgacgagcaccgcattatcggtttacagtggcattcagagtttctggttaatgaagaagatggcaatttagaattatttgagtatttattgaatgaactgtaa

SEQ ID NO: 1526 - DNA, 1812 bp, Streptococcus pneumoniae
ttggcagtagctaactgcgctaaatataatataaggaggagtaaaatgaagacagttcaatttttttggcattattttaaggtctacaagttctcatttgtagttgtcatcctgatgattgttctggcgacttttgcccaagccctctttccagtcttttctggacaagcggtgacgcagctagccaatttagttcaagcttatcaaaatggcaatccagaacttgtatggcaaagcctatcaggaatcatggtcaatcttggcctgctggttttggttctatttatctctagtgtaatatacatgtgtctcatgacgcgcgtgattgcagaatcgaccaacgagatgcgcaaaggcctctttggtaagcttgctcagttgacggtttctttctttgaccgtcgacaagatggcgatatcctgtctcattttaccagtgatttggataatatcctacaagcctttaacgaaagcttgattcaggtcatgagcaatattgttttatacattggtctgattcttgtcatgttttcgagaaatgtgacgctggctctcatcaccattgccagcaccccattggctttccttatgctgattttcatcgtgaaaatggcacgcaaatacaccaacctccagcagaaagaggtagggaagctcaacgcctatatggatgagagcatctcaggccaaaaagccgtgattgtgcaaggaattcaagaggatatgatggcaggatttcttgaacaaaatgagcgcgtgcgcaaggcaacctttaaaggaagaatgttctcaggaattcttttccctgtcatgaatgggatgagcctgattaatacagccatcgtcatctttgctggttcggctgtacttttgaatgataagtctattgaaacaagtacagccctaggtttgattgttatgtttgcacaattttcacagcagtactaccagcctattatccaagttgcagcgagttggggaagccttcagttggcctttactggagctgaacgaattcaggaaatgtttgatgcagaggaggaaatccgacctgaaaaggctccaaccttcactaagttgcaagaaagtgttgaaatcagtcatatcgatttttcatacttgcctgataaacctattttgaaagatgtcagcatttctgcccctaaaggccagatgacagcagttgttgggccgacaggttcaggaaaaacgactattatgaacctcatcaatcgcttttatgatgttgatgctggtggtatttattttgatggtaaagacattcgtggctatgacttagatagtcttagaagcaaggtgggaattgtattgcaagattcggtcttgtttagcggaacgattcgagacaatatccgatttggtgtgccagatgctagtcaggaaatggttgaggtagcagcaaaagcaacccacattcacgactatatcgaaagtttgcctgataagtacgatactcttattgatgatgaccagagcatcttttcagcagggcagaagcaattgatttcaatcgctcgaaccctgatgacagatccagaagttctcattctcgatgaagcaacttcaaacgtagatacggtgacagaaagcaagattcaacatgccatggaggtggttgtagcaggtagaactagtttcgtcattgcccaccgcttgaaaaccattctcaatgcagatcagattattgtccttaaagatggagaagtcattgaacgtggtaaccaccatgaacttttgaagctaggtggcttttattcagaactctatcacaatcaatttgttttcgaataa

SEQ ID NO: 1527 - DNA, 216 bp, Streptococcus pneumoniae
acgattcccaatcccagtaaccgtcgttatgatcgagttgaactcagccatcaagtcattgacacatgtttccgccttgtcaatgagcctcttgtaatgtttgatgttttcattacacgagataaaacgtttatgcgttatcaaactcatgaccaattgaaacaaaaagctgtggttagatcctttcggaaattgtcaagcgattggaggaaatga

SEQ ID NO: 1528 - DNA, 324 bp, Streptococcus pneumoniae
ttgtttcaattggtcatgagtttgataacgcataaacgttttatctcgtgtaatgaaaacatcaaacattacaagaggctcattgacaaggcggaaacatgtgtcaatgacttgatggctgagttcaactcgatcataacgacggttactgggattgggaatcgtttaggggcggtcattttagccgagattcgaaatattcatgcctttgataatcctgctcaattacaagctttcgctggactggattcttctatttatcagtcaggtcagattgatttagctggaagaatggtcaaacggggttcccctcatctgcggtag

SEQ ID NO: 1529 - DNA, 588 bp, Streptococcus pneumoniae
  unsure (145): n at each above location is unknown.
ttggctcaattgattccacgtctctttgatccacagaacggggccattaaaatcggtggcacggatattcgagacgtgagtgaagggaacctgcgtcaaacagtttcatcgttctccaaacgttccattctttttagtgtgacgnttgcagataacttgagacaggggaagggaaatgctactctatttgaaatggagcgcgcacgcaatattgcccaggctagtgaattcattcatcgtatggagaaaaactttgaaagtccagttgaagaacggggaaccaatttctctggtggacaaaaacaaaggatgtcgattgcgcgtgggattgtcagcaatccacgtattctgatttttgacgattcgacctcagccttggatgccaaatcagagcgcttggtgcaagaagctttgaataaggacttgaaggggacgacaaccattattattgctcaaaaaattagctcggttgtccatgcagacaagatcttggttctaaatcaaggacgattgattggtcaaggcacgcatgcagacttggttgccaacaatgccgtttaccgtgaaatctatgaaacacagaaatga

SEQ ID NO: 1530 - DNA, 1083 bp, Streptococcus pneumoniae
atgctgattcagaaaataaaaacctacaagtggcaggccttggcttcgctcctgatgacaggcttgatggttgctagttcacttctgcaaccgcgttatctgcaggaagtattagacgccctccttactgggaaatatgaagctatttatagtatcggggcttggttgattggtgtggccgtagtcggtctagttgctggtggactcaatgttgtcctcgcagcctatattgcccaaggagtttcatccgaccttcgggaggatgccttccgtaaaattcaaaccttttcttatgctgatattgaacaatttaatgcgggaaatctagtcgttcgaatgacaaatgatatcaaccagattcagaacgttgtcatgatgaccttccaaattcttttcagacttcccctcttgttcatcggttcgtttatcctagcggttcaaaccttaccttctctgtggtgggtgattgttctcatggtagtcttgatttttggtttgactgctgtcatgatgggaatgatggggcctcgttttgccaagtttcaaacccttcttgagcgcatcaatgccattgccaaggaaaatttacgtggcgttcgtgtggtcaagtcctttgtccaagaaaaagagcaatttgctaagtttacagagatctcagacgagctttttggtcaaaacctttacattggttatgccttttcagtagtggaaccctttatgatgttggttggttacggggcggtcttcctctctatttggctggtcgcgggaatggttcagtcggatccgtctgttgttggttccatcgcttcttttgttaattacctaagccagattatctttaccattgttatggttggatttttgggaaattctgtcagccgtgccatgatttccatgcgtcgtattcgagaaattcttgacgcagagccagctatgaccttcaaggatatcccagatgaagagttggttggaagccttagctttgaaaatgtgacctttacctatcccatggacaaggaaccgatgctgaaagatgtgagctttactattgaaccttgtcaaatggttggtgtagtatga

SEQ ID NO: 1531 - DNA, 1965 bp, Streptococcus pneumoniae
atgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctcttgcagttggcgactaccttgtctagtgtgccacggattcgtgcgattttagaagggatggagcaacctactctagcctatctcatcgcacaactggatgcaatccctgagttggagagtttgattagcgcagcgattgctcctgaagctcctcatgtgattacagatgggggaattatccgaactggatttgatgagactttagacaagtatcgttgcgttctcagagaagggactagctggattgctgagattgaggctaaggagcgagaaaactctggtatcagcacgctcaagattgactacaataaaaaggatggctactattttcatgtgaccaattcgcaactaggaaatgtgccagcccactttttccgcaaggcgacgctgaaaaactcagaacgctttggaaccgaagaattagcccgtatcgagggagatatgcttgaggcgcgtgagaagtcagccaacctcgaatacgaaatatttatgcgcattcgtgaagaggtcggcaagtacatccagcgtttacaagctctagcccaaggaattgcgacggttgatgtcttacagagtctggcggttgtggctgaaacccagcatttgattcgacctgagtttggtgacgattcacaaattgatatccggaaagggcgccatgctgtcgttgaaaaggttatgggggctcagacctatattccaaatacgattcagatggcagaagataccagtattcaactggttacagggccaaacatgagtgggaagtctacctatatgcgtcagttagccatgacggcggttatggcccagctgggttcctatgttcctgctgaaagcgcccatttaccgatttttgatgcgatttttacccgtatcggagcagcagatgacttggtttcgggtcagtcaacctttatggtggagatgatggaggccaataatgccatttcgcatgcgaccaagaactctctcattctctttgatgaattgggacgtggaactgcaacttatgacgggatggctcttgctcagtccatcatcgaatatatccatgagcacatcggagctaagaccctctttgcgacccactaccatgagttgactagtctggagtctagtttacaacacttggtcaatgtccacgtggcaactttggagcaggatgggcaggtcaccttccttcacaagattgaaccgggaccagctgataaatcctacggtatccatgttgccaagattgctggcttgccagcagaccttttagcaagggcggataagattttgactcagctagagaatcaaggaacagagagtcctcctcccatgagacaaactagtgctgtcactgaacagatttcactctttgatagggcagaagagcatcctatcctagcagaattagctaaactggatgtgtataatatgacacctatgcaggttatgaatgtcttagtagagttaaaacagaaactataa

SEQ ID NO: 1532 - DNA, 546 bp, Streptococcus pneumoniae
ttgctctcaagacttatttttgaaaaggagagacagaaaatggcgatagaaaagctatcacccggcatgcaacagtatgtggatattaaaaagcaatatccagatgcttttttgctctttcggatgggtgatttttatgaattattttatgaggatgcggtcaatgctgcgcagattctggaaatttccttaacgagtcgcaacaagaatgccgacaatccgatccctatggcgggtgttccctatcattctgcccaacagtatatcgatgtcttgattgagcagggttataaggtggctatcgcagagcagatggaagatcctaaacaagcagttggggttgttaaacgagaggttgttcaggtcattacgccagggacagtggtcgatagcagtaagccggacagtcagaataattttttggtttccatagaccgcgaaggcaatcaatttggcctagcttatatggatttggtgacaggtgacttttatgtgacaggtcttttggatttcacgctggtttgtggggaaatccgtaacctctag

SEQ ID NO: 1533 - DNA, 447 bp, Streptococcus pneumoniae
atgagaaaaagagatcgtcatcagttaataaaaaaaatgattactgaggagaaattaagtacacaaaaagaaattcaagatcggttggaggcgcacaatgtttgtgtgacgcagacaaccttgtctcgtgatttgcgcgaaatcggcttgaccaaggtcaagaaaaatgatatggtgtattatgtactagtaaatgagacagaaaagattgatttggtggaatttttgtctcatcatttagaaggtgttgcaagagcagagtttaccttggtgcttcataccaaattgggagaagcctctgttttggcaaatattgtagatgtaaacaaggataaatggattttaggaacagttgctggtgccaataccttattggttatttgtcgagatcagcacgttgccaaactcatggaagatcgtttgctagatttgatgaaagataagtaa

SEQ ID NO: 1534 - DNA, 1692 bp, Streptococcus pneumoniae
atgaatacaaaagaattgattgctagcaaattatctagcatcattgatagcctggaccaagaggctattttaaagttactggaaacccctaaaaactcagaaatgggagacattgctttccctgctttttctcttgcaaaagtcgaacgtaaagcaccacaaatgattgcggctgaactggctgaaaaaatgaacagccaagcctttgaaaaagttgtcgcaacaggaccttacgttaactttttccttgataaatctgccatttctgctcaagtattgcaagctgttaccactgaaaaagaacactatgctgaccaaaatattggtaaacaagaaaatgttgttatcgacatgtctagtccgaatatcgctaaaccattttctattggccacctgcgttcaactgttatcggagatagcttgtcacatattttccaaaaaatcggttatcaaacggtcaaggtcaaccatttgggagactggggtaaacaatttgggatgttgattgttgcctacaaaaaatggggcgacgaagaagctgtaaaagctcatccaatcgatgaactccttaaactctatgtccgcatcaacgctgaagctgaaaatgaccctagcttggatgaagaagcgcgcgaatggttccgtaaacttgaaaatggagatgaggaagctctcgctctttggcaatggttccgcgatgaaagtttagtggaatttaaccgcctttacaatgaattgaaggttgaatttgacagctataacggagaagccttctacaatgataagatggatgcagttgtagacattctttctgaaaaaggactacttcttgaatcagaaggtgcccaagttgtgaatcttgagaaatacggaattgaacatccagccctcatcaagaagtctgatggtgcaactctctatatcacacgtgacttggctgcagccctctaccgtaaaaatgaataccaatttgctaaatctatctacgtcgttggtcaagaacaatctgcccactttaaacagctcaaagctgtcttgcaagagatgggctacgattggagtgacgacattacccacgttccttttggtctggttacaaaagaagggaagaagctctctactcgtaaagggaatgtcatcttgctagagcctactattgcagaggctgttagccgtgccaaggtccaaatcgaggctaaaaatcctgaactagaaaacaaagaccaagtagcacatgctgttggggttggagccattaaattctatgacctcaaaaccgaccgtacaaatggatacgacttcgacctagaagctatggtatccttcgagggtgaaactggaccttacgttcaatatgcctacgctcgtatccaatctatcttacgcaaagccgatttcaaaccagaaacatctggcaactatagcttgaatgatactgaaagctgggaaatcattaaactcattcaagacttcccacgtattatcaaccgtgcggcagataactttgaaccttctatcattgctaaatttgcaattagcctggctcaatcctttaacaaatactatgcacatacacgtatcttggatgaaagcccagaacgcgacagccgtctagccctcagctacgcaaccgcagtcgttctcaaagaagcccttcgcttgcttggagtagaagcgccagagaagatgtaa

SEQ ID NO: 1535 - DNA, 450 bp, Streptococcus pneumoniae
aaatcaatcgccctaaaaaaacaattagcgaatgattttggtaaaaagaaatttcacgctatgaaggctcaagcgattgtcacaagtcaagggagaattgtttctttggatatcgctgtgaactattgtcatgatatgaagttgttcaaaatgagtcgcagaaatatcggacaagctggtaaaatcttggctgacagtggttatcaagggcccatgaagatatatcctcaagcacaaactccacgtaaatccagcaaactcaagccgctaacagttgaagataaagcctgtaaccatgcgctatctaaggagagaagcaaggttgagaatatttttgccaaagtaaaaacgtttaaaatgttttcaacaacctatcgaaatcatcgtaaacgcttcggattacgaatgaatttgattgctggcattatcaatcatgaactaggattctag

SEQ ID NO: 1536 - DNA, 204 bp, Streptococcus pneumoniae
ttgatttttacttccgtcgcatcaatcattatcgtgtcctcagagctgagaggagttcttgaaatcgtaacaccacctttgaacaagagttacttcaacccattggctccgacggataaagaagacttgataagaactctagagttagctccccatgttgaaggtggctattttagacaaacaaaaaaacttcagacactataa

SEQ ID NO: 1537 - DNA, 285 bp, Streptococcus pneumoniae
  unsure (249): n at each above location is unknown.
ttgacagcagatgaaatctggtattttcatgcaggatccccacttactgttcacatgattacagcagatggtcactacgaagcagtcactttaggcctggacatatccaaagggcaacaacttcactactgtgttcctaagggcactatttggggatcaacagttgataaggattatgctctggtttcttgtcttgttgctcctggttttgaatttgaggattttgaattatttgaaagggtagatctnactggcgacctatccagagcacaaggagatgattga

SEQ ID NO: 1538 - DNA, 708 bp, Streptococcus pneumoniae
atgacaaaacaagtcttattagtggatgatgaagaacacattctgaaattgcttgactaccatttaagtaaggaaggcttttctactcaattggtaacaaatggacggaaggccttagctttggcagaaacagaaccctttgattttatcttgcttgatatcatgttaccacaattagatggcatggaagtttgtaagcggctgagagccaaaggcgtcaaaactccaattatgatggtttctgcgaaaagtgatgaatttgataaggttttagccttggaattaggggctgatgactacctgaccaagccttttagccctagagaattgctggcgcgtgtcaaggctgtcctcaggcgaactaaaggagaacaagaaggagatgattcagataatatcgctgacgattcttggctatttgggaccttgaaagtataccctgagcgtcatgaagtctacaaggcgaataagttactgagtttgaccccaaaagaatttgaactcttgctctatcttatgaaacatcccaacatgacactgactagagagcgtcttttggaacgtatctgggggtatgactttgggcaggaaacacgtttggtggacgttcatattggtaagttgagggaaaaaattgaagacaatcctaaagcccctcaatttattcgaaccattcggggttatggttataagttcaaggagttatag

SEQ ID NO: 1539 - DNA, 1332 bp, Streptococcus pneumoniae
atgaaacgctaccttcaattttggctagtcaatctaagtgttagcctcattctgattgcagggatggcattaacttggatcagtaaaggcatcggtctctttcttctagccctttctttgggacaaggtggctactggctcttttgcctttggaaatgggaagttgcttttgagaccttgcaccaacctctcttgaccaatagtgaatactttttagaaaaagggcaagaagacttaaagtctttggctcagtatgtgtctgccctaaaaaccaaagtctcccaacaggatcagcaatacaaggacctacccgaaacaatggaggttcttctgtcgcacctaaccatggggacgtttttagtttccgctcaaggtcagatgttattatccagtcgctctctgcctcattattttcccgatgtggacggcgacataagttcacttgatgacctcaaacggatggatattcgaaatttagttcaccaagcctttgatcaaaaaacaaggttaaaacaaaaagtaagtgggtttcatgagggtgacttgattttagaagtgacagcagttcccgtttttagccccacccaatctgtggaagctgtgctcgtcttgctatatgatttaacaacgattagaacttatgaaaagttaaatttagcctttgtctcaaatgcctcccatgaattgaggacaccagttacttcgattaagggctttgctgaaaccattaaggggatgtcagctgaagaagaagcgctcaaggatgactttctagacattatttacaaagaaagcttgcgtcttgagcatattgttgagcatcttcttaccttatctaaggctcaacaaatgcctatacaatggacgaccctttctttggcagaatttgtacaggatttgactcaaagcttgcaacctcagctcaagaagaaggatttacagctaaaggtgcaggtgccagatgatgtcaccctcgtatcagatagtcaattactttcccaaatcttactcaatcttttatccaatgccatccgttacactgaacaagggggaaaaattgaggtcaagacccaaaaggtgaacgaaggcattaagatttctgtatcagatacagggattggtattagtcaattagagcaggatcgtatttttgaacgtttttaccgagttaataaaggtcgaagcagacaaactggtggcactggtcttggccttgccattgtcaaagaactcagtcaattattaggtggccaagtcacggtgacgagtcagcttggcagaggcagttgcttcacgatttttcttcctaaccaatctttcgcacaggactaa

SEQ ID NO: 1540 - DNA, 876 bp, Streptococcus pneumoniae
atgaaattcaaaaaaatgcttactcttgcagccattggcttatcaggatttgggcttgttgcctgtggcaatcagtcagctgcttccaaacagtcagcttcaggaacgattgaggtgatttcacgagaaaatggctctggaacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaactgaaaccacagaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaataa

SEQ ID NO: 1541 - DNA, 816 bp, Streptococcus pneumoniae
atgagtgcaacagtagctgttgtagctattttgctaatctgtttctttatttttagtaatggcttacctttcatggctaactacggctttgcccgttttttattaggcagtgattggtcgccaacgaacattccggcaagctatggtattttaccaatgatcgttggttccttattaattaccttaggagcgattgtgattggggtgccaacaggcatcttgacatcggtgtttatggtttattattgtccaaagcccgtctatggcttcttaaaatcagctatcaacttgatggcggccattccatctattgtttatggttttttcggcctacaattattggtgccttggattagaacctttttaggaaatggcatgagtgtcctaaccgcttcgttactattaggaataatgattttgccaaccattatcagtttgtcagaatctgctatccgaacagttcccaaaacgtattattctggtagcttggctctaggagctagtcatgaacggagtatttttagtgtcatcttgccagctgcgagatctggtattttatcagcagttattttaggaatcggtcgcgcagtaggtgaaaccatggcagttattttggtggcaggcaaccagccgattattccaagcggactcttttcaggaaccagaaccttaacaaccaatattgttctggaaatggcttacgcatcaggtcagcatagggaagcccttattgcaacctcagcagttctctttttccttattctcttgattaatgcctactttgcctacttgaaaggaaaatcatcttatgagtaa

SEQ ID NO: 1542 - DNA, 816 bp, Streptococcus pneumoniae
atgagtaaatacctgctaaaacttctcgtttattgtttttcagctttaacctttggctctctctttttaatcattggttttatcctcatcaaaggcttacctcatctaagtctatccctcttttcttggacttatacttctgagaacatttcccttatgccagcgattatttccaccgttattctggtttttggtgctcttcttttagccttgcccatagggatttttgctggtttttatcttgtggaatatacaaaaaaagattccctttgtgttaaaatcatgcgattggcctcagataccttgtctgggattccttccattgtttttggtctgtttggcatgctcttctttgtagtcttcttaggttttcaatactctctgttatcaggaatcttaacctcagttatcatggtgttgccagtcattattcgctcaacagaagaagcccttttatctgttagtgatagcatgcgtcaagcaagttatggacttggggcaggtaagttacggactgtttttagaattgttctaccagttgccatgccaggtattttagctggagtgatactagctattggccgtatcgttggtgaaacagctgccctcatgtatacattaggtacctctaccaatacgccaagtagtctcatgtcttcaggtcgttctctagccctgcatatgtatatgctgtcaagtgaggggctacatgtcaatgaagcctatgctaccggtgtgattttgattattactgttttaatgataaatactctatcaagcttattatctcggaaacttgtgaaaggagcttcctag

SEQ ID NO: 1543 - DNA, 753 bp, Streptococcus pneumoniae
atgggaacattttcagtcagacacctagacttattttacggggattttcaagccttaaaaaatatttcgattcaattaccagaaagacagattactgccttgataggcccatctggttgtggtaaatcaacttttctaaaaacccttaatcggatgaacgatttggttccttcttgccatattgaaggccaagtcctcttagatgagcaagatatttatagtagcaaattcaaccttaatcagctacgtaagcgtgtagggatggtttttcaacagcctaatccctttgccatgtctatctatgataacgtggcttatggcccaaggacacatggtattcgagacaaaaaacaattagatgccttagtggagaaatctttaaaaggggcagccatttgggaagaagtcaaagatgatcttaaaaagagtgccatgtccttatctggcggtcagcagcaacgcctttgcattgcgcgagctttagcagtagaacctgatattctgttaatggatgagccgacttcagccttagaccctatctccactttaaaaattgaagacctcattcagcaactaaaaaaggattatacgattatcattgttacccataacatgcaacaagcttcacgtatttcagataaaactgcttttttcttaacaggagaaatttgcgaatttggagataccgttgacgtgtttaccaatccaaaagatcagcgcacagaagactatatttcaggacggttcggataa

SEQ ID NO: 1544 - DNA, 651 bp, Streptococcus pneumoniae
atgagaaatcaatttgacttagaattgcatgaattagaacaatcctttttaggactagggcaacttgtccttgaaacagcttcaaaagccttactggccttagcctccaaagacaaggagatggcagagctaattatcaataaggatcatgctatcaaccaaggtcaaagcgctatcgaattggcctgtgcccgtttgttagccttgcagcagccacaagtgtctgaccttcgatttgtaattagcatcatgtcttcttgttcagaccttgaacgtatgggagaccatatggcaggcattgccaaagctgttttgcaactaaaagaaaatcaactagcccctgacgaagaacagttacaccaaatgggtaaattatccctcagcatgctagccgatttattggttgcctttcctttgcaccaagcctcaaaagctattagtattgctcaaaaagatgaacagattgaccaatattattatgccttatcaaaggaaatcattggacttatgaaagaccaagaaacctcaattcccaatggaactcaatacctttatatcatagggcatctggaacgcttcgctgattacattgctaacatttgtgaacgcctagtctacctagaaacaggagaactggtggatttgaattaa

SEQ ID NO: 1545 - DNA, 426 bp, Streptococcus pneumoniae
ttgaacaatttaagcagtgtagatagtgaggagctgtttcaattctatcgtgaacgagggaatgctgaaaactttatcaaagaaaggaaagcaggattctttggggataagacagatagttcgaccatgattaagaatgaagtacgtatgatgatgggctgtctggcttataatctctacctctttttaaagcagctagctggtgatgaagtaaaggccttgactatcaagcgttttcgacgtctcttccttcatattgccggaaaatatgtctctactgctagacgacatattctcaaattctcaagtctatacgcctattcaaaacagtttcaagccttatttgatacaatctgccagataaatctgatactccctgttccatatagagctagagggcaggggaaaacatgcctaacagaataa

SEQ ID NO: 1546 - DNA, 219 bp, Streptococcus pneumoniae
atgcctaacagaataagtcaccttattttaaaaatcgagcatcaaaccaagggaggagtctacccttttttaggaaaaaatcaagacaaatctcctcaattatgtctcgaacatcagaaattaagcaaaatcaccagaaggacagtatttcaactagcttttctggtaatttttgaactgtgtagttcgttagtgccagatatgaataatttgggatga

SEQ ID NO: 1547 - DNA, 459 bp, Streptococcus pneumoniae
gtgagaagaaatctgatagatagtttgattcagtatatgcttataataggggtaaacaactcaggaggttcttgtaggttgcgagagtttggcgaaaaaattaaaagattacgtttggctaaaaaaatcagtcgttcagaattttgtggtgatgagtctgaattaagtatccgtcaattaattagaattgaaaatggagaatccagaccaacactaacaaagttaaaatatatcgctgaacgtttgggggttgaagattacaagttgatgccaagttatatagagttggataaggaatacctagaattgaagtatttcttgatgagaactcctacatacgaagatgaaactatcgcccaaaagaaagagagtgttttgataagatttttgaagagtattatgataggctacctgaggaagaaagatttatcatcccaaattattcatatctggcactaa

SEQ ID NO: 1548 - DNA, 1017 bp, Streptococcus pneumoniae
atggaaaaacaaaccgtcgccgtcttggggcctggttcttggggaaccgccctttcacaagtcttaaatgacaatggacacgaggtacgtatttggggaaatcttcccgagcaaatcaatgaaattaatacacaccatactaataagcactactttaaagatgtcgttctagacgaaaatatcattgcctacaccgacttagcagaaacattgaaagatgtggatgcgattttgtttgttgtcccaacaaaagtgacacgacttgttgcccaacaagttgcacaaaccttggaccataaggttatcatcatgcacgcatcaaagggattagaacctgatagccataaacgattatcaaccattcttgaagaagaaattcctgaacatctccgtagtgatatcgtcgttgtttcagggcctagtcatgcagaagagaccattgtgcgtgacctaactttaataactgctgcttctaaagatttacaaacagctcaatacgttcaggagctatttagtaatcactacttccgactttataccaatacggatgttatcggggttgaaactgctggtgctcttaaaaatattattgctgtcggtgctggagctttacatggtcttggatttggtgataatgctaaggcagccatcatcgctcgaggtttagcagaaatcacccgcctaggggtagcactcggggccagtccattgacctatagcggcttatctggtgtgggagatttgatcgtaacgggaacttccatccactctcgtaactggagagctggagatgctctcggacgaggagaatccctagctgatatagaagctaatatgggcatggtaatcgaaggaatttcaacgactcgagcagcctatgaactagcccaagaacttggagtctatatgcccattacacaggctatttaccaagttatttatcacggaaccaatatcaaagatgccatttatgacatcatgaacaatgaatttaaagcagaaaatgagtggtcttaa

SEQ ID NO: 1549 - DNA, 900 bp, Streptococcus pneumoniae
atgacatcaaaagttagaaaggcagttatccctgctgctggactaggaactcgatttttaccagcaaccaaggcccttgccaaagaaatgttgccaatcgtagacaaaccaactatccagtttatcgtggaagaagctctcaaatcaggtattgaagatattctagttgtcactggtaaatcaaaacgttctattgaggaccacttcgattcaaacttcgaattggaatataacctcaaagaaaaagggaaaacagatcttttgaagctagttgatgaaacaactggcatgcgtctgcattttatccgccaaactcatccacgcggtctcggagatgctgttttgcaagccaaggctttcgtcggaaatgaaccttttgtcgttatgcttggtgatgacttgatggatatcacagacgaaaaggctgttccacttaccaaacaactcatggatgactacgagcgtacccacgcgtctactatcgctgtcatgccagtccctcatgacgaagtatctgcttacggggttattgctccgcaaggcgaaggaaaagatggtctttacagtgttgaaacctttgttgaaaaaccagctccagaggacgctcctagcgaccttgctattatcggacgctacctcctcacgcctgaaatttttgagattctcgaaaagcaagctcctggtgctggaaatgaaatccaacttactgatgcaatcgatactcttaataaaacacagcgtgtttttgcccgtgaatttacaggagctcgttacgacgttggggataagtttggctttatgaaaacatctattgactacgccctcaaacacccacaagtcaaagatgatttgaagaattacctcatccaacttggaaaagaattgactgagaaggaataa

SEQ ID NO: 1550 - DNA, 675 bp, Streptococcus pneumoniae
atgaaaaaagataaggcattttttgaaccttatctttttattttattccttctcagtcaattcttttccaagttggatgaggtaattcttcaaatcatctttgacttgtgggtgtttgagggcgtagtcaatagatgttttcataaagccaaacttatccccaacgtcgtaacgagctcctgtaaattcacgggcaaaaacacgctgtgttttattaagagtatcgattgcatcagtaagttggatttcatttccagcaccaggagcttgcttttcgagaatctcaaaaatttcaggcgtgaggaggtagcgtccgataatagcaaggtcgctaggagcgtcctctggagctggtttttcaacaaaggtttcaacactgtaaagaccatcttttccttcgccttgcggagcaataaccccgtaagcagatacttcgtcatgagggactggcatgacagcgatagtagacgcgtgggtacgctcgtagtcatccatgagttgtttggtaagtggaacagccttttcgtctgtgatatccatcaagtcatcaccaagcataacgacaaaaggttcatttccgacgaaagccttggcttgcaaaacagcatctccgagaccgcgtggatgagtttggcggataaaatgcagacgcatgccagttgtttcatcaactag

SEQ ID NO: 1551 - DNA, 681 bp, Streptococcus pneumoniae
ttgatgaaggaaatctttgatagacgttaccctgtgacgagtttcttcctcttagtgacgaccttggtatttttactaatgttggtcactacaggcggaaactttgacagggcagatacattatttcgatttggagccatgtatgggccagctattcgcctctttcccgagcaggtttggcgtctcttgtctgccatttttgttcatattgggtgggaacatttcattgttaatatgctttcactttattatcttggaaggcaggtagaggagattttcggttctaagcagtttttctttctctatcttttatcaggaatgatgggcaatctctttgtttttgtatttagtcctaaatccttagcagcaggcgcctctacctctctttatgggctatttgccgcgattattgttcttcgctatgcaactcgcaatccttatatccaacagctagggcaatcctatctgacactttttgtggttaacattattggaagtgttctgattccaggaatcagcctagcaggccatatcggtggtgcagttggtggcgcatttctagcagttatctttccagttagaggagaaaaacggatgtataacaccagccagagattaggagcggtagtcttgttcgtaggactcgccattttgcttttctacaagggaatgggaatgtga

SEQ ID NO: 1552 - DNA, 546 bp, Streptococcus pneumoniae
ttgtatatgaaatcggaattacgcaagcaagtcttgcatgaaatgaaggctttatctcaagaacaaaaacaggctatagaccaagctttaaccgagcgaattttacaacaccccttttatcaagaagccaaggtcatcgcaacctacctctctttttctcatgagtttcaaacgcgggaactgattgagcaggcgctgaaggacggcaagaaggttttaatacccaaaacttatcccaaggggcgcatggactttgtagtctatgatccgcagcagttggtaaaaactgcctttgccttactggagccacagggagatttggaagtggtggatgtatctcagattgatttgattcatgttcctggcctggcttttacgacggatggatatcggattggatatggtggaggttattatgaccgctatctggaacatttttctggtcatactttgagtacggttcatccttgtcaaattcaggactttatacctgaaaaccatgatattcctgttcaggaggtattaattgatgaaggaaatctttga

SEQ ID NO: 1553 - DNA, 1131 bp, Streptococcus pneumoniae
atgttagatttgattcagactagacgagatttacaccagataccagagattggcttggaggagttcaagactcaggcttatttgctggatgtgattgagaaattgactacgggcaaggattttgttcaaattcgtacttggcggacagggattttggtctacctgcagggaagtcagccggagcgaaccattggttggcggacagatattgatggcctgcctatcgtcgaacaaacaggtctaccttttgcttctcaacaccaaggtcgcatgcatgcctgtggtcatgattttcatatgaccattgccttaggctgtcttgagcgcgcccttgaggagcaacccaagaataatctgctctttctatttcagcctgctgaagaaaatgaagctggtggtatgctcatgtatgaggacggtgcttttggagattggttgccaaaccaattctatggtctccatgttcgtccagatttgaaagtcggccagattgcgactaatactcatacactctttgcaggaacttgcgaggtgaagatccgtttcaaaggcaaaggtggccacgcagcttttcctcatgaagccaatgacgccttggtggcggctagttactttgtgacccaagtgcagtcagttgttagccgcaatgtcaacccaatcgagggagcagtggtgaccttcggcgtttttcaagctggaaccaccaacaatgtcatcacagacacagcttttttacatggaactattcgtgccttgacacaggacatgagtctcttggtgcaaaagagggtaaaaacagttgcagaaggggttgcagctgcctttgatatggaagtcgaagtggaactcaaacaaggtggatacctacctgttgagaacaatccagccttggcgcgtgaactgatggacttctttgacgagaaagacggaatcgagttgattgatatcgaacctgctatgacaggcgaggactttggttatctcctttcaaaggttgatggcgtgatgttttggctaggtatcgatagtccctacgctcttcatcaccctcaaatgagtcctaaggaagaagtcttagctattggggtggctgcggtgtctagtttcctgaaaaagaaggcagcagaatag

SEQ ID NO: 1554 - DNA, 699 bp, Streptococcus pneumoniae
atgactgctacaaaaatgaacgctcaagaaattatccaatttatcgccaatgctgaaaagaaaaccagtgtcaaagtaacctttgaggggcaactcgcaactgctgtgcctagctctgttgtcaaactaggaaatgtcctattcggagactggaaggacgtggctccgcttcttgaaggtttggtagaaaatcaagattatgttgtcgagcaagatgctcgtaattctgcagttcctttgctagataagcgtgctatcaacgctcgtatcgagccaggtgctattatccgtgaccaggtggaaattggtgacaatgctgttatcatgatgggagctgttatcaatatcggtgctgaaatcggtgctggaaccatgattgacatgggtgccatccttggtggccgtgccatcgttggaaaaaatagccacgttggtgcaggtgcagttttggcaggtgtgattgagccagctagtgctgaaccagtccgtgtcggagacaatgttcttatcggtgctaatgcagtggttatcgaaggagtccaaatcggtagtggttcagttgtcgcagcaggagctattgttacccaagatgtcccagaaaacgtggtagtagcaggtgttccagctcgtattatcaaagaaattgatgcccaaactcaacaaaaaacagcgctagaggatgcgcttcgtaccttgtaa

SEQ ID NO: 1555 - DNA, 459 bp, Streptococcus pneumoniae
gtttgggcatcaatttctttgataatacgagctggaacacctgctactaccacgttttctgggacatcttgggtaacaatagctcctgctgcgacaactgaaccactaccgatttggactccttcgataaccactgcattagcaccgataagaacattgtctccgacacggactggttcagcactagctggctcaatcacacctgccaaaactgcacctgcaccaacgtggctattttttccaacgatggcacggccaccaaggatggcacccatgtcaatcatggttccagcaccgatttcagcaccgatattgataacagctcccatcatgataacagcattgtcaccaatttccacctggtcacggataatagcacctggctcgatacgagcgttgatagcacgcttatctagcaaaggaactgcagaattacgagcatcttgctcgacaacataa

SEQ ID NO: 1556 - DNA, 216 bp, Streptococcus pneumoniae
atgattttggcaggtttgtttagcaatgtcctctcgccggtttatgagctttcctttactcttgatatttggagtatcttgatttgcctcattatcgctttctttggaacggcttttgcttttttcatttccatgaaggctgtgtccttggtttctcctttggtgggttttccgcttactcagtgcgcagtgaacctctctcttctgctctcttga

SEQ ID NO: 1557 - DNA, 834 bp, Streptococcus pneumoniae
ttgctattggtggaagtgatgcggattatcagaatgcttggtctagtattgtggggagtctaccaactccatccagctccagcagttcaagtagtagttctagcgatagcagtaactcaagtactacacgaccttcttcaagggcgagacgataattctctaaatgaagtggccaatcaatggattgccacttttttcctttcgtgttacaataagggtatgaatcagtatcagaaaaagattgttaacggaaaaatttattcgctcctatccggcttaatatggggaatctgtggaattttaggaaagtacttctttactcattatcaggtgtcttcgggctggattacctctatgcgtttgacactggcagggagtcttgtactcatttggtctgcaatacaattaaaatcgcaagtgctagatatttggcgagacaagaaaaattacctgccctttttagcctatgctattttggggattttttcagttcagtattttttctatctctgtgtagaatactcaaatgctacgacagcaactattttacagtttattagccctgtctttatcctcttttataatcgcttggtttatcaaaaacgagcgtcaaaaagcgctgttttctatgttttggttgccatgctgggtgtttgcttgatggcgacaaagggagatctctctcagttatccatgacgccgctagctcttataacaggtttgctgagtgccatgggtgttatgtttaatgttatcttgccccaaccttttgctaagcgttatggttttgttctaacgagtttgctgggggatgattttggcaggtttgtttag

SEQ ID NO: 1558 - DNA, 2463 bp, Streptococcus pneumoniae
atgcaaaatcaattaaatgaattaaaacgaaaaatgctggaatttttccagcaaaaacaaaaaaataaaaaatcagctagacctggcaagaaaggttcaagtaccaaaaaatctaaaaccttagataagtcagtcattttcccagctattttactgagtataaaagccttatttaacttactctttgtactcggttttctaggaggaatgttgggagctgggattgctttgggatacggagtggccttatttgacaaggttcgggtgcctcagacagaagaattggtgaatcaggtcaaggacatctcttctatttcagagattacctattcggacgggacggtgattgcttccatagagagtgatttgttgcgcacttctatctcatctgagcaaatttcggaaaatctgaagaaggctatcattgcgacagaagatgaacactttaaagaacataagggtgtagtacccaaggcggtgattcgtgcgaccttggggaaatttgtaggtttgggttcctctagtgggggttcaaccttgacccagcaactaattaaacagcaggtggttggggatgcgccgaccttggctcgtaaggcggcagagattgtggatgctcttgccttggaacgcgccatgaataaagatgagattttaacgacctatctcaatgtggctccctttggccgaaataataagggacagaatattgcaggggctcggcaagcagctgagggaattttcggtgtagatgccagtcagttgactgttcctcaagcagcatttttagcaggacttccacagagtcccattacttactctccttatgaaaatactggggagttgaagagtgatgaagacctagaaattggcttaagacgggctaaggcagttctttacagtatgtatcgtacaggtgcattaagcaaagacgagtattctcagtacaaggattatgaccttaaacaggactttttaccatcgggcacggttacaggaatttcacgagactatttatactttacaactttggcagaagctcaagaacgtatgtatgactatctagctcagagagacaatgtctccgctaaggagttgaaaaatgaggcaactcaaaagttttatcgagatttggcagccaaggaaattgaaaatggtggttataagattactactaccatagatcagaaaattcattctgccatgcaaagtgcggttgctgattatggctatcttttagacgatggaacaggtcgtgtagaagtagggaatgtcttgatggacaaccaaacaggtgctattctaggctttgtaggtggtcgtaattatcaagaaaatcaaaataatcatgcctttgataccaaacgttcgccagcttctactaccaagcccttgctggcctacggtattgctattgaccagggcttgatgggaagtgaaacgattctatctaactatccaacaaactttgctaatggcaatccgattatgtatgctaatagcaagggaacaggaatgatgaccttgggagaagctctgaactattcatggaatatccctgcttactggacctatcgtatgctccgtgaaaagggtgttgatgtcaagggttatatggaaaagatgggttacgagattcctgagtacggtattgagagcttgccaatgggtggtggtattgaagtcacagttgcccagcataccaatggctatcagaccttagctaataatggagtttatcatcagaagcatgtgatttcaaagattgaagcagcagatggtagagtggtgtatgagtatcaggataaaccggttcaagtctattcaaaagctactgcgacgattatgcagggattgctacgagaagttctatcctctcgtgtgacaacaaccttcaagtctaacctgacttctttaaatcctactctggctaatgcagattggattgggaagactggtacaaccaaccaagacgaaaatatgtggctcatgctttcgacacctagattaaccctaggtggctggattgggcatgatgataatcattcattgtcacgtagagcaggttattctaataactctaattacatggctcatctagtaaatgcgattcagcaagcttccccaagcatttgggggaacgagcgctttgctttagatcctagtgtagtgaaatcggaagtcttgaaatcaacaggtcaaaaaccagggaaggtttctgttgaaggaaaagaagtagaggtcacaggttcgactgttaccagctattgggctaataagtcaggagcgccagcgacaagttatcgctttgctattggtggaagtgatgcggattatcagaatgcttggtctagtattgtggggagtctaccaactccatccagctccagcagttcaagtagtagttctagcgatagcagtaactcaagtactacacgaccttcttcaagggcgagacgataa

SEQ ID NO: 1559 - DNA, 1257 bp, Streptococcus pneumoniae
atgcacatttttgatgagctaaaagatcgtggtttgatatttcaaacgactgatgaagaagctttgcgtaaagccctagaagaaggtcaagtttcttattatactggctacgatccaactgctgacagccttcacctaggccaccttgtcgcaatcttgacaagtcgtcgcttgcaactagcaggtcacaaaccttatgcgctcgttggcggtgctacaggtctcatcggagatccgtccttcaaagatgctgaacgtagtctccaaacaaaagacacagtagatggctgggtcaagtctatccaaggacaactttctcgttttcttgactttgaaaatggcgaaaacaaggctgtcatggtcaacaactacgactggtttggcagcatcagcttcattgacttcctccgtgatattggaaaatacttcacggtcaactacatgatgagtaaggaatctgttaaaaaacggatcgaaacaggaatttcttacactgagttcgcttaccaaatcatgcaagggtatgacttcttcgtccttaaccaagaccataatgtcactcttcaaatcggtggttctgaccagtggggaaatatgacagctggtaccgaattgcttcgtcgtaaggcggacaagactggtcacgttatcactgttccactaatcacagatgcaactggtaagaaatttggtaaatcagaaggaaatgccgtctggctcaatcccgaaaagacttctccatacgaaatgtaccaattctggatgaacgtgatggacgctgacgctgttcgcttcttgaaaatctttactttcttgtcacttgatgagattgaagatattcgtaaacaatttgaagcagcgccacacgaacgcttggctcaaaaagtcttggctcgtgaagttgttacacttgttcacggagaagaagcctacaaagaagcacttaacatcactgagcaactctttgcaggaaacatcaaaaacctttctgtcaaagagctcaaacaaggacttcgtggtgtgccaaactaccaagtacaggcagacgaaaacaacaatatcgtggaactgctcgtctcatctggtatagttaactcaaaacgccaagcccgtgaagacgtccaaaacggagccatctacgtaaacggcgaccgcatccaagagcttgactatgtcttgagtgacgctgataagttagagaatgaactgactgttatccgtcgtgggaagaaaaaatactttgtattgacttactaa

SEQ ID NO: 1560 - DNA, 2073 bp, Streptococcus pneumoniae
gtgaataatatgtcttttaaagtgctacatagaggataccaacatatccgactatcatcttctttttcacttaccttggatattcaagactatcttcgttccttggcgagagatgaaaaggggattgagtctatccagttttacatggatcaacagcactttactctacgcataaaagaaggcttttctgtattagataatgcagaagcctttttaaaaagaattgataaagggaaagtttctgagttgatgactcttcccattcgtagagaagagagtgcttattctattgtttcaggtgcagcggttaagcgtgtactttttcgtagttttgtgccgtatcctattcgctatatatggacttgttatcaggctttgggttatattagagaagcctatcaaacactagcgcgtaaggaactaacgatggaagtcttggactgttcggctattttattgtctttgtttatgaaccaatcaaagacagctagcaatatcatgtttatgcttgatttggggaatcatttagatcagtggtccttgaaaaaaactgcaacagatttagaacagagtcttcttgcaaaagagagcgatgtattcctagtacagggcgatacggttgttagtatcaagagttccgatgttcaaataggagatgtcttgatcttatctcaaggaaatgaaattctgtttgatggacaagtagtttcaggtttaggtatggtcaacgaaagttccttgacaggagagagttttccagttgaaaaaagagagtctgatttggtttgtgcaaatacagtattagaaactggagagttacgcattcgtgtaacagataatcagatgaacagccgtattttacagctgattgagttgatgaagaaatctgaagaaaacaagaaaacgaaacaacgctatttcatcaagatggcggataaagtcgtcaaatataatttcttgggggctgggctgacttacctattgacaggttctttttctaaggctatttctttcctattggtcgatttctcctgcgctttgaaaatctctactcctgtagcttatttgacagttatcaaggaagggttgaaccgtgaaatggtgattaaggatggagatgttctggagaaatatctggaagttgatactttcttgtttgataagacaggaacaatcacaactagttatcctatagttgaaaaggtgttaccttttggagactatagtgaggaagatattctcagaatcagtgcctgtcttgaggaacacatttatcatcctattgctaatgccatcgtcaagcaagctgagatagagggaattgaacatgaggaaatgcatgggaaactccaatatatcgcaagcaaggggatcaaatctcatatagatggccaaccagttcttattgggaattatgtcttgatgcaggatgagcagattcatatcagttcagaacaaaatgctttaattgaagagtacaagagtcactacaatctcttattcttggcttatcaaaatgaattgattggaatgttctgcattcatactcctttgagaaaagaagcaaaaacagccttggataaacttaaggcacaggggaaaaaattgattctggcaacaggagacaccttgattaggacagaggaattagtcaaagatttgccctttgatcaggtctatacagacttgaaacctgatgggaaatttgagttagtagagaaactgcagaaagcaggtcacactattttgatggttggagatggattgaatgactcagcggctttaactctatcagatatcggtgtggtgatgaatgagagtgcagatatttctaagcagatgagtgatatcttattgttagataatcgtttggatttcttccaagagttggattcgttatcatcatctttgcaaacactcatcaagaaaaatattcaggataccgttgtcgtaaatagtagtttgattggctttggcttatttaattggttcagtccttcaaatctctctatcttacataatctaacaaccttgcgcattgtcctgcgtagcctgtctattaaaaatagatag

SEQ ID NO: 1561 - DNA, 195 bp, Streptococcus pneumoniae
ttgaaaatcttagcaagtaaggaagctaaaaaaggttattctaaagctttggctaaggcttacaagttgaaagacgagctagatgcatctgtttctgttgtgaagcaacatggagacgatgtcttgcaagatgccaaatatttgtacgagcaagagaaaaaagaagagcaattagatagccttataggtgaataa

SEQ ID NO: 1562 - DNA, 264 bp, Streptococcus pneumoniae
atgaatacaaatctcaagcccaaacttcagcgttttgcttctgcgactgcctttgcctgtcctatctgtcaagaaaatctgactctgttagagactaatttcaagtgctgcaaccgtcattcttttgacttggcgaaatttggctatgtcaatctagcacctcaaatcaagcaatctgctaactatgacaaggaaaattttcaaaaccgtcaacaaatccgtagaagccggcttttaccaagctatcttagatgctgtatctga

SEQ ID NO: 1563 - DNA, 591 bp, Streptococcus pneumoniae
atgacaaggaaaattttcaaaaccgtcaacaaatccgtagaagccggcttttaccaagctatcttagatgctgtatctgacttgcttgcaagctcaaaaactaccataacaattttggatatcggttgtggtgaaggattctattctcgcaaactacaagaaagtcactctgaaaaaactttctatgcctttgacatctccaaagattcagtccaaatcgctgctaaaagtgaacccaactgggcagtcaattggttcgttggcgacttggcacgccttcctataaaagacgctagcatggatatcctgcttgatatcttctcacctgccaactatggagaatttcgtcgcgttttatccaaagatggtatcttgataaaggttatcccaactgaaaatcacctcaaagaaatccgtcaaagagtacaggaccagctgacaaacaaggagtattctaaccaagatatcaaggagcatttccaggaacactttaccatcctatctagtcaaactgcctctctgactaagactatcacagcagaacaactgcaagccctactcagtatgaactcctctcctcttgcacgttga

SEQ ID NO: 1564 - DNA, 171 bp, Streptococcus pneumoniae
ttgtctctattatttattattttaaatttatttattttgtataagatctattctttgaggcgggaaaaatcgaaatacttgatttatacggcctatatcatatttggggtaaatgtagtatatggtattcaatggttattaaaagaactgatttcaactatttccccttaa

SEQ ID NO: 1565 - DNA, 573 bp, Streptococcus pneumoniae
atgaacaaattaatgaaatttatttcggtttttttgacgtcaattgtgttaattgtatcagcgattccaagtgtttcagctgtatacgcttctgaacaagtatcacaaattgaaacaaatatggaacttcaacctgtcacttctctaacagaagaacaaatcaatacacttgcaaacgaaatccaatcttttcatccagacgtctcacaacaatggatcaaagaagtaattaaccgacaattacaaggcgattatacaatcccacctacatactctccatttagagcagcttggcaaggtattacagttaatcaaatgggtgctctattagatactgcaatagctttagcattaggaggaactactgcaggccttgcaaatctaattaaagtaaaaggaaaacatgcagcaaaaagtgctattcgttcagcaatttctagatatctaggtagttggtttgtaaatgatgttgctttagaattcgctatgaatttattatcaccggggacttatttagcacaattatgggataaaaatgatgccattcctaacaacagaaggattaacttttaa

SEQ ID NO: 1566 - DNA, 2259 bp, Streptococcus pneumoniae
atgttatcactacaagaatttgtacaaaatcgttacaataaaaccattgcagaatgtagcaatgaagagctttaccttgctcttcttaactacagcaagcttgcaagcagccaaaaaccagtcaacactggtaagaaaaaagtttactacatctcagctgagttcttgattggtaaactcttgtcaaacaacttgattaaccttggtctttacgacgatgttaaaaaagaacttgcagctgcaggtaaagacttgatcgaagttgaagaagttgaattggaaccatctcttggtaatggtggtttgggacgtttggctgcctgctttatcgactcaattgctactcttggtttgaatggtgacggtgttggtcttaactaccactttggtcttttccaacaagttcttaaaaacaaccaacaagaaacaattccaaatgcatggttgacagagcaaaactggttggttcgctcaagccgtagctaccaagtaccatttgcagactttactttgacatcaactctttacgatattgatgttactggttatgaaacagcgactaaaaaccgcttgcgtttgtttgacttggattcagttgattcttctattattaaagatggtatcaactttgacaagacagatatcgctcgcaacttaactctcttcctttacccagatgatagtgaccgtcaaggtgaattgctccgtatcttccaacaatacttcatggtttcaaacggtgcgcaattgatcatcgacgaagcaatcgaaaaaggaagcaacttgcatgaccttgctgactacgcagttgtccaaatcaacgatactcacccatcaatggtgattcctgaattgattcgtcttttgactgcacgtggtatcgatcttgacgaagcaatctcaattgttcgtagcatgactgcctacactaaccacacaatccttgctgaagcgcttgaaaaatggcctcttgaattcttgcaagaagtggttcctcacttggtaccaatcatcgaagaattggaccgtcgtgtgaaggcagagtacaaagatccagctgttcaaatcatcgatgagagcggacgtgttcacatggctcacatggatatccactacggatacagtgttaacggggttgcagcactccatactgaaatcttgaaaaattctgagttgaaagccttctacgacctttacccagaaaagttcaacaacaaaacaaacggtatcactttccgtcgttggcttatgcatgctaacccaagattgtctcactacttggatgagattcttggagatggttggcaccatgaagcagatgagcttgaaaaactgttgtcttatgaagacaaagcagctgtcaaagaaaaattggaaagcatcaaggctcacaacaaacgtaaattggctcgtcacttgaaagaacaccaaggtgtggaaatcaatccaaattctatctttgatatccaaatcaaacgtcttcacgagtacaaacgccaacaaatgaacgctttgtacgtgatccacaaataccttgacatcaaagctggtaacatccctgctcgtccaatcacaatcttctttggtggtaaagcagctccagcctacacaatcgctcaagatatcattcacttgatcctttgcatgtcagaagttattgctaacgatccagcagtagctccacacttgcaagtagttatggttgaaaactacaacgttactgcagcaagcttccttatcccagcatgtgatatctcagaacaaatctcacttgcttctaaagaagcttcaggtactggtaacatgaaattcatgttgaacggagctttgacacttggtactatggacggagctaacgtggaaatcgctgagttggttggtgacgaaaacatctacatctttggtgaagattcagaaactgttatcgacctttacgcaaaagcagcatataaatcaagcgaattctacgctcgtgaagctatcaaaccattggttgacttcattgttagcgatgcagttcttgcagctggaaacaaagagcgcttggaacgtctttacaatgaattgatcaacaaagactggttcatgactcttcttgacttggaagactacatcaaagtcaaagagcaaatgcttgctgactacgaagaccgtgacgcatggttggataaagtcatcgttaacatttctaaagcaggattcttctcatctgaccgtacaatcgctcagtataacgaagacatctggcacttgaactaa

SEQ ID NO: 1567 - DNA, 1518 bp, Streptococcus pneumoniae
atgaaaaaacgtcaaagtggtgtgttgatgcacatctcttctcttccaggagcttacggaatcggatcatttggtcaaagtgcttacgacttcgttgatttcttggtccgtacaaaacaacgttactggcaaatccttccattaggagcaactagttacggggattctccttaccaatctttctcagccttcgcaggaaacactcattttatcgatttagatatcttggtggagcaaggtttgttggaagcaagtgaccttgaaggagttgactttggtagcgatgcgtctgaagttgactatgctaaaatctactatgcacgtcgtcctcttttagaaaaagcggtgaaacgtttctttgaagtcggagatgttaaagattttgagaaatttgctcaagacaaccaatcatggcttgagctctttgctgagtatatggctatcaaagagcattttgacaatcttgcttggactgaatggccagatgcagatgctcgtgctcgtaaagcttcagcacttgaaagctatcgtgagcaattggcagacaagttggtttaccaccgtgtgactcaatacttcttcttccaacaatggttgaaattgaaagcttacgctaacgacaaccacatcgaaatcgttggggacatgccaatctacgtagcggaagattcaagtgatatgtgggcaaatccacatctcttcaaaacagatgtcaatggtaaggctacttgtatcgcaggatgcccaccagatgagttttctgtaactggtcagctttggggtaatccaatctatgactgggaagcaatggacaaagacggctacaaatggtggattgaacgcttgcgtgaaagcttcaaaatctacgatatcgttcgtatcgaccacttccgtggcttcgaatcttactgggaaatccctgctggttccgatacagcagcacctggtgagtgggtgaaaggtccaggctacaagctttttgcagccgttaaggaagaacttggtgagctaaacatcatcgcagaagaccttggcttcatgacagatgaagtgatcgaattgcgtgaacgtactggcttcccaggaatgaagattcttcaatttgccttcaacccagaagacgaaagcattgatagcccacacttggcacctgctaactcagttatgtacacaggaacacacgataacaatacggttcttggttggtaccgtaatgagattgatgatgcgactcgtgagtacatggctcgttacacgaaccgtaaagaatacgaaacagtggtacacgctatgcttcgtacagtattttcatcagttagctttatggcaattgcaactatgcaagatttactagaattggatgaggcagctcgtatgaacttcccatctacccttggtggaaactggtcttggcgtatgactgaagatcaattgacaccagctgtcgaggaaggtttgcttgacttgacaacaatttatcgccgaattaatgaaaatttggtagatttaaagaaataa

SEQ ID NO: 1568 - DNA, 1272 bp, Streptococcus pneumoniae
atgtcatctaaatttatgaagagcactgcggtgcttggaactgttacacttgctagcttgcttttggtagcttgcggaagcaaaactgctgataagcctgctgattctggttcatctgaagtcaaagaactcactgtatatgtagacgagggatataagagctatattgaagaggttgctaaagcttatgaaaaagaagctggagtaaaagtcactcttaaaactggtgatgctctaggaggtcttgataaactttctcttgacaaccaatctggtaatgtccctgatgttatgatggctccatacgaccgtgtaggtagccttggttctgacggacaactttcagaagtgaaattgagcgatggtgctaaaacagacgacacaactaaatctcttgtaacagctgctaatggtaaagtttacggtgctcctgccgttatcgagtcacttgttatgtactacaacaaagacttggtgaaagatgctccaaaaacatttgctgacttggaaaaccttgctaaagatagcaaatacgcattcgctggtgaagatggtaaaactactgccttcctagctgactggacaaacttctactatacatatggacttcttgccggtaacggtgcttacgtctttggccaaaacggtaaagacgctaaagacatcggtcttgcaaacgacggttctatcgtaggtatcaactacgctaaatcttggtacgaaaaatggcctaaaggtatgcaagatacagaaggtgctggaaacttaatccaaactcaattccaagaaggtaaaacagctgctatcatcgacggaccttggaaagctcaagcctttaaagatgctaaagtaaactacggagttgcaactatcccaactcttccaaatggaaaagaatatgctgcattcggtggtggtaaagcttgggtcattcctcaagccgttaagaaccttgaagcttctcaaaaatttgtagacttccttgttgcaactgaacaacaaaaagtattatatgataagactaacgaaatcccagctaatactgaggctcgttcatacgctgaaggtaaaaacgatgagttgacaacagctgttatcaaacagttcaagaacactcaaccactgccaaacatctctcaaatgtctgcagtttgggatccagcgaaaaatatgctctttgatgctgtaagtggtcaaaaagatgctaaaacagctgctaacgatgctgtaacattgatcaaagaaacaatcaaacaaaaatttggtgaataa

SEQ ID NO: 1569 - DNA, 1293 bp, Streptococcus pneumoniae
atggaaaagcaacaacctagtaaagcagccctgctgtctatcattcctgggttaggacagatttacaataaacaaaaagccaaaggttttatcttccttggtgtaaccatcgtatttgtcctttacttcctagcacttgcaacccctgaattgagcaacctcatcactcttggtgacaaaccaggtcgtgataattccctctttatgctgattcgtggtgccttccatctaatctttgtaatcgtttatgtactcttttatttctcaaatatcaaagatgcacatacgattgcaaaacgcattaacaatggaattccagttccacgcacactcaaagacatgatcaaagggatttatgaaaatggcttcccttacctcttgatcattccatcttatgttgccatgaccttcgcgattatcttcccagttatcgtaaccttgatgatcgcctttaccaactacgacttccaacacttgccaccaaacaagttgttggactgggttggtttgaccaactttacaaacatttggagcttgagtaccttccgttctgcctttggttctgttctttcttggactatcatttgggctttggcagcttctactttacaaatcgtaattggtatcttcacagctatcattgctaaccaaccatttatcaaaggaaaacgtatctttggtgttattttccttcttccttgggctgtcccagccttcatcactatcttgacattctcaaacatgtttaacgatagtgtcggtgctatcaacactcaagtattgccaatcttggctaaattccttcctttccttgatggagctcttattccttggaaaacagacccaacttggactaagattgccttgattatgatgcaaggttggctcggattcccatacatctacgttctgaccttgggtatcttgcaatctattcctaacgacctttacgaagcagcttatattgacggtgccaacgcttggcaaaaattccgcaacatcactttcccaatgattttggctgttgcggcacctactttgattagccaatacaccttcaactttaacaacttctctatcatgtacctcttcaatggtggaggacctggtagtgtcggaggtggagctggttcaaccgatatcttgatctcatggatctaccgtttgacaacaggtacatctcctcaatactcaatggcggcagctgttaccttgattatctctatcattgtcatctcaatctctatggttgcattcaagaaactacacgcatttgatatggaggacgtctaa

SEQ ID NO: 1570 - DNA, 843 bp, Streptococcus pneumoniae
atgaataactcaattaaactcaaacgtagactgactcaaagccttacttacctttacctgattggtctatcaattgtaattatctatccactgttgattaccattatgtcagcctttaaagcaggtaacgtctcagcctttaaactagatactaatatcgacctcaattttgataattttaaaggcctcttcactgaaaccttgtacggtacttggtacctcaacactttgattatcgccttaattaccatggctgttcaaacaagtatcatcgtacttgctggttatgcttacagccgttacaacttcttggctcgtaaacaaagtttggtcttcttcttgatcatccaaatggtgccaactatggccgctttgacagccttcttcgttatggcgcttatgttgaacgcccttaaccacaactggttcctcatcttcctctacgttggtggtggtatcccgatgaatgcttggctcatgaaaggctacttcgatacagtgccaatgtctttagacgaatctgcaaaactagacggtgcaggacacttccgccgcttctggcaaattgttcttccacttgttcgcccaatggttgccgtacaagctctctgggccttcatgggacctttcggggactatatcctctctagtttcttgcttcgtgagaaagaatactttactgttgccgtaggtctccaaaccttcgttaacaatgcgaaaaacttgaagattgcctacttctcagcaggtgctatcctcatcgcccttccactctgtattctcttcttcttcctacaaaagaactttgtttcaggacttacaagtggtggcgacaagggataa

SEQ ID NO: 1571 - DNA, 801 bp, Streptococcus pneumoniae
atgcttccatatccattttcctttttttcaagtatttgggggtttcgtaagcccctgtccaaacgtttcgagctcaactggtttcaacttctctttaccagtatcttccttatcagcttgtctatggtacccattgctatccaaaacagctcccaggagacctatccgctagaaacttttatcgataatgtctatgaacctctgacagataaggttgtccaggatctctctgaacatgctacaattgtcgatggcacattaacttatactggaacagttagtcaagcctcttctattgtgattggtccaagtcaaatcaaggaattacctaaggacttgcaactgcatttcgatacaaatgagctagtcatcagcaaggaaagcaaggaactgacccgcatctcttaccgagccattcagactgagagtttcaaaagcaaagacagcttgacccaagcaatttctaaagactggtaccaacaaaatcgtgtctatatcagcctcttcctagttctcggtgcgagcttcctctttggtttgaatttctttatcgtctctctaggagctagtcttctcctttatatcactaagaaatcacgcctcttttcatttagaacctttaaagagtgctatcactttatcttgaactgtttaggattgccgactctaattacacttattttgggattatttggccaaaatatgacaaccttgattactgtacaaaatattctttttgttctgtatctggtcactatcttttataaaacacatttccgtgatccaaattaccataaatag

SEQ ID NO: 1572 - DNA, 987 bp, Streptococcus pneumoniae
atgcccgttacgattaaagacgtggccaaggctgctggtgtttcgccttcaaccgtaacccgtgttattcaaaataaatcaaccattagcgacgaaacaaaaaaacgcgttcgcaaggctatgaaggaactcaactaccacccaaacctcaacgctcgtagcttggtaagcagctatactcaggttatcggattggttcttcctgatgactcagacgccttctaccagaatcctttctttccatcggttctacgtggcatctctcaagtcgcatctgaaaaccactatgccattcagatagcaacagggaaagatgagaaggagcgtctcaacgctatttcacaaatggtctacggcaagcgtgtagatgggctaatctttctctatgcccaagaagaagaccctctcgtaaaactcgtcgcagaagaacagttccccttccttatcttaggtaaatctctatctcctttcatcccacttgtcgacaacgacaatgttcaagctggttttgatgcgactgaatatttcatcaaaaaaggctgcaaacgcattgcctttatcggaggaagtaaaaagctcttcgtgaccaaagaccgtttaacaggctatgaacaggcgcttaaacattacaaacttaccactgacaacaatcgcatctactttgccgacgagtttctggaagaaaagggctataaatttagcaagcgattattcaagcacgatccacaaattgacgctatcatcacaaccgatagcctcctagctgaaggtgtttgtaactatattgccaaacaccagctggatgtccctgttctcagctttgactcggttaatcccaagctcaacttggcagcctatgtcgatatcaatagtttagagcttggtcgtgtttcccttgaaactattctccagattattaatgataataaaaacaataaacaaatttgttaccgtcaattgatcgcccacaaaattatcgaaaaataa

SEQ ID NO: 1573 - DNA, 342 bp, Streptococcus pneumoniae
ttgaaaaaacttgatactatgcgttttattgtgggaagatttacttccttttctactgaaattgagtcttttcccaagatctttttatactcaatgaaaatcaaagtgcaaactaggaagctagccgcaggttgctcaaaacactgttttgaggttgtggatagaactgacgaagtcagctcaaaacatggttttgaggttgtagatgaaactgacgaagtcagctcaaaacatggttttgaggttgcagatgaaactgacgaagtcagctcaaaacatggttttgaggttgcagatagaactgacgaagtcagtaacatatatacggtaaggcgacgctga

SEQ ID NO: 1574 - DNA, 381 bp, Streptococcus pneumoniae
ttaatagtcttcgaaaatctcttcaaaccacgtcagcgtcgccttaccgtatatatgttactgacttcgtcagttctatctgcaacctcaaaaccatgttttgagctgacttcgtcagtttcatctgcaacctcaaaaccatgttttgagctgacttcgtcagtttcatctacaacctcaaaaccatgttttgagctgacttcgtcagttctatccacaacctcaaaacagtgttttgagcaacctgcggctagcttcctagtttgcactttgattttcattgagtataaaaagatcttgggaaaagactcaatttcagtagaaaaggaagtaaatcttcccacaataaaacgcatagtatcaagttttttcaatacctga

SEQ ID NO: 1575 - DNA, 942 bp, Streptococcus pneumoniae
atgaaacaaacaaaacgaattaagcggtggcgctattatctgcgccgctttgcttatcagataaaaattttacgtgtcttacaaagtatctctcgagaaaagtatgatgagaagatttcggcctctctggtctatggttttttatcagcagtagcagttaatttctttttccaaccagggcatgtgtattcgagtggtgcaacaggtctggcacagattatctctgccttgagtaatcactggtttggttttcatattccgatttcgctaaccttctacgccattaacttccctttgatggtcttagcttggtatcagattggccataagttcaccgtctttacctttatcacggtatctatgagttccttctttatccagtttgtccctgtggcaaccttgacggaggatcccattatcaatgccctttttggtggtgttgttatgggtttggggattggttttgctcttcgaaacaatatctccagtggtgggacggatatcgtcagcctgactattcgcaagaaaacgggtaagaatgtcggtagtatttctttcttggtaaatggaactatcatgctgatagcaggtttgacctttggttggaaatacgctctttattctatgattaccatctttgtctctagccgtgtgacagacgcagtctttactaagcaaaagcgtatgcaggccatgattgtgacaaatcatccagagaaggtaattgaaaaaatccataaaaaattgcaccgcggagcaaccatgatccacgatgcagaaggaacctataatcacgagagaaaggcagttttaatcactgtcattacacgtgcagagtttaatgaatttaaacagattatgacacaagtggatccaagctcctttgtctctgtctcggaaaatgttcatattctaggaagatttgtggagatagataattag

SEQ ID NO: 1576 - DNA, 1764 bp, Streptococcus pneumoniae
atgaaacgtagtatgtatgctggtcgtgttcgtgaggaacacatcggacaagaaataaccttgaaaggatgggttggccgtcgtcgtgaccttggtggtttgatctttatcgatcttcgtgaccgtgaaggaatcatgcagttggttatcaaccctgaaaaagtatctgcagaggttatggcaacagctgaaagccttcgtagcgaatttgttattgaggtgactggtcaggtcgctgcgcgtgagcaagccaatgataagttgccaactggtgcggttgagttaaacgtgacagctcttattgtgcttaatacagctaagacaacaccatttgagattaaggatggcattgaggcaaatgacgatacacgtttgcgttaccgttaccttgaccttcgtcgtccagaaatgttggaaaatcttaaacttcgtgccaaggtgacccactctatccgcaactacttggatgagttggagtttatcgacgtggagacaccattcctttctaagtcaacgcctgaaggggcgcgtgattatttagtgccgtctcgtgttaataaggggcatttttacgctcttcctcaaagtccacaaatcacgaaacagctcttgatgaatgctggttttgaccgttactaccaaatcgttaaatgtttccgtgacgaggacttgcgtggagaccgccagcctgaatttactcaggtcgacttggaaacgtccttccttactgagcaagaaatccaagatattacagaaggcttgatcgcgcgcgtgatgaaggaaacaaaaggcatcgaagtaacgctaccattccctcgtatgaaatacgatgatgctatggctctttacggttctgacaagccagatactcgttttgacatgttgcttcaggacttgacagaagtggtcaaaggtgtagactttaaagtcttttcagaagcacctgctgtaaaagcgattgtggtcaaagaagctgcggacaactattcacgtaaagacatcgacaagatgacggaagtagccaaacagtatggtgccaaaggtcttgcttgggtcaaggtggttgatggagaattaaacggaccagttgccaagttcttgactggtatccaagaagaattgacaacagcgcttgctcttgaagataaggacttggttctctttgtggcggatacgcttgaagtggctaatgcaacactgggtgcccttcgtggacgtattgctaaagagcttggcttgattgataatgataagttcaacttcctttgggtggttgactggccgatgtttgaatggtctgaagaagaaggccgctacatgagcgcccaccatcctttcacccttccacaggaagagactgttcacgaattagaaggtgatttggctaaggttcgtgccattgcttacgatatcgtcttgaacggttatgagcttggtggtggtagccttcgtatcaaccaaaaagaccttcaagaacgcatgttcaaggctcttggtttctcaactgaagaagccaatgaccagtttggtttccttcttgaagccatggactatggtttcccaccacacggtggtttggctatcgggcttgaccgttttgtcatgttgcttgctggagaagaaaatatccgtgaagtcattgcctttcctaagaacaacaaggcaactgacccaatgacacaagctccatcaacagtcgctctcaaacaactagaggaactcagcttacaagtagaagaagatgaaacaaacaaaacgaattaa

SEQ ID NO: 1577 - DNA, 432 bp, Streptococcus pneumoniae
ttgctcacgcgcagcgacctgaccagtcacctcaataacaaattcgctacgaaggctttcagctgttgccataacctctgcagatactttttcagggttgataaccaactgcatgattccttcacggtcacgaagatcgataaagatcaaaccaccaaggtcacgacgacggccaacccatcctttcaaggttatttcttgtccgatgtgttcctcacgaacacgaccagcatacatactacgtttcattatttctctcctcttttattctgttactattttaccataaaagcgcaggctcttcatgaaaatcatcagaaaagtttgccagtctttaaaagtcaggtgaaagccctaaaaattagcgctaatactcttcgaaaatctcttcaaaccacgtcagcgtcgccttaccgtaggtattgttactga

SEQ ID NO: 1578 - DNA, 192 bp, Streptococcus pneumoniae
atgaaaatcaaagtgcaaactaggaagctagccgcaggttgctcaaaacactgttttgaggttgtggatagaactgacgaagtcagctcaaaacatggttttgaggttgtagatgaaactgacgaagtcagtaacaatacctacggtaaggcgacgctgacgtggtttgaagagattttcgaagagtattag

SEQ ID NO: 1579 - DNA, 231 bp, Streptococcus pneumoniae
atgaaacgagtaattttattagcagtgattcaggcagtcgttctatttttcatcattggagcgctagcttatgccttcaaaggcgatttcttctataactatctagcagttgtctttgctcctattgcaggtgtactgcgttttgggacggcttacataacggaaattgtcttgcctcgaaaggcagccgaaatcgctgaaaagcgtaaagcaggcaaaaattcaaaataa

SEQ ID NO: 1580 - DNA, 642 bp, Streptococcus pneumoniae
atgaaactacttaaaaaccttggctggtttcttctagcccttctatcctttttctttatctatggctttattcaggggctcgcgactgcgtcgcttgctttaggcgcttcaccctatgctgttactctactctatgtggtcttggctggagtatatgtgtacggcatttacaaatggtatcagaaagctcctgttcatattgagaagagcggctttaaccgatttatttggcttcctgccttggtttggttcttatctctggtcgttcaattcttcttgccagatgatccttcagtaaatcaacaaatagcgacagacttgaccttgtctcaaccacttttctcattctttgctgtggttatttttgctcctttgacggaagagattgtttttagagggatgttagcacgctatctctttcctaagcaggacaatagtaaacgaaccctgatttttcttctggtatctagtcttctatttgccttgattcattttccaggtgatgtgcaacaattttttgtctattttagccttggttttagtttgggtttggcttacattagcagaaaaggtctggtctacagtatttctcttcacgctttgaataatttagtcggctttttgatgattctcatgctataa

SEQ ID NO: 1581 - DNA, 741 bp, Streptococcus pneumoniae
atgaatatgaaaaagaaacgtagattgttatttttgatgtctattgtcttgggggggttcttgggcatgtttgtagggatgtttaaggcacgtgtcgaatcccacgaaattattttagatgtaaaagccttgatgccatggatatcagctatttgtttactgataggtttcattagtatgtttttgactttcaatttcttaaagaaaagcagaaaatttcattccttgtatcaagaggaaatggatgacgatctgaatgaaacctattatgtgcaaatgtatcggaatcttgagtttggaaccattgcttttaatattacaggtgtagcgattccattggctatttttatttcattaagtgaggtgattatattgcatacaaaccctcaaacatttttcctttctttcttactctttgtggtattcttagtcgctcaaaaatctctttttaaaaccattgcgattgttcgtcagtttgatttggaatttttcgctacaccaaaggatgtcttgaactatataaattcttatgatgaaggggagcgtcaggctaatttggaacagagttttcgaattttattccaattacaccaatatgtcttaccagccttatatatttttcttattatcatttctttcttgacaggagagattcagttactagctttcttgcttgtaggagccatccatgtttatatcaatgtgatgcagttacctatggtaaaacgttatttcaaataa

SEQ ID NO: 1582 - DNA, 201 bp, Streptococcus pneumoniae
gtgatgaacaagtataaagtgatttattatgtagtggtcatagctttattagtcagcgtatttctactgattgggatggacctaagctggtttaatccctatcaaagcgaccaatttgtttgggtctactttgctctcatcccagtaattgaatggattgaaaagaaatccaaaaatctagcaagtgaaaaaggagaatga

SEQ ID NO: 1583 - DNA, 465 bp, Streptococcus pneumoniae
atgatagataaagtggtcaggaacttactcctgacctttttcttttgcaaaatgacaaaaatcataaactttttgacaactatacttgtcaaaaagaaaaagatgtgttacaatgtaagcaagttaagagaaaagaagaaaggagctatgatgtgggtactagggtttatactatttctgattttcttttattctaatgattctaaaaaaatcaagaaactagagaagaaaatcaaaagacttgagcgaaaagagaaaggaaatgcagaaatgtcgagattattacaagaaatgattggaaaggaaccaattataacgggagtgtatattgggccagataactgggaagttgtggatgttgatgaggaatgggtaaagctacgacgtgtagataatacgggaaaagaaaaattcaagttgcaacgtattgaggatatccaaaccgttgaatttgacggagagtag

SEQ ID NO: 1584 - DNA, 186 bp, Streptococcus pneumoniae
agtggtcaggaacttactcctgacctttttcttttgcaaaatgacaaaaatcataaactttttgacaactatacttgtcaaaaagaaaaagatgtgttacaatgtaagcaagttaagagaaaagaagaaaggagctatgatgtgggtactagggtttatactatttctgattttcttttattctaa

SEQ ID NO: 1585 - DNA, 192 bp, Streptococcus pneumoniae
atgaaaatcaaagagcaaactaggaagctagccgcaggttgctcaaaacactgttttgaggttgtggatagaactgacgaagtcagctcaaaacatggttttgaggttgtagatgaaactgacgaagtcagtaaccatacctatggcaaggtgaagctgacgtggtttgaagatattttagaagagtattaa

SEQ ID NO: 1586 - DNA, 189 bp, Streptococcus pneumoniae
gtatggttactgacttcgtcagtttcatctacaacctcaaaaccatgttttgagctgacttcgtcagttctatccacaacctcaaaacagtgttttgagcaacctgcggctagcttcctagtttgctctttgattttcattgagtataaaatcctagtttttcaaagatttctgagaagttttggctga

SEQ ID NO: 1587 - DNA, 1290 bp, Streptococcus pneumoniae
atgaaattacaaaaaccaaaaggaacgcaggatattttacctgctgaatctgctaagtggcagtatgttgagggctttgcccgtgagattttcaagcgctataactatgcagaagtgcgcacgcctatttttgagcattacgaggttatcagtcgctctgtcggagatacaacggatatcgtaaccaaggaaatgtacgatttttatgacaagggtgaccgtcatattaccctccgtccagaaggaactgcgcccgttgtccgttcctatgtggaaaataaactcttcgccccagaagtgcaaaagccaagcaagttctactatatgggacctatgttccgttatgagcgtccacaggcagggcgcttgcgccaattccaccagattggtgttgagtgttttggctctagcaatccagctaccgatgtggaaacaatctctatggcagcctattttttgaaggaaatcggtattcaaggtgtcaaattgcacctcaacactcttggaaatcctgagagccgtgcagcctaccgccaagccttgattgactatttgacaccgctcaaggagaccttgtctaaggatagccaacgtcgcttggaggaaaatcctcttcgtgtcttggactctaaggaaaaagaagacaaggtggcagtagagaatgcgccgtctatcttggactttcttgatgaagaaagccaaactcattttgatgctgtgcgtcagatgttggaaaatcttggagtagattacatcatcgataccaatatggtgcgtggtctggactactacaaccacaccattttcgagtttatcacagagattgagggcaatgacttgacagtctgtgcgggtggtcgctacgatggtttggttgcttactttggaggccctgaaactgctggatttggttttgggcttggtgtagagcgcctgcttctcatccttgaaaaacaaggcgtggccctccctatcgaaaacgccctagatgtctatatcgcagtcttgggtgatggagcaaatgtcaaagccctagaactagtccaagctcttcgccaacaaggtttcaaagcagagcgtgattacctcaaccgtaagctcaaagctcagttcaagtcagcagatgtctttgcggctaagaccctcatcaccctaggagagagcgaagtcgaaagcggacaagtgacggtcaagaacaaccaaacccgagaagaagtgcaagtgtcacttgagacaatcagccaaaacttctcagaaatctttgaaaaactaggattttatactcaatga

SEQ ID NO: 1588 - DNA, 921 bp, Streptococcus pneumoniae
ttgtttttcaaggatgagaagcaggcgctctacaccaagcccaaaaccaaatccagcagtttcagggcctccaaagtaagcaaccaaaccatcgtagcgaccacccgcacagactgtcaagtcattgccctcaatctctgtgataaactcgaaaatggtgtggttgtagtagtccagaccacgcaccatattggtatcgatgatgtaatctactccaagattttccaacatctgacgcacagcatcaaaatgagtttggctttcttcatcaagaaagtccaagatagacggcgcattctctactgccaccttgtcttctttttccttagagtccaagacacgaagaggattttcctccaagcgacgttggctatccttagacaaggtctccttgagcggtgtcaaatagtcaatcaaggcttggcggtaggctgcacggctctcaggatttccaagagtgttgaggtgcaatttgacaccttgaataccgatttccttcaaaaaataggctgccatagagattgtttccacatcggtagctggattgctagagccaaaacactcaacaccaatctggtggaattggcgcaagcgccctgcctgtggacgctcataacggaacataggtcccatatagtagaacttgcttggcttttgcacttctggggcgaagagtttattttccacataggaacggacaacgggcgcagttccttctggacggagggtaatatgacggtcacccttgtcataaaaatcgtacatttccttggttacgatatccgttgtatctccgacagagcgactgataacctcgtaatgctcaaaaataggcgtgcgcacttctgcatagttatagcgcttgaaaatctcacgggcaaagccctcaacatactgccacttagcagattcagcaggtaa

SEQ ID NO: 1589 - DNA, 1248 bp, Streptococcus pneumoniae
atgaaactattgtttagaaatccagcttatagaattttgactttgtcacgcttcttcaatgcttttggtgcttcgattttcaatctggtctttatcgtctatgcatcgaccttgtcacaagcatcttttgctgttgctatggcgaatattgtcatgcttcttccgactctctttacagtttttgcagggattcgggcagattacacgagggccaaggtcaaatggatggtctatagcggtttgtttcaggcggttttattttttctggcagccctagttgttcagcaagctagtttatttgccttttctagcctgtgtttgatcaatgtcattagtgatatcatcagtgattttgcaggtggcctgcgtatgcctcttattaaggaaaaagtagctgaagatgatttgatggaggcttattctttttcacagttcatcacctatatttcagctattggtggtcaagctttcggagtctggctcttagctctatcggtcaacaatttttctctcgttgcgggaatcaatgcctgctttttcctagtatcagccactatcctctttttaggaaaaagcaaattgagcctgtcaatgtcatctgctgatggtgaaaaactaaaaaatgagaagctttctatcaaagaccagttcctaacaatttatcgaaatttacgtctcgtttttcttaaaagtggacagaaaaactttggttttatgctctgtgctgtcttgcttgtcaatgccttgggtggcgctttgggtggaatttataatatcttctttttgagccattctctcttgaatttttcttacacagaggcactatttatcaatcaagtctgtgttttgttagcaatcatcattagtagccttacgggcaatgattattttgggaagcagtccttgcctagattgatgatgtgggagaccgtaggacttagtctagttggtttggctaatttattcaatcaagtcgtgcttggtttgctatttctcttctttactctgtatgtgtctggtaaagttcaaccaaagattagtgccatgctcatgaaaaatctagctccagaggttctagctcgtactagtaattttttaggtctattgtttaccttatccatacctgtgggaacagcttgtttttcactagtagccgtatggaatatacagttgacttggatgctatttgttggtctttccttgctagctatttttttgacaattcttaatctcaaaaatgatatctaa

SEQ ID NO: 1590 - DNA, 399 bp, Streptococcus pneumoniae
ttgagtgtgaagaatttaccaatgcctattattttaaacgtgttatcgaagagcatttctacaaggaaaatgagacctatttccgaattgtttatctgtgggcagaaggtctccttgatagcaagcaaggtagagtcaaggaaggccagaaaaagatggaggatgctgtccgtatttttgagatgcttggctgtaataaatctgccgaatactatagaaatacgaccgaatgttgaatatctgcaaaccaagaaaaaatttgaagcgatagaactattgccctctctcaggtcattacaaaagttctatcgtttttttgctcattttatttgttgcatatattcaaaagaatcgtttcgcaaattcataagtgctatactaaagctattcttgatgtag

SEQ ID NO: 1591 - DNA, 852 bp, Streptococcus pneumoniae
atggagcagattggaaaagtctttagacaattacgagaatcaagaaatatctcactgagacaagcaaccggaggacaattttcgccgtctatgttgtcccgttttgaaacaggtcagagtgagctttcggtggaaaagtttctatttgctctggaaaatatatctgccagtgtggaggagatcctctttctggcgagaggtttccagtatgatacagattctgagttgagaaaagaaattacagatgtcttggaaccaaagaatatagcacctcttgaggacttatatcgcagggagtatcaaaagcatgcccattctcacaacaaacagaaacatattctaaatgccattattatcaagtcttatatgaagagcatagatgaaagggtagagttaacagcagaggaaggaaaagtccttcatgattatttgttttctaccgagatctggggaatctatgaactcaatttattttcagtcagttctccatttttatctgtttctctttttactagatatgtacgagaaatggtacgtaaatctgattttctaatggaaatgtctggcaatcgaaacctttttcatactatactattgaatggctttttagctagtattgagtgtgaagaatttaccaatgcctattattttaaacgtgttatcgaagagcatttctacaaggaaaatgagacctatttccgaattgtttatctgtgggcagaaggtctccttgatagcaagcaaggtagagtcaaggaaggccagaaaaagatggaggatgctgtccgtatttttgagatgcttggctgtaataaatctgccgaatactatagaaatacgaccgaatgttga

SEQ ID NO: 1592 - DNA, 342 bp, Streptococcus pneumoniae
atgagagacgatatcaaaatcaatgaccgtgctttggccttgcaagaccaaatcatcgaaaaactagagaaagtttttgatacagatgtggaattggatgtttacaatctaggtctgatttatgaaatcaatctggatgaaacggggctctgcaagattgtcatgaccttcaccgatactgcctgtgattgcgccgaaagcctgcctattgaaatcgtggcaggtctgaaacaaatcgagggtatcaaagatatcaaggttgaagttacctggtcgcctgcttggaaaatcacacgaatcagtcgctatggccgtattgcccttggactaccacctcgttaa

SEQ ID NO: 1593 - DNA, 1704 bp, Streptococcus pneumoniae
atgactgaattagataaacgtcaccgcagtagcatctatgacagcatggttaaatcacctaaccgtgctatgcttcgtgcgactggtatgacagataaggactttgaaacatcgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcggacgggatcgctatgggaacgcctggtatgcgtttctctctaacatctcgtgacatcatcgcggactccatcgaggcggctatgagtggtcacaacgtggatgccttcgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggttgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccacatcgtatcatctgcttcacgcggagccgtgacagacttctggaatatggacaagtcaggtaaaaaataa

SEQ ID NO: 1594 - DNA, 933 bp, Streptococcus pneumoniae
atgatgagaagtacgaaagaattacggcatgtatatagagacttccttttagaggctaatcaaagttattctgatatagtagtcttagaagccgatttgtcaagttcgatggctactcataatcttgaaaaggacttcggagaccgttatgtgaatgttgggattatggaagcagaaatggtcggccttgcagcaggcttgtctattcaggggtttagaccttatcttcatacatttggtccttttgcttcacgaagagtatttgatcaattatttatttctcttggatacgcacaattggatgccactgtgattggatcagatgcaggagtaactgcagaaatgaatggtgggacacatatgccatttgaagaaattggattgttacgtttaattcctaaatcgatcatttttgaagcaactgatgatatccaatttcgtgaaatattgaaccagacattagacttaaaaggactaaaatatattcgaacaattagaaaagctccagttcctgtgtatcaaggtggagaagatttttctaaaggctacattgagttaaggcatggtgaagatcttgtaatcgttgcttctggtataatggttgctccaagtattcgagttgcagatgaactgtctaaattaggttattcagtaagtgtgatagatttatttagaatcaaaccgataccagaacagataaaaacaatgttaagtggaaaaactatatttactgtagaaaatcacaatcagataggtggaattggcagtgctttatgtgaattattctctgatgatggaataacaaaaattcatcggatgggtgttcaagaaagattcggtcaagtagggaaaatggattatcttcttaatgagtatggtttgagtgaatcgaatataaaagagaaggttctagaaatttataatgcaagatag

SEQ ID NO: 1595 - DNA, 858 bp, Streptococcus pneumoniae
atgattttaagtaaaaatagagaagatgggttaagaaaatttgcgactaacatccgattaaatactcttagaacattgaatcatcttggattcggacattacggaggaagtctgtctatcgtagaagttttagcagtgctttatggtgaaataatgccaatgactccagaaatatttgcagcacgagatagagattatttcatattatcaaaaggtcatggaggaccagctctatacagtacactctatttgaatggtttctttgacaaagaattcttatattctttaaatacaaatggaaccaaattaccgtctcatcctgatagaaatctaacgccaggcatagatatgacaacgggctctttaggacaaggaattagtgttgcaactggacttgcatatggtcagagaataagaaagagtcccttttatacttatgctattgttggagatggtgagttaaatgagggacaatgttgggaggctatacagtttgcttctcatcaacagttatccaacttaattgtatttgttgatgataacaaaaaacaattagatggttttacaaaggatatttgtaatccaggtgatttcgtagaaaaattttcagcatttggatttgaatccattagggtcaagggttcagatattagagaaatttatgaagggattgtccaattaaaacagtcacataattcatcacctaagtgcattgtattagatactattaaaggtcaaggggttcaagagctggaagaaatgaaatccaaccatcatcttcgccctactgtagaggagagacaaatgttaacttcagttgtagaaagattaagtcaggaattggaggaaacagaatga

SEQ ID NO: 1596 - DNA, 1347 bp, Streptococcus pneumoniae
atgatgaagttcatattggatattgttagtacaccagctattttagtagctttaattgcaatcttaggattagttcttcagaagaagaaattacctgatattattaaaggtggaattaagacctttgttggtttcttagttgtatctggtggtgcaggaattgtacaaaattctttaaatccatttggtaccatgtttgagcatgcttttcatttatctggcgttgtgccgaataatgaagcaattgtagctgtagctttaacaacatatggctcagctactgcaatgattatgtttgcaggcatggtgttcaatatcttaatcgctcgttttactcgatttaaatatatctttttaacagggcaccacactctatatatggcatgtatgattgcggtcattttatcagttgctggctttactagcttgcctctcatcttactaggaggattagcactcggtattattatgagtatttccccagcatttgtgcaaaaatatatggttcaattaactggaaatgacaaggtggctttaggtcatttcagttctttgggatattggttgagtggttttactggtagccttatcggtgacaaatcaaaatcaacagaggacattaaatttccaaagagtttagcttttttacgtgatagtactgttagtatcactttatctatggcagttatttacattattgtagctatctttgcagggtcagaatatatagaaaaagaaatcagtagtggtacaagtggtctagtttatgctttacaattagcaggtcaatttgcagcaggggtatttgttattttagcaggtgttcgccttattttgggcgaaattgttccagcctttaaaggtatttcagagcgtcttgtacctaattcaaaacctgctttggattgtccgattgtttatacttatgcacccaatgcagttctaattggatttatctctagttttattggtggtttagtaagtatggcaattatgattgcttcaggaacggttgttatcttaccaggcgttgtgcctcatttcttctgtggagcgactgcaggtgtcattgggaatgcatctggtggtgttcgtggagccactattggagcatttttacaaggtattttaatcagttttcttccagtctttttaatgccagttttgggaggactcggtttccaaggatcaactttctcagatgcagattttggtctatcaggaattattttaggaatgttaaatcaatttggctcacaagcaggcattgtgattggtcttgttcttattttagcagttatgtttggagtatcctttattaaaaagccatctgcaaaggaggaataa

SEQ ID NO: 1597 - DNA, 285 bp, Streptococcus pneumoniae
atgttaaaaattggtacagcttgtggttcaggattaggttcaagttttatggtacagatgaatattgaatctgtattgagtgatttgaatgtttcggatgtagaagttgaacattatgatttaggtggagcagatccaaatgcagctgatatttggattgttggtcgtgatctagctgattcagctagtcatcttggagatgttcgtatcttaaatagtattattgatatggacgaactacgagaattaattactaaaatttgtgaagaaaaaggacttatatag

SEQ ID NO: 1598 - DNA, 2031 bp, Streptococcus pneumoniae
atgtttgattatagagcactagttattttgatgactttgatggatcattgtgagctatcattatatgaattatctgttaaggtgagcttacctataaaggaagtcaaagaaggaatagattatttagtgccttatctagctaataaagggatagtgctggataaaaaacaaggtcgctatagtttatcaaatcgtacgaagcagtctttgacagatattattaagtcggatgaattggttttaccaaagtcgactcgcttagctttaatctatctttacactttttgccgattagattttatatcgaataatcattaccaagactttttgaaagtaagtaagaatacaaccttatctgatattcaatcattaagaaagattatgttagataatgatttggagctagggtacagtagagcaaaaggttatactttacacggttcagagtggaataagcaccgtttagcttttcaaatggttagtgagttgctggaatcctccatagggatttggggtttggattatgttttatccagttgggggtattcattaacttatgatttgattgatcaggtagttaaagattattatgagaagctacagctagtacctattgttaatcaattaaaagtttaccttttcggtttagtattcattctgtgtaggtatcaaagggatgttgaaagagtatgtctttcagagacattagtatctcctgttattcaagatataacgactattttattggatacagtggttgatttgggaattatagatacggtgttttctgaggatgattatcgctatatcacagttttattatcaagttgctttgaaggtgaagtagatgttgctccggtttactttaatcaattaacagaggctattataagtagaatggaagatatttctttgttacattttaaacaaagggaaggattgagagaaaatcttcgtcgccaccttataccggcttactatagattaaagttcggcctacctagttcaaatgaatatgtattgcatgttaaagaacattatcctgatttatttgaattagtcaaagattctttgatgcccttgatggacgctattgacaatcccatacctgatagtgaaacagcatattttgttatccatttcggaggttatttaaagaaagcagatactttgcctcaaaaatggtataaagcagcaatcatttgtcctaatggtgttagttcttcattgatgttaaaagagaatctattagcattatttcctcaaattgagtttataggaacctcaaagattgatgatttacaggtgaaagctagtagtgactatgatatggttttttctaccataaaggtggagacagaaaagccaaattatctagtttcggttatgatgactgaagagcaagcaatacaactagtagaactagtgttaaaagattttccgaatttagagtatggagattttgagattgaacaaatcctgaatattgtcaaaagatatggaattattacacaagaattggaattaagattggcgttaaagaattatctttatcaaaaaaatgatagaaaggaaattgtaccagtgctagaacaacttattaccaaagaaacctatcaggttagttcgcaaaaattaggatggaaggaggcgattcgtttagcagctaaaccgcttttggatcaagataagataacggagaactaccctgaggcaatgattcaaaaagtagaagagtttggaccttttattaatttagggaagggagtagcaattcctcacgctcggccagatgaaggtgtgaatgaaataggaatgtcaatgttagttttggaagaaccgatttatttattggataatccagaacaagaggtaagattgttgatttgtattgcagccattgataatgagagtcatttaaaggctttgtcacatttaacaacaattttaagagataaaaatcatgttcaaactttaatatcatcaaaaaactatgatgatattaaaatgataattaaacaggaggattag

SEQ ID NO: 1599 - DNA, 1008 bp, Streptococcus pneumoniae
atgactgaaaaactaatcaattcaaaaccaaatggtgtattcgcattgattctcattgagttgacaatcgtacttggtgtctttatatttataatgggtgttggttcggaaaacatttttggaattattatcggacctttactaatcgtaattgcagcgctaactcatgctggtttaaaagttgtcaaacctcaggaagctctggttctgacactctttggtaattatacaggtaccatcaaagaacctggtttttactttgtcaatcccttcagcgtagcagtcaaccctgcaaaccacactcgacttggacaaagtggtgatgttagcacaaaatctccttttttaggagctaaatcatcaaatgacaatgatgtaaatcttgaaattggcaagaaacacatttccctcaaagtcatgaccttgagcaattctcgtcaaaaaatcaatgattgcttaggaaaccctgtagaaatcggtatcgcggtaacttggagagttgtcgataccgctaaggcagtcttcaacgttgataactacaaagaatatctttcattgcaatgtgatagcgccctccgtaatattgtccgcatctatccttacgatgtgtctcctaatgtggatactacgggtgaacggcaagcagatgaacgtagtctccgtggctctagcgaaattgttgctaaccgtattcgtgaagaaatccaaagtcgtgttgaggatgctggcttggaaatccttgaagcacgtatcacttacctagcttatgctccagaaattgctgccgttatgcttcaacgccaacaagcatctgccattattgatgcacggaagatgattgtagatggtgctgtaggaatggttgaaatggcactagaacggctcaatgaaggggaattggtagaacttgacgaagaacgaaaagctgccatggtttcaaatctccttgtcgttctttgtggcaatcatgatgcacaaccaattgtcaacacaggaagtctttactaa

SEQ ID NO: 1600 - DNA, 201 bp, Streptococcus pneumoniae
atggctgaagctaaaaaaaagcagatcccccttcgactctcaacaaagttatacgctgcactcgcatcatgggcagaagacgactttcgttcagtcaatgggcaaatcgaatatctcctcacagagtgtgtcaagcaacggaaaaaagacggaaaatacgtatcagaaaccattgacgaaccatttgagattgatatttaa

SEQ ID NO: 1601 - DNA, 183 bp, Streptococcus pneumoniae
atggcagtacctgcacgtcgcacttcaaaagcgaagaaaaacaaacgtcgtacacactacaaagtaacagctccatctgtaaactttgacgaaactactggagattactcacgttctcaccgtgtatcacttaaaggatactacaaaggacgtaaaatcactaaagctgcatcagctgaataa

SEQ ID NO: 1602 - DNA, 1926 bp, Streptococcus pneumoniae
atgaaaaaaactacaatattatcattaactacagctgcggttattttagcagcatatgtccctaatgaaccaatcctagcagatactcctagttcggaagtaatcaaagagactaaagttggaagtattattcaacaaaataatatcaaatataaggttctaactgtagaaggtaacataagaactgttcaagtgggtaatggagttactcctgtagagtttgaagctggtcaagatggaaaaccattcacgattcctacaaaaatcacagtaggtgataaagtatttaccgttactgaagtagctagtcaagcttttagttattatccagatgaaacaggtagaattgtctactatcctagctctattactatcccatcaagcataaaaaaaatacaaaaaaaaggcttccatggaagtaaagctaaaactattatttttgacaaaggcagtcagctggagaaaattgaagatagagcttttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaactcaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgcggatgcgattaaacttgaagaaattagcttaccaaatagtttagaaactattgaacgtttagccttttacggtaatttagaattaaaagaacttatattaccagataatgttaaaaattttggtaaacacgttatgaacggtttaccaaaattaaaaagtttaacaattggtaataatatcaactcattgccgtccttcttcctaagtggcgtcttagattcattaaaggaaattcatattaagaataaaagtacagagttttctgtgaaaaaagatacatttgcaattcctgaaactgttaagttctatgtaacatcagaacatataaaagatgttcttaaatcaaatttatctactagtaatgatatcattgttgaaaaagtagataatataaaacaagaaactgatgtagctaaacctaaaaagaattctaatcagggagtagttggttgggttaaagacaaaggtttatggtattacttaaacgaatcaggttcaatggctactggttgggttaaagacaaaggtttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttgggttaaagacaaaggcttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttggtttacagtttctggtaaatggtactatacctataattcaggagatttattagtaaacacgactacacccgatggctatcgagtcaatgctaacggtgagtgggtaggatag

SEQ ID NO: 1603 - DNA, 228 bp, Streptococcus pneumoniae
gttttatcttttgaaaacaaaacaccatcaactgaggcaaacgattcatttccttcttcaacatcaacatgttttaagctagtagtgagtctaaatagattacttcctaatgttttaaccgattttggtaatgttagtttctctaaatttgataaattagcaaaagcctcatgtgatattaattctaattttgaacttgaggaaaaggttagctttttcaatttttga

SEQ ID NO: 1604 - DNA, 576 bp, Streptococcus pneumoniae
atggacttaaaatttgaaggggttgatttagaatacaaaaaagctaaaaacaatcttccagagtctttctgggaaacctactcagcatttgcaaatacaaatggcgggaaaataattctcgggatagatgaaaaaaacattgacacctaccaaagagtcaatagactccctgcgaaacaaaattatgaagcaagtaaacaactaactgatgcacgatttaagcgtcttgttggtgttcagcgtaccacttttgaagagatgttagctgtattaaaaacagcttatcaacttaaacacgcaaaaggtggacgaaaacctaaattaagcctagaagaccttcttatggccactcttcaatatgtgcgagaatatcgcacttatgaagaaattgcggctgattttggtatccacgaaagcaacttaatccgtcggagccaatgggttgaagtaactcttgttcaaagtggtgttacgatttcaagaactcttctcagttctgaggacacggtaatgattgatgcgacggaagtaaaaatcaatcgccctaaaaaaacaattagcgaatcattctggtaa

SEQ ID NO: 1605 - DNA, 378 bp, Streptococcus pneumoniae
aaatcaatcgccctaaaaaaacaattagcgaatcattctggtaaaaagaaatttcacgctatgaaggctcaagcgattgtcacaagtcaagggagaattgtttctttggatatcactgtgaactattgtcatgatatgaagttgttcaaaatgagttgcagaaatatcggacaagctggtaaaatcttggctgacagtggttatcaagggctcatgaagatatatcctcaagcacaaactccacgtaaatccagcaaactcaagccgctaacagctgaagataaggcttataaccatgcgctatctaaggagagaagcaaggttgagaacatctttgccaaagtaaaaacgtttaaaatgttttcaacaacctattga

SEQ ID NO: 1606 - DNA, 327 bp, Streptococcus pneumoniae
gtgattttatggagtttcgattttgtaaatgctcatgctcacgcatttttcatggataatgttgagtggagtcatgcagattcttactttcttagctttgttagtgacgatgttgaagaacgttacacagaaaatgtctatctggatagcctaagtgtcaaacaaaaatttaagtttcttttcgacttcggtgatgaatggcgttttgaatgccaagtactgagagaaatcgagacagaggacgaagaagcttatctcgtacgttcggttggaacgtcgccagaacaatatccagattatgatggttttgactatgaagaatggtaa

SEQ ID NO: 1607 - DNA, 1881 bp, Streptococcus pneumoniae
atggtaagatttacaggacttagtcccaaacaaacgcaagctattgaggttttaaaaggtcatatttctctaccagatgtggaagtggctgtcactcagtctgaccaagcctctatctctatcgagggtgaggaaggtcactatcaattgacctaccgcaaacctcaccaactttatcgtgccttgtccttgttggtaacagttctagcagaagctgataaagtagagattgaggaacaagcagcttacgaagatttggcttacatggttgactgttctcgaaatgcggtgctgaatgtggcttctgccaagcagatgattgagatcttggctctcatgggctactcaacctttgagctttacatggaagacacttaccagattgaagggcagccttactttggctatttccgtggagcttattcagcagaggagttgcaggaaatcgaagcctatgttcaacagtttgacatgacctttgtaccatgcatccagaccttggcccacttgtcggcctttgtcaaatggggtgtcaaggaagtgcaggagctccgtgatgtagaggacattcttctcattggcgaagaaaaggtttatgacctgattgatggtatgtttgccacgttgtctaaactgaagactcgcaaggtcaatatcgggatggacgaagcccacttggttggtttgggacgctacctgattttgaacggtgttgtggatcgtagtctcctcatgtgccaacatttggagcgcgtgctggatattgctgacaaatatggtttccactgccagatgtggagtgatatgttcttcaaactcatgtcagcggatggccagtacgaccgtgatgtggaaattccagaggaaactcgtgtctacctagaccgtctcaaagaccgtgtgactctggtttactgggattattatcgggatagcgaggaaaaatacaaccgtaatttccgcaatcatcacaagattagccatgaccttgcatttgcagggggagcttggaagtggattggctttacacctcacaaccattttagccgtctagtggctatcgaggctaataaagcctgccgtgccaatcagattaaagaagtcatcgtaacgggttggggagacaatggtggtgaaactgcccagttctctatcctatcaagcttgcaaatctgggcagaactcagctatcgcaatgacctagatagtttgtctgcgcacttcaagaccaatactggtctaacggttgaggattttatgcagattgaccttgccaacctcttaccagacctaccaggcaatctcagcggtatcaatcccaaccgctatgttttttatcaggatgttctttgtccgatacttgaccgacacatgacacctgaacaggacaaaccgcacttcgctcaggctgctgagacgcttgctaacattaaagaaaaagctggaaactatgcttatctctttgaaactcaggcccagttgaatgctattttaagtagcaaagtagatgtgggacgacgcattcgtcaggcctaccaagaggatgataaagaaagtttacaacaaatcgccagacaagaattaccagaacttagaagccaaattgaagacttccatgccctctttagtcaccaatggctgaaagaaaacaaggtctttggtttggatacagttgacatccgtatgggcggactcttgcaacgcatcaaacgagcagaaagccgtatcgaggtttatctggctggccagcttgaccgcatcgacgagctggaagttgaaatcctaccatttactgacttctacgcagacaaggatttcgcagcaactacagctaaccagtggcataccattgcgacagcttcgacgatttatacgacttaa

SEQ ID NO: 1608 - DNA, 870 bp, Streptococcus pneumoniae
atgaccattgcaacgattgatatcggagggactgggattaagtttgccagtctgactcctgatgggaaaatactgtataagacaagtatttcaacgcctgaaaacttggaggatttactagcgtggctagatcaacgcttgtcagaacaggattacagtgggattgctatgagcgttccaggtgcggtcaatcaagagacaggtgtgattgatggcttcagtgcggtgccctacatccatggcttttcttggtatgaggcgcttagctcttatcagctacctgtccatttagaaaatgatgccaactgcgttggactcagtgaactactagctcatccagatcttgaaaatgcagcctgtgtcgtgattgggacagggattggcggagccatgattatcaatggtagacttcatcgaggtcgccacggtctgggtggagaatttggctacatgacaacccttgcccctgctgaaaaacttaataactggtcgcaactagcatcaactgggaatatggtacgatacgtgattgaaaaatctggtcatactgattgggacggtcgcaagatttaccaagaggccgcagctggtaatgctctttgtcaagaagccattgagcgcatgaaccgcaatctggcgcaaggcttgctcaatatccagtatctcatcgatccagatgtcatcagtctgggtggctctatcagtcaaaatccagattttatccaagatgtcaagaaggctgttgataactttgtcgatacctacgaagaatacacggtcgcaccagttatccagacctgcacctatcacgcagatgccaatctctacggtgcccttgtcaactggctacaggaggaaaagcaatggtaa

SEQ ID NO: 1609 - DNA, 2661 bp, Streptococcus pneumoniae
atgaggttttacttcatggaaaatgttgttgtacatattatctcacatagtcactgggaccgtgagtggtacttgccttttgaaagccatcgtatgcagttggtggaattgtttgacaatctctttgatctctttgaaaatgaccctgagttcaagagtttccacttggatggacaaactattgtccttgatgactacttacaaattcgccctgaaaatcgtgacaaggtccaacgctacattgacgagggcaaacttaaaattggtcccttttacatcttgcaggatgactacttgatctccagtgaagccaatgtccgcaataccttgattggtcaacaagaagctgccaaatggggtaaatcaacccagattggctactttccagatacctttggaaatatgggacaagctcctcaaatccttcaaaaatcaggtattcacgtggcagcctttggtcgtggtgtgaagccgattggatttgacaaccaagtccttgaagatgagcggtttacatcccagttttcagaaatgtactggcagggtgtggatggtagtcgtgttttaggtattctctttgccaactggtacagtaatgggaatgaaatcccagttgacaaagatgaggccttgatcttctggaaacaaaaattgtcagatgtgcgtgcctacgcttcgaccaaccaatggttgatgatgaacggctgtgaccaccagcctgtccagaaaaatctgagcgaagccattcgtgtggcaaatgaactcttcccggatgtaatctttgttcatagttcttttgatgaatatgttcaagctgtagaaggtgcgcttcctgaacacttatcaactgttacaggtgagttgaccagtcaggaaacagatggctggtacacacttgccaacacttcttcatcccgcatttacctaaaacaagccttccaagaaaatagcaacctcctagagcaagtggtagaacccttgactattatcactggtggacacaaccacaaggaccagttgacctatgcttggaaaacacttttgcagaatgcgccacatgatagtatctgtggctgtagcgtggacgaagttcaccgcgagatggaaacgcgttttgccaaggtcaaccaagtaggaaactttgttaaaagtaatttgctcaacgagtggaagggtaaaattgctacggataaggctcaaagtgactatctctttactgtcattaacacaggcttgcatgataaggtcgatactgtcagcacagtgattgatgtggcgacttgtgatttcaaggaattgcacccaacagaaggctacaaaaagatggctgctcttatcttgccaagttaccgtgtggaggacttggatggtcgtcctgtagaggctacaatcgaagacctcggagctaattttgagtatgatttaccaaaagacaagttccgccaagctcgtattgctcgtcaagtgcgcgtgaccattccagttcacctagcgccgctttcttggacaaccttccaattgctggaaggaaaacaagaacaccgtgagggtatttaccaaaacggagtgattgatacaccattcgtaacggtgagtgtggatgacaacatcacagtctatgacaagacaactcacgaagcctatgaagactttatccgctttgaagaccgtggggacatcggaaacgagtatatctatttccaaccaaaaggaacagagccaatctttgcagagcttaagggccacgaggtcttggaaaacacagcttgctatgctaaaatcttgctcaaacatgaattgaccgtgcctgtcagtgcggatgaaaagctagaagaagagcaacaaggtatcatcgagtttatgaagcgtgaggctggacggtcagaagaattgacaaacattcctctggaaactgagttgactgtcttcgttgacaatccacaaatccgcttcaagactcgctttactaacactgccaaggatcaccgtatccgtctcttggtcaagactcataacacgcgtccaagcaatgattctgaaagtatctatgaggtggtgacacgaccaaacaaaccagctgcttcatgggaaaatcctgaaaatcctcaacaccaacaagcttttgtcagtctgtatgacgatgaaaaaggggtgactgtatccaataagggattgaatgaatacgaaatccttggggataacaccattgccgtgaccattttgcgtgcatcaggtgagctaggtgactggggctacttcccaacgccagaagcacaatgcttgcgtgagtttgaagtcgagtttgcacttgaatgccaccaagcccaagaacgcttctcagcctatcgtcgtgccaaagccttgcagacaccgtttaccagccttcagcttgctagacaggaaggaagcgtggttgcgactggtagcctcttgagccattctgttctcagcataccgcaagtttgtccaacagcctttaaagtggcggaaaatgaagaaggctatgtcctccgttactataatatgagtcaagaaaatgtgcgcatatcagaacatcaacaaaccattcttgacttacttgagcgaccatatccagttcattcaggactattggctccacaagagattcgtacagaattcatcaaaaaagaagaaatttaa

SEQ ID NO: 1610 - DNA, 1305 bp, Streptococcus pneumoniae
ttgtttgaaagagggaattgcacgatgatttattcgaaagaaattgttagagaatggctagatgaagtagcagagcgggctaaggaccatccagagtgggtggatgttttcgagcgttgctacaccgataccttggacaatacggttgaaatcttagaagatggttcaacttttgtcttgactggggatattcctgccatgtggcttcgggattcgacagcccaactcagaccctaccttcatgtagctaaaagagatgccctcctgcgtcagaccattgcaggtttggtcaaacgtcagatgaccttggtactcaaggatccctatgctaactccttcaacattgaggagaactggaaagggcaccacgagactgatcacacagaccttaacggctggatctgggagcgcaagtatgaggtggattcactttgctatcctttgcagttggcttatctcctctggaaagagactggcgagactagtcagtttgatgagatttttgtcgtagcgactaaggaaattctccatctatggacagttgaacaagaccacaagaactctccttatcgttttgtccgagatacggaccgtaaggaagacaccttggtaaatgatggctttggacctgactttgcagtgacaggtatgacttggtcagcctttcgtccgagtgatgactgttgccagtatagttacttgattccgtcaaatatgtttgctgtagtagtcttgggttatgtgcaagaaatcttcgcagcattaaacctagctgatagccagagtgttattgctgatgccaagcgtcttcaggatgaaatccaagaaggaatcgaaaactacgcttacaccaccaacagcaagggcgaaaagatttacgcttttgaagtagatggcctaggaaatgccagcatcatggatgatccgaatgtgccaagtctactagctgcgccctatctgggctactgttcgatcgatgatgaagtgtatcaagccactcgccgtaccattctgagctctgaaaattcatacttctaccaaggagaatacgctagcggtcttggaagttctcataccttctatcgctatatctggccaatcgccctttctatccaaggattgacaacaagagataaggcagagaaaaaattcttgctggatcagctggttgcctgcgatggtggtacaggtgtcatgcacgaaagcttccacgtagatgatccgaccctctactctcgtgaatggttctcctgggctaacatgatgttctgtgagttggtcttggattacttggatattcgctaa

SEQ ID NO: 1611 - DNA, 2085 bp, Streptococcus pneumoniae
atgaaaccactacttgaaaccatcgatacccgctttggaactaccaacaagcatgccttttctcggggaaataccctgccatacacaggcgtgccttttgggatgaattattttgtgccccagaccagtgaccaggacggagcttggttcttcgatccgcatctgcctatctttcaggggattcgattaactcaccagcccagtccttggattggggactactcttggctccttctgacacctgtcaccagtcaactgggtgaagacagtctctttcaccgccagtcttcctataatagggataaggcctctttccaacctcattatctaaagattttctccctgcgctatcagattgaaacccagctcacaccgacttgctacggtgcttctattcgtttgaagcaaaagcaaggcaaagccctctccctctatcttcacgcaacagatgaactgacagtagagcaagtagataagcgaactcttgccctgcgacaagaaggtaaaactgaaaccaacaaaaattcgctaacgatgttcactgccctacaaatgaacacggatattcttgctatcagccaagaagctggagactggcgaattgacttagtaagtagtcaaaccgagatgcaactagccacttctttcatctctccttctcaagctctaatcaatctacctcaagaagattttgatagctgtaaagcaagtgcccaagcggattgggaaaatctcctccatcgttttgatgttatagagacaggagaggctaaccgaaccttctttgaccactgtctctacagactcttcctcttcccacagactttttatgaggttgatgagtcagggcaagccatccacatggatctggctactggtactgtcaagcctggtgtcctctttagcaacaatggtttctgggataccttccgcaccaccttccccctctttgcccttatcataccggagcactatcaacgctttttagaaggtttcctcaatagctaccgcgatactggtttccttccaaaatggctggctccagatgaacggggtatgatgccaggtacacttttagacggtattatcgcagatagcgcctgcaaggacatggcccctgacctagaaggagaactcttccaagccatgctcgaaacagccagcaaagccgaccctctcggcatcaatggccgccacggactagcccaataccaagaactaggttacctctctaccgaccaccacgaaagtgttagccatactctagactatgcctatagtgacttttgtatcgctagctgtgccaaaaaactagagaacatagaaatcgctgaaacctacaaggctgcttcacaaaattaccgccagctatttgacgctgagacaggttacatgcgagcacgagacaatcaaggaaactttcaccctgacttctctccttatagttgggggcgagactacgctgaatgctctgccattcaagctactttaggcgttctccacgacatccctggcttaatccaactgatgggtggaaaagaaacctttagcaactatcttttgaaagcttgtcaagatgctcccctctttgaaacaacaggctatggttacgaaattcacgaaatgagcgagatggctactgctccttttggacaaatagccatttccaaccagcctagtttccacattccttatctcttccgctacagcgattaccctgactacactgcccttcttatcaagacgctccgtcagaaagcttttcacccaagttgggaagcctatcctggagatgaagacaatggtagtctctctgcttggtacatctggtcagctctcggattttatccaacctgtccaggaaaaccaagctatgacctcggaatccctctctttgaccatctacgagtctacctcgctaaagaagataaatggctggatatccatactaaacaaaaccacaaccattttaactttgtcaaagaatgccgactggacaaaacactcgtatcaactattcaacaccaagacctcttaaaagctgaacaactaactttcaccctcagctggttaccaagtcactaa

SEQ ID NO: 1612 - DNA, 1680 bp, Streptococcus pneumoniae
atgaagaaaattaaaccgcatggaccgttaccaagtcagactcagctagcttatctgggagatgaactagcagcttttatccacttcggtcctaataccttttatgaccaagaatgggggactggacaggaggatcctgagcgctttaacccgagtcagttggatgcgcgtgagtgggttcgtgtgctcaaggaaacgggcttcaaaaagttgattttggtggtcaagcaccacgatggctttgtcctttatccgacagctcacacagattattcggttaaggtcagtccttggaggagaggaaagggcgacttgctccttgaagtatcccaagctgccacagagtttgatatggatatgggggtctacctgtcaccgtgggatgcccatagtcccctctatcatgtggaccgagaagcggactacaatgcctattatctggctcagttgaaggaaatcttatcaaatcctaactatgggaatgctggtaagttcgctgaggtttggatggatggtgccagaggagagggcgcgcaaaaggttaattatgaatttgaaaaatggtttgaaaccattcgtgacctgcagggcgcttgcttgattttttcaacagaaggcaccagtatccgctggattggcaatgaacgagggtatgcaggtgatccactgtggcaaaaggtgaatcctgataaactaggaacagaagcagagctgaactatcttcagcacggggatccctcgggcacgattttttcaatcggagaggcagatgtttccatccgtccaggctggttctaccatgaggatcaggatcctaagtctctcgaggagttggtcgaaatctactttcactcagtagggcgaggaactccactcttgcttaatattccgccgaatcaagctgggctctttgatgcaaaggatattgaacgactttatgaatttgcgacctatcgcaatgagctctataaagaagatttggctctgggagctgaggtatctggtccagctctttccgcagactttgcttgtcgccatttgacagacggccttgagaccagctcttgggcaaacgatgcagccttgcccatccagttagaactcgacttaggttctcctaaaacttttgatgtaattgagttaagagaagatttgaagctagggcaacgaatcgctgcttttcatgtgcaagtagaggtggatggtgtctggcaggagtttggttcgggtcatactgttggttacaaacgtctcttacgaggagcagttgttgaagcacagaagatacgtgtagtcattacagaatcacaggttttgcctttgttgaccaagatttcactctataaaactccgaggttatcacaaacagtagctgttcaggggctagcatttgcagaaaaaagcctagctgtggcaaagggagagactcttcattttaggattgaacgtagtgaaagtagctcctctttagaggctaagatttcgattcaaccggggacaggtgtccatggtgtcgcctatcaggatgagattcaagtccttcaattccaagcaggggaaagcaaaaaagatttgcatctaccaaccctgtatttcgcaggagataaaaccttggatttctatctgaacctaacggtggatggtcagcttgtggatcaacttcaagtccaagtttcataa

SEQ ID NO: 1613 - DNA, 1230 bp, Streptococcus pneumoniae
atgtcttctcatccaattcaggtcttctcagaaattgggaaactgaaaaaagttatgttgcaccgtccaggcaaggagttagaaaacttgttgccggactatcttgaaaggcttctttttgatgatattcctttcttggaagatgctcaaaaagaacatgatgcatttgcccaagctcttcgcgatgaaggaattgaggttctctacctagaacaactcgctgctgaatcattgacctctccagaaatccgcgatcaatttatcgaggaatacttagacgaagccaacatccgtgatcgtcaaaccaaggttgctattcgtgaattgcttcacggcatcaaggacaaccaagaattggttgaaaaaacaatggctgggattcaaaaagttgaattgccagaaattcctgacgaagctaaagatctaactgacttagttgaatcagagtatccatttgcaattgacccgatgccaaacctctatttcactcgcgacccatttgcaacaattggaaacgccgtatcgcttaaccacatgtttgcagatactcgtaaccgtgaaacactctacggtaagtatatcttcaaataccacccaatctatggcggaaaagtggatttggtctacaaccgtgaagaagatacgcgtatcgaaggtggagacgagctaattctttctaaagacgtccttgcagtaggtatctctcaacgtacagacgcagcttctatcgaaaaacttttggtcaacatcttcaagaaaaatgttggcttcaagaaagttttggcctttgaatttgctaacaaccgtaaattcatgcacttggatactgtcttcactatggtagactatgacaagttcactattcacccagaaatcgaaggcgaccttcacgtttactcagttacttacgaaaacgaaaaacttaaaatcgttgaagagaaaggtgacttagctgaacttcttgctcaaaaccttggtgtagaaaaagttcatttgattcgttgcggtggtggcaatatcgtagcagctgcgcgtgaacaatggaacgacggttctaacactttgaccatcgcacctggtgtggtagttgtttatgaccgcaataccgtgaccaataagattttggaagaatacgggcttcgcttgattaagattcgcggaagtgaattggttcggggccgtggtggacctcgttgtatgtctatgccatttgaacgtgaagaagtgtaa

SEQ ID NO: 1614 - DNA, 1017 bp, Streptococcus pneumoniae
atgacaaattcagtattccaaggacgcagcttcttagcagaaaaagactttacccgtgcagagttagaataccttattggtctttcagctcacttgaaagatttgaaaaaacgcaatattcaacaccactaccttgctggcaagaatatcgctctcctatttgaaaaaacatctactcgtactcgtgcagcctttacaactgcggctatcgaccttggtgctcacccagaatacctcggagcaaatgatattcagttgggtaaaaaagaatctactgaagatactgctaaagtattgggacgtatgtttgacgggattgaattccgcggattcagccaacgtatggttgaagaattggcagaattctcaggcgttccagtatggaacggtctaactgacgaatggcacccaactcaaatgctcgctgactacttgactgttcaagaaaacttcggtcgcttggaaggcttgacattggtatactgtggtgatggacgtaacaacgttgccaacagcttgctcgtaacaggtgctatccttggtgtcaatgttcacatcttctcaccaaaagaactcttcccagaaaaagaaatcgttgaattggcagaaggatttgctaaagaaagtggcgcacatgttctcatcactgaagatgctgatgaagcagttaaagatgcagacgttctttacacagacgtttgggtatcaatgggtgaagaagacaaattcgcagaacgtgtagctcttcttaaaccttaccaagtcaatatggacttagttaaaaaagcaggcaatgaaaacttgatcttcctacactgcttgccagcattccacgatactcacactgtttatggtaaagacgttgctgaaaaatttggtgtagaagaaatggaagtaacagacgaagtcttccgcagcaagtacgctcgccacttcgatcaagcagaaaaccgtatgcacactatcaaagctgttatggctgcgacacttggtaacctttatattcctaaagtataa

SEQ ID NO: 1615 - DNA, 948 bp, Streptococcus pneumoniae
atggcaaatcgtaaaattgtagtagctttgggaggaaatgcgattctttcttctgacccatcagcaaaggctcaacaagaagctttagttgaaacagctaagcatcttgtaaaattgattaaaaatggagatgatttgattatcactcacggtaatggacctcaagttgggaatctcttgctccaacatttggcatcagactctgaaaagaaccctgccttcccactcgactcacttgtcgctatgacagaaggtagcatcggtttctggttgaaaaatgctttgcaaaatgctctcttggatgaaggcatcgaaaaaaatgttgcctctgttgtaacgcaagttatcgtagataaaaatgatccagcttttgttaacttgagtaaaccaatcggtcctttctattcagaagaagaagcaaaagcagaagccgaaaagagcggagcgactttcaaggaagatgctggccgtggctggcgtaaggtcgttgcctcaccaaaacctgttgacatcaaagaaattgaaaccatccgtactcttttaaataatggtcaagtcgtcgtagctgcaggtggtggcggtattcccgtcgtcaaagaaaacaatggacatttgactggtgtcgaagcggttattgataaagacttcgcttcccaacgtttggcagaattggttgatgcagacctcttcatcgttttgacaggtgtagattatgtatttgttaactacaacaagccaaaccaggaaaaattggaacatgtgaatgttgcccagctggaagaatatatcaaacaagatcagtttgcaccaggtagcatgcttccaaaagtagaagcagctatcgcttttgtcaatggtcgtccagaaggaaaagcagttattacttcccttgaaaatctaggcgccttgattgaatctgaaagcggaacaattattgaaaaaggataa

SEQ ID NO: 1616 - DNA, 1512 bp, Streptococcus pneumoniae
atgagtgaaaaagctaaaaaagggtttaagatgccttcatcttacaccgtattattgataatcattgctattatggcagtgctaacttggtttatccctgcgggggcctttatagaaggtatttacgagactcagcctcaaaatccacaagggatttgggatgtcctcatggcaccgattcgggctatgctaggtactcatccagaggaaggttcgctcattaaagaaacgagcgcagcgattgatgtagccttcttcatccttatggttgggggtttccttggcattgtcaacaaaactggtgctcttgacgtagggattgcctctatcgtgaagaagtataagggccgcgaaaaaatgttaattttggtactgatgcctttgtttgccctcggtggtacaacttatggtatgggggaagaaacaatggccttctatccactccttgtgccagttatgatggccgttggttttgatagcctgactggtgttgcaattattttgctcggttctcaaatcggctgtttggcatctactctgaatccatttgcgacaggtattgcttcagcgactgcgggagttggtacaggggacggtatcgtacttcgtctgatcttctgggttaccttgactgctcttagtacttggtttgtttaccgttatgcggataagattcaaaaagatccgactaagtcactggtttatagtactcgcaaagaagatttgaaacactttaacgtagaagaatcttcatctgtagaatctacacttagcagcaaacaaaaatcagttctcttcttatttgtgttgacattcatcttgatggtattgagcttcattccatggacagaccttggcgttaccatttttgatgactttaatgcttggttgactggtcttccagttattggtaatattgtcggttcatctacttctgcactaggtacttggtacttcccagaaggcgcaatgctctttgcctttatgggtatcctgattggtgttatttatggtcttaaagaagataagattatctcttccttcatgaatggtgctgctgacttgctcagtgttgccttgatcgtagcgattgctcgtggtattcaagttatcatgaacgacggtatgattaccgatacaatcctcaactggggtaaagaaggcttgagcggtctatcttcacaagtctttatcgttgtaacttatatcttctatctacctatgtcattcttgatcccatcttcatctggtcttgccagcgcaactatgggtatcatggctccacttggagaatttgtaaatgtccgtcctagcttgattatcactgcttaccaatctgcttcaggtgtcttgaacttgattgcaccaacatctggtattgtgatgggagctcttgcacttggacgtatcaacattggtacttggtggaaattcatgggcaaactcgtagtcgctattattgtagtgaccatcgcccttcttctccttggaaccttccttccattcctataa

SEQ ID NO: 1617 - DNA, 1332 bp, Streptococcus pneumoniae
atgaaaatagatataacaaatcaagttaaagatgaatttcttatatcattaaaaaccttgatttcctatccttcagtactcaatgaaggagaaaatggaacaccttttggacaagcaatccaagatgtcctagaaaaaactttagagatttgtcgagacataggtttcactacctatcttgaccctaaaggttattacggatatgcagaaatcggtcagggagcagagcttctggccattctctgtcatttggatgttgttccatcaggtgatgaagcagattggcagacaccgccatttgaagcaactatcaaagacggctgggtattcggacgtggtgtccaagatgataaaggtccttcgcttgcagctctctatgcagtaaaaagcttgctggaccaaggtattcagttcaaaaagcgcgtacgctttatctttggtaccgatgaggaaaccctctggcgctgcatggcacgctacaataccatcgaagaacaggccagcatgggctttgcacctgactcatcttttcctctgacctatgctgaaaaagggcttctacaggtcaaacttcatggccctggatcggatcaactagagcttgaagtaggaggcgcctttaacgttgtaccagacaaggccaactaccaaggtcccctctatgaacaggtttgtaacgatctcaaagaagctggttatgattaccaatccactgaacaaaccgtaacggttctcggagtgccaaagcatgctaaggatgctagtcaaggtatcaatgctgtcatccgactagctaccattcttgctcctctccaagaacaccctgctctcagctttcttgcaacacaagcaggtcaagacggcacaggaagacaaatctttggtgatatagcagatgaaccttctggtcacctatcctttaatgtcgcaggtctcatgatcaatcatgaacgttctgaaatccgtattgacattcggactcctgtcttagctgacaaggaagaactagtaaagttgcttacaagatgtgcacaaaactaccaactccgctacgaagagtttgactatctagcgcctctatacgtcgcaaaagacagtaaactcgttagcacactgatgcaaatctaccaagaaaagactggcgataacagtcctgctatttcatccggtggtgccacttttgctcgcaccatgccaaattgtgtagccttcggcgccttattcccaggagcgaagcagacagaacatcaggcaaatgaatgtgccgttctagaagatttgtaccgtgctatggatatttatgccgaagccgtctatcgacttgcaacttaa

SEQ ID NO: 1618 - DNA, 192 bp, Streptococcus pneumoniae
tttcaacatactataaaatcaggcaatacaacggctaaaaagtttgagtttatcgaaataccagtgcaaaaactgaaaaaagcgatttataaagctcatctcaaagattcagatgactttagaccagaaacatccacaccaaatctttttgaaagctgtttgaagctttgtccttgctttcttagttcatag

SEQ ID NO: 1619 - DNA, 237 bp, Streptococcus pneumoniae
tacaaaaaccaagctgaagaagacaaaccgctatctgataaatatattttcgaaaaaatattaggaaaaacatatgcagccttcaaaaaagatcaaattaatgagcgtgtcgagaaattaggtaagttaaaacctattacaataaattacaacggaaaatcagaagtaattgatagtaaagaaaaattacaagagcttatgaataaagccgttaaagacgaagtggctcaaatatag

SEQ ID NO: 1620 - DNA, 267 bp, Streptococcus pneumoniae
atgatgggagatgggatgaaagaatttcaatttgagagaaagcagcgtttttctttgaggccatatgcaataggagcttgttcggtcttgctaggaacgagtttattttttgctggtatgggtgctcagcctgtacaggatacagaaacgagttcagcactaatttcaagtcattatttggatgagcaggatttatctgaaaagctgaaatctgagttgcaatggcttgaattagaaaacaagcttttgaacttatgggagcattag

SEQ ID NO: 1621 - DNA, 153 bp, Streptococcus pneumoniae
ttgcgtttattaagaaaaacaaaaaacatcgatatacatttaactaaaaattattgtatgttatctcccttaattaggaatgataagggaataactagaaagatttgtgaatacaaactatttctgatatacaaaatatacagtaataatgaa

SEQ ID NO: 1622 - DNA, 216 bp, Streptococcus pneumoniae
actaatactcttcgaaaatctcttcaaaccacgtcagcgtcgccttgccgtatatctgcaacctcaaaacagtgttttgagctgacttcgtcagtcttatctactacctcaaaacggtgttttgagcaacctgtggctagtttcctagtttgctctttgattttcattgagtataaagagcttggcaacaggctctttttgtattgcgtttattaa

SEQ ID NO: 1623 - DNA, 165 bp, Streptococcus pneumoniae
ttgccaagctctttatactcaatgaaaatcaaagagcaaactaggaaactagccacaggttgctcaaaacaccgttttgaggtagtagataagactgacgaagtcagctcaaaacactgttttgaggttgcagatatacggcaaggcgacgctgacgtggtttga

SEQ ID NO: 1624 - DNA, 900 bp, Streptococcus pneumoniae
atggcaatatttttcatgatttttctgattgtttgtgtgctcctattggtgatagtcacactgagtacagtttatgtggttcgtcagcagtcggtggcgattattgaacgctttgggaaataccaaaaggttgctaatagcggtattcatattcgcttgccttttgggattgactcgattgcagcacggattcagttgcgcttgttgcaaagtgatattgtggttgagactaagaccaaggacaatgtgttcgttatgatgaatgtagcgactcagtaccgtgtcaacgagcagagcgtgacagatgcttactataaactcatacgtccagaatctcagattaaatcttatatcgaagatgctcttcgctcttctgttccaaaattaaccttggatgaattgtttgagaaaaaagatgagattgcccttgaagttcaacaccaagtagcagaagaaatgaccacttacggctacattatcgtgaaaaccttgattaccaaggtcgaaccggatgcagaagttaagcaatccatgaatgaaatcaatgcggcgcaacgtaagcgggtcgcagcacaagaattggcggaagctgacaagattaaaattgtcactgcagctgaagccgaagcagaaaaagaccgccttcatggtgtggggattgcccaacaacgtaaggcgattgtggatggattggcagagtctatcaccgaactcaaggaagccaatgttggcatgacagaagaacaaatcatgtctatcctcttgaccaaccagtatttggataccttgaatacctttgcctctaaaggaaatcaaaccatctttttaccaaatacgccaaatggtgtggatgatatccgaacacaaatcttgtcagcccttcgcgctgagaagaaataa

SEQ ID NO: 1625 - DNA, 192 bp, Streptococcus pneumoniae
catttcaggaaaaatcgcagtaaaaacggcacagccttctttaaatgtgctataatactagaaaaatacttgtggaggttccattatggcaatatttttcatgatttttctgattgtttgtgtgctcctattggtgatagtcacactgagtacagtttatgtggttcgtcagcagtcggtggcgattattga

SEQ ID NO: 1626 - DNA, 1152 bp, Streptococcus pneumoniae
atggctacattttatgttccggcagtcaaccttattggtaaaggtgttgtaaatgaagtgggtccttatatcaaggaacttggctataaaaaggcacttttggtgacagataagtacatcgaaggcagtgacattttacctaaggttttaaaaccactggatacagaaggaatcgaatatgtcatctttagcgatgtagagccaaaccctacttgtaagaatgtcacagatggggtagctgctttgcaagaacatggatgtgattttatcatcagtcttggtgggggttctccacaggatgcagctagttgtatttctatcatggctacaaatggtggaaaaccacaggattatgaagggcttcataagtctgctaaaaaaggcttgccagttgtggctatcaatacaacggcaggaacttctgcagaaatcactattaactatgtgattactgatgaagaacgcaaggttaagatggtaatggttgacaagaatagccttgctcttatctctgttaatgacccggaactcatgctttccaaacctaaaggcctgactgctgctactggtatggatgctctgactcacgctgttgaagctttggtaacacctggtgcttatgatgtaaccaagaaactgtctattggtgctattgagcttatcaaggaatatcttcctcgtgctgtagaaaatggacatgatattgaagcgcgtgaaggtatggtcaatgccatcttccttggtggtatgagctttaataatgctggtcttggttatgttcactcaatggctcaccaactcggtgcagtatataatttgccacatggtgtttgctgtgccatgttgctaccagttatagagcgtgaaaatgctaaacgtgtaccagaagctttccgcaatgttgccaaagccttgggacttcatgtagaaggtaaatcagatcaagaatgtgccgattatgcgattgttgagattgagaagctttctgagacagtaggtattcctaagaaactgactgaacttggtattgaagaaaaagatttcgactttgaatacctttctaagaatgccttgattgatgcctgcgcaccaggaaatccatttatgccaaccttagaagaaacgattgccttttataaagagttattttag

SEQ ID NO: 1627 - DNA, 1767 bp, Streptococcus pneumoniae
atgatccaacatccacgtattgggattcgtccgactattgatggtcgtcgtcaaggtgtacgcgaatcacttgaagtacaaacaatgaacatggctaaaagtgtggcagatttgatttcaagcacattgaaatatccagatggggaacctgtggaatgtgtgatttctccatctaccattggtcgtgttccagaggctgcagcttcccatgagttgtttaaaaaatcaaatgtttgcgcaacaattacagttacaccatgctggtgttatggtagtgaaactatggatatgtctccagatattcctcatgctatttggggatttaatgggacagaacgcccaggagctgtctatcttgcagctgtactagcttcacatactcaaaaagggattccagcctttgggatttatggtagagatgttcaggaagctaatgatacagctattccagaagatgtcaaagaaaaacttttacgttatgcgcgggcagctcttgcaactggcttgatgagagacactgcttacctatcaatgggtagtgtttcgatggggattggtggttctattgtaaatccagatttcttccaagaatacttaggaatgcgaaatgaatcggtagatatgacggagttcacgcgccgtatggaccgtggtatttacgaccctgaagagttcgaacgtgcgctcaaatgggtgaaagaaaacgtaaaagaaggattcgaccataaccgtgaagaccttgttttaagccgtgaagaaaaagatagacaatgggaatttgttattaagatgttcatgattggacgtgacttaatggttggtaacccaagacttgctgaacttggttttgaggaagaagcagttggtcaccatgctttagtagctggtttccaaggtcaacgtcagtggacagaccattttccaaatggggactttatggaaactttcctcaatactcagtttgactggaatggtattcgaaaaccatttgtatttgcgacagagaatgattcactaaatggtgtgtctatgctctttaattatctattaacaaatactccacaaatctttgctgatgtgcgtacttattggagtccagaggctgttgaacgtgtaacaggatatactttagagggtcgtgctgcagctggattcttacatctaatcaactctggatcttgtacattggatggtacaggtcaagctactcgagatggcaaacctgttatgaaaccattctgggagttggatgaaagtgaagtacaggctatgcttgaaaatacagacttcccaccagcaaaccgcgaatacttccgtggaggaggattctcaactcgtttcttgacgaagggggatatgccagtaacaatggtacgtctcaatcttttaaaaggggttggtccagtgctacaaattgcagaaggttacacacttgaacttcctgaagatgttcaccatactttagataatcgtacagatccaggatggccaactacttggtttgctccacgtttgacaggaaaaggtgctttcaagtctgtctatgacgtcatgaataattggggagctaatcacggagccataacatatggacacattggagcagacttgattaccttggcttctatgttgagaattcctgtcaatatgcataatgtacccgaggaagatatctttagacctaaaaattggtccttatttggaacagaagatctagaatcagcagactatcgtgcatgtcagttgttgggaccgctacataaataa

SEQ ID NO: 1628 - DNA, 729 bp, Streptococcus pneumoniae
atgtctcaagatgaaaaattaattcgtgaacagatttgtgatgtttgtcataagatgtggcaacttggttgggttgctgctaacgatgggaatgtatctgttcgattagatgaggataccattcttgcaacacctactggtatcagcaaaagttttattacaccagaaaagctggtgaagttaaatcttaaaggagagattttagaagcagaaggtgattactgtccttctagtgaaattaaaatgcacattcggtgctacgaagaacgtgaggatgttcgttcagttgttcacgcgcatccaccgattgcaacaggatttgctcttgcacacattcctttagatacttattcactaattgagagcgcgattgtggttggggcaattcctattaccccatttggagtaccgtctacaatggaagtgccagaagcaattacaccttatctgcccgatcatgatgtcatgctattagaaaatcatggagctctgactgtcggaagcgatgtcattacagcatactaccgtatggaaactttagaattagtcgcaaagacaaccttccacggaagaatgttactttctacaaagggcattgaggagcaagaaattgctcgtccgactttagaacgtctattctcaatgcgagaaaattataaggttacaggtcgtcacccaggctaccgtaaatataatggcgatggtagtataaaagaaacaaaaaaataa

SEQ ID NO: 1629 - DNA, 3087 bp, Streptococcus pneumoniae
gtgttccagaatatcttacaaaattatttgttattgaggaagttgtatgtaaataatgaggaaataaaaatggaaaataaaaaaatagcaaaacagattttaatagctacggctgttttaacaagttttttaggaagtaatttggtttatgcagatgtagttcaaagtaattctaataacagagctagtactgaaactgctagagtaacagggaataacttagaaaaacttattactaaagataaagaaattgataaagagatgacatatctttcagatatggattggtcttctgcaactcatggtgatatagataaaacaaaaacagtacaaaaagatgctccatttacaacaggaaataaaggagagcatactaagatttcattgctcacttctgatgataaagttaaatattttgataaaggaataggaacagtcgcagattctccatcagtaatcagctatgatatcagcggtcaagggtttgaaaaatttgaaacttatataggaattgatcaaagtgctaatagttctagatcagaccatgcagtagtggatagaatagaaatagaaattgatggaaaggttgtctattctagtagtgtaactaatccagaaggattcagatataatacccaggcacaatttattagtgtgacaattccacaaaacgctaaaaaaatatccttaaaatcattcgcaggagaacatacatggggtgatgaggttgtatttgctgatgctaaacttattaaaactgttagtactcaaactataactccagatcttcttaataaaggaattaatggaggagtatatctttctgatttagaatgggttgatgctactcatggtgatgacgataaatcaaaaacagttcagaaagataaaccgtttacacctggtaataacgggtctaataataaaataaaattactaattgacggtaaggaagtcgaatttaataagggattgggaactgtagcaagtaacccgtctagtataaaatatgatgtttcgggtgctaatgttacaagatttatttcctatgtcggaattgataggagtgcaaatcatttaaattcagattacgcagatattcaaaaatttgaagttgttgcggatggtaaagtcatttactcatcagattcaaaatatccaaaaggaattaagtatgatatatcggcatttctggttgatgttgaaattcccaaagatacacagacaatagaacttaaatcatattcagggaaatatacatgggctgacgaattggttttaggtggagccttgtttatggcaaatggtaaatttaagaatcctaatgattggtcagaagttgataaacgtcgtgaaattaataatgaacatccgttacttatgatgcctttatatgctaacggagaagagtttaaccaagggaaatatactttttggggaggagatacattaacaggtaagtgggagaatataccagatgacttaaaaccatatactgttatacagttacatccagatgatcttcctaaaagagatggagctgctagagatttttatgaacatatgctagaagaagcagcgaaatatgtaaatcctaagactggaaaaaatgaacctattccagttattctaacggtttacactgctggtaatatgccttattatacttcggcacattggttaagtaccagctggattgataaaatgtatcaaaaatatccaaatttgcatggtattttcagtactgagaattattggatttgggcaaatgatattgaaaataaggcggcagattacttaaaagtatcagctaaaaatggaggatattttatatgggctgaacaaaataatggttctgcaatagaaaaagcatttggaaaaaacggtaagatagcatttcagaaatctgttgataagtactggaagaaccttattttcatgttcaaaaatacacctgctgctgagggaaatgattcaactacagaaagttatatgaagggactttggctttcaaatcatacttatcaatggggtggtttgatggatacttggaagtggtatgagacaggtaaatggaaactgtttgcaagtggtaatatcggaaaaagtcaaggagatagacaatggttgactgaaccagagtctatgctaggagaagaagctttaggggtttaccttaatggaggtgtagtttataattttgaacacccagcttatacctatggtgtaaataataaagaaagcttactctttagcgaagtaataaaagaattttttagatatgtaatagcgcatccagcaccatccaaagaaaaggtacttgaggatacaaaagtattcatacatggagactattcaaataaaggaaatggtaagttctttgtaaacgtaaatactgatagagaacaaactccattatacatgactggtcgttataatgttattccagctattccaggtgttttaaaaacagataaattgaaagagtctgtttctggtagccgtattcagattaaggaaatcacttctccagaatttagctctactcaggctagaaaagaatacttaaataagctgtatcctatgaattatgaaggagatatctttgctcagaaattagataatagatggtttgtctataattataaggtaaatgagaatgttaaacagactgggaaattaaaatttaattctttagaaatggatgttgaatttgaacctcatacctatggtatttttgagagaataagtaatggattgaaagtgaatttaaataattttagaacaaataaagattcactatggtctaatgctcaagatgcaaatcaggcaaagaaactaccacaattgaccaagaaaggtgcgattaagtggattgaagaacattatatcaaagatactcagtttggagagaaaagggttacaaagatagtattaagaggtatagataaacttcctactattcattcattatcaggaacaaataattcctatgatcagccatctctcaattttgatcagaaaaatcatatggttactattaccattaacagtaacggaaatcttgaattcgaacttcatttttag

SEQ ID NO: 1630 - DNA, 2214 bp, Streptococcus pneumoniae
atgacgatttatattaataaggacgagaccgtttttcatttggcaatgaaagatagtagttatatttttagaattttagaaaatggggaacttcaacatctacattttgggaaaaggattcatgtcaaggaaaattataaccaattgatggcctatgaaaaaagaggatttgaagtatctttttctgaagaatttgaggatattcaacagtctatgatacaaaatgaatattcttcatatgggaaaggagattttcggcatccagcctttcaagttcaaggaatgaatggtagtaggataacgacactaaaatatcaaggttttgaacttgaaaaagggaaaaatcgtcttaactctctaccttcaacatttgatgatattggtcagtgtgcggaaacattaacgattattttaacagattccatattagatttaactgttagactaaattacacaatttttccggaatacaatgtcttagttagaaatacggaatttttaaataatagcaataataagttgactcttttgaaagcaatgagcttacagctagatctacctgatagtcaatatgactttattcaattttctggagcatggctgagggaacgtcagttatatagaacttcgcttagaccaggtattcaagcaatagatagcttgagatactcatcaagtcctcagcaaaatcctttctttatgctatcaaggagggaaactacagagcatagtggtgaggtttatggttttaactttatctattctggaaattttcaaaatatgattgaagttgaccattttgacaccgctagagtaacggtaggaataaatccagtagaatttcgttttttattaaatcctgccgaaagttttgtgacaccagaagcaattgtgatctattctgatcaagggatgaatcagatgagccaacaactatcagatttttatcgacatcatttagttaatcctaatttttctcaagctagtcgtcctataatactcaatagttgggaaacattttattttgacttgggtacagaaaaaattttagatttagcaaaggctgctaaagatttagggatagaattatttgtactggatgatggttggtttggtcataggaaagatgacaaaagttctctgggggattgggtaacagatagaagtcgccttcctgaaggtattggatttcttgcagatgaaattcacaaaataggtttacaatttggtttgtggtttgagcctgaaatgatttctattgatagtgatttgtacaagaatcatgccgattggactatccatttgttagacagagagaagtcagtaggaagaaatcaatatgtgttggatttgacgagacaggaagttgttgattacctttttgattctatttctaaaatcataatcaaaacaaatctggattatatcaaatgggatatgaatcgtcatataacagatatttatagtattgaacttgattctgaacagcagatggaatttggtcatcgatatatcttaggtctttatcagttattagatcgtttaataactaagttcccttcagttctatttgaatcttgttcttcaggtggtggacgttttgatttaggacttatgtattatgcaccgcaagcgtggacgagtgatgatacggacccgatagaaagattgaaaattcagcatggaacttcttatggatattctccatcaatgatgacagcccatgtttctatttctccaaatgaacaaagtagaagacaaacgagtttggacactaggacaaatgtagcttattttagttctttcggttatgaattagatgttacgagattgtcggtagaagaaaaagaacaagtgagagaacaaattcagttttataaaaaatatcgttcattgtttcaatatggggatttctataggataaacagtccttttagttgtgattctgctagttggcaagttgtttcaaaagataaatgccaatcgattttattgtatgctcaattgaatagtaagttgaatccaggttatacaagagtttattttagtggtttagataaagataaatgctattccgtctctggatttgatgagttcttttatggagatgaattaatgaatgctggaataaaagtcagtttaagtaatttagcactatgtgttccagaatatcttacaaaattatttgttattgaggaagttgtatgtaaataa

SEQ ID NO: 1631 - DNA, 1872 bp, Streptococcus pneumoniae
atgaaaattgaaaataaaaatgtaagacgtaatttcttttggggagatggtcgattttatactactgatatcgtaaacaaacgggcaggagtaatgatagaaaatgtttcgaaagaagaatttaccattacattggagaatggtataagactttcttcaaatcatttttcagcaatcgttagggaagagggagatacgcgaattcaggtttcttttgtttgtccttccattcgtttacgtttaatctttgaatcgagggatgatgttctttcgaagcaattagttttagaatcatctactgaggttattaaatctgtagaggtagagagttttgagtttgaaacagaagacaatattttctatccgaaaagacaagattgtattaaggaaatggcgaatttttccggtcattatgtagaattgggacaacctgtttatgcgaattctttattcttaggaatggaatttccaatgtctgaaaacaaggtagatggtagacactatgtatcaagatattacttgggaactgttgtaaatcaagaaaagagtttgtggtcttgtattattgggggagcatgttcttataaaaaagaagagattcaagaggcattttttgaatatgttgaaggaatagctcaacctagttatttccgtaaacagtataattcctggtatgaccatatgaccgatattacagaggaaggtattttaaaaagtttttctgagattcgagatggatttgaaaatcatggagttcatttagatgcttatgttgttgatgatggttggacaaactatcaatcagtttgggaattcaatcataaattcccaaatggtttgagaaatattaaacatcttgtaaatggatttggttcaagcctaggattgtggattggtccccgaggtggttataatgggacagaaatcattatgagtgattggttagaagcacatccagagttaaatattggatctaaaaatttgatttcaaatgatgtaaacgtggctgattttaactatctcaatcaaatgaagaaaaagatgttggaatatcaaaaagaattcgatatcagctattggaaaattgatggttggttacttcaacctgacaaacctgataagagtggaccgcacggtatgtataccatgacagcggtttatgagttcttaattcaactgttgatagatctaagaaaggagagaggaggaaaagattgttggttaaacttgacttcttatgtaaatcctagtccatggtttttacagtgggtcaatagtttatggattcaaatatctcaagatgtaggctttacagagaatgcaggtaatgatatcaatcgtatgattacttaccgagatagtcagtatcaagaatttttggaaaaacgtgagatacagttacctatgtggtcgctttataatcatgaaccaatctatgctgtcagtgcaaatacctggtacatggatcatcaaatgtttgcatcaataccagattttgaagcttatctattatttatttcaacaagagggaatgctttttgggagtttcactattcttttgatatgtttgatgaagaacgctggaaagccaatgctcgtgccgtcaaatggatagaggagaattatcaaacactaaaatatagtaaaaaaataggaggaagtcctgaaaaatttgaaatttatggttataagtgtcacaatcagaagacttctactgaaattctctctctgagaaatcctgctcagattaaacaaaaaataaaaatagagaatctttcgatagagaattttaccagagtaattggagattttactattcaagaagatgagatagaattggcaccgtactctatcgtgatactgaagaagtaa

SEQ ID NO: 1632 - DNA, 1320 bp, Streptococcus pneumoniae
atgaaacatacacttgaaactatcaatagtagaactcagtggtttagagaagcaagatttgggatgttcattcattgggggttatattctattccaggaaaaggggaatggattcgtagtcatcagaaattatctattgaagattatgaaccatattttcgagcttttgatcctaaggaatataaccctagagaatgggctaaacaagcaaaagctgcagggatgaagtatatggttttaacggctaaacatcatgatgggttttgtttgtttgattcaaaatttacagattataaagcaacaaatacacctgcaggtagagatttagttaaagaatttgtagatgctgttcgagctgaaggtttaaaagtaggcttatattttagtttgattgactggcaccatcctgatttccctaaatatgctgatctaaatcatccaatgagaggaaatgaagcctatcgagatgagaaaattaactttgacagttatttggagtatttacacaatcaagttaaagaaattgtaactggttatggtcagattgacatattatggtttgattattcttatgaagacatggtgggtgaaaaatggggagcttcaaaattaatagacatggttcgtcattatcagccaaacgttatcgtagataatagattagaaacatcaggtgaaggattcggaagtatcgttacagatgaaattacctcttacgctggagattttgttagtccagagcaaattgttcctcacgaaggtattcgaaactttaaaggtgaacctgttccttgggaactttgtctaactatgaataacaattgggcttataatcctacagattatctatataagtctagtcaaactttgataagaaagttagtggaatgtgttagtaaaaacggaaatatgattcttaatgtaggcccagatgctttgggaagaattaatgattcaagtaagaaaatattagataattttcatcgatggatgtctcgaaatggtgaggcaatttatggatgtagtggagatgaaaatttaccaaaaccagattggggatactatactcgtaatggaaatacggtttatgctcatgtatttgaacaacctataggtcctttagctcttcttggtattagtaaagaaaacgtaaaaagaatgagctttcttcatgatggaagtgaggtgaaaatttcagaaagctggacgaccaatgcctacaaaggaatttgttttgcacagtttggagaagttccacattttacctatccattaccagacttgattgatagcgtaatcaaaattgagttgagagagtag

SEQ ID NO: 1633 - DNA, 186 bp, Streptococcus pneumoniae
atgaatgaacatcccaaatcttgcttctctaaaccactgagttctactattgatagtttcaagtgtatgtttcatccttttactgctcctcctcctaaagcttcaatgaagtatttacttgtaaatgcgaatagaatgattggtggtaatacgattacaacaatagctgaaaatagaccattataa

SEQ ID NO: 1634 - DNA, 885 bp, Streptococcus pneumoniae
tattttattcagagaaagaaaaagactgaaaggtgggaaatgattatgaatacacatataaatggtattagtaaaaaaggcaaagttcttatatatggttatatgctccttaccattttaatttctattttccctattgcgtggatttttttatcatcattaaaagcagatcctatgaaaaatccaggtattagtttaccgactgactttactcttgaaggttatataaatgtttttacaaaacttcatgttttcacttacttttggaatagctttaaagtagtgtctatatcagttattattagcattgttatgatctccatgtcttcatatgttattgctaggatggaatttagagggaagaagttggtgacttctatgctgtattctactctatttattccagcaacagctatgacttttccagtttatagattagtaaatgagttggggatttataataccccagttgctctaattctggtctactcttgtagtggaattgctatgagtttctttattataaagaactattttgaaattattccaaaagaattggaggaggcagcagagattgatggtgcgacatatgctcaaactttttggaaagtgatgttaccaattgctagaccaggaattttaacagcagcagtacttgcctttattaataactggaatgaatattattgggcatctatgttggtgattgataaaaatgaattaacagtaccagcattactaggtcaatttactacaagttttaatactaattataatggtctattttcagctattgttgtaatcgtattaccaccaatcattctattcgcatttacaagtaaatacttcattgaagctttaggaggaggagcagtaaaaggatga

SEQ ID NO: 1635 - DNA, 930 bp, Streptococcus pneumoniae
atggcacaaaaaattatgagcctacaaaataggaagaatcaaaaaagacgatttatctttttatttcttttgccaacgttgatttgtttctttctattttatttttattctgtagtaacaatctttttaacttcatttgctaaatgggattatacaaatttaaacacccctgagtttcttggatttgataaattatttgaaaattataggtatgtttttaaagaatacccattttttacagaagctctaattaattctgttcgttgggctgtaattggtgttattattcaagttcctttagctgtatctgttgcaattacattatctaagaaattaaaaggctggaagatatctaggaatctttatattgtaccaagtatcatttctagtgctgctatgggcttgatttttcttcaaatctataatccaaactatggtgttgttaaccaaattattcatctatttaatccatcgtttaaagattcagtactgttgactccaggattaaatatagtagctatgactggcgcttatatcttctttgcaggagcatcaaccattatgattcttgggcaaatttttgctattccagaagaagttcaagaagctgctattttagacaatattactggttggaggaaagagtggtatattacgattccgatgattaaggggacaattaaaactgtttcaattatggcagcaacttcagggtttttgctctataacgaagtattctttttgacaaatggtgctgcaggaacaaaaagtatcagttttgttattcgagaattagcagtggctagctcacgaactcagtatgctcgtgcaaatacaattggagttatacaaattttaggtggaatgttgattatcgtttgtattaatattttattcagagaaagaaaaagactgaaaggtgggaaatga

SEQ ID NO: 1636 - DNA, 1293 bp, Streptococcus pneumoniae
atgaacaaaaaaagtcttttgaaatgcgctgttatcgggttagtagctacctttggtttagcagcttgtggaacatctaaggatgcaagcggtggaagttcttctggtaaagaagtattagaattttatcatgggtatcatcatagtgaagatgaatggcctgtagcgaagactatgcgagatttatatgataaatttgcagaagaacataaagatagtggtgtagaatttaaaccaacccctgtaaatggtgatttgaaggatataatgaataacaaggttgctagtggtgagtttcctgatgtgattgacctagcaggtaatgcagtatcattagctgcgattgaacaaaaacttgttttagatttgaaaccatatatcgattcaaataagcttgaaaaaaatgttggtttgaactataagcaaaaccaaaaagatggaaaaatttatacagttcacgaacagttatttacaatgggtttgtggtacaacaaggacatatttgcaaaagcgggtgctaagacacctgatcagtggaatacttgggatgatttcactcaggcaatggcaagcattagaaaacaagatggagtgtatgcatttggtgctggagaaccatctattcgcttgtttaatacagtattaggaaccacagaaaatggacgtaaattattagacaagccattaacaaaagaaggaattgaatctaaagaatttgcagatgctttgaaaatggttatgaaagaaattcaagctaatggttctaagaatgctggtggcgatgccaatgcttattccaaagatttccaagaaggtaaatctgcagtcttctttaatggtgtgtgggcttctggtgagatgtctaagaacccaagtcttgcacctggaatctatcctgcaggtgtagcaattagttcttctggaggtggtatcactatctcaagtaagatgtctgaagctaaacaaaaactagctcttgagtttttgaaatatatgactagcgatgatgtacaaaaagtaatttttgaaaaagtaggagcaaatccttctaatgaaaatgtaaatgtaaaagaactttcagaaaagagttcagaagctactactaaaattttaggacaagcaatcactcaagttaagaatgcaaaagcagttgttccaactgtaagtgatgtttggggtggcgatgtacacacagctattatcaatgcattgacagaaagtgctgctgaaaatgtagatgttgatcaaaaagtaaaatctactcaagatgtgttgaaatcattgattggttaa

SEQ ID NO: 1637 - DNA, 1404 bp, Streptococcus pneumoniae
atggaagcggttttagcaatagatttaggtgcgacttctggaagagcaatcgttggttacctttctgaaaataaactagtaatggaagaaataaatcgcttttctaatctacctattagagtaaaagggcatttatcttgggatattgactttctactagctaaaattcttgaaagtatccgcttggctaatactagttacaagattttatctatcggtattgacacatggggagttgattttggactgattgataatgaaggtaagctgttattacaacctgttcattatcgtgatgaaagaacaaagggagtgttaaaggaaatatctgaaatgactgaattagaaaaactgtattcagagacaggaaatcagattatggagataaataccttgtttcaactctttaaggcacgtcaagaatctcctgactctttctataagaccaataagattcttttaatgccagatttgtttaattatctcttgacaggtaagtttgctacagaaaaaagcattgcttcaacaactcaattatttgatcctaggagtcaaaattggaatcagaatatcttaaaactatttgaattggattcatctttacttcctgaaattgtttcagagggaaatgttcttggaaggataaaagaggagtatggtttaggcgatattcctgttgtgaatgtttgtagtcatgatacagcaagcgcgattgtctcagtacctaagacagaaggtagtttatttatttcatcaggtacttggtctttggttggagtggaacttacttcaccgattcttactaccgaatccttcagttatggatttacaaatgaagtcggtaaagatggagtgattacatttctgaagaattgtacagggttgtggatcatagaggaactaagacgttcatttgaacgaagagggaaagcctattcttttgatgatattaggacaatggtggagaaagaaaaagaaaatcttcctctgattgatactgaatcaactgaatttgcaacagaatctgatatgcacaagactttgacagaatatctagcttatcatcatgaaactagagagtggacagatggacaactatttaagattgtttatgaaagcctagctgaaacgtataggaaagcgatagagttactagaagaactaactcataaggtttataagaggatatatgtgattggaggaggtgctagagccagttactttaaccaaatgattgctgatagaactggtaaagaggttcttacaggttcgactgagggtacagctgtggggaatattgttgtgcagctattgagtcaaggtaaaataaacgaggatacagagttaaaggatattatgacaaatattgctgatacacaatattattatcctcagctatcataa

SEQ ID NO: 1638 - DNA, 177 bp, Streptococcus pneumoniae
atgaatattgggttaacatttgaacattattcaagtaagcgttcacatattgaaaaaataaaacgtggggattataataaagttaatcaaggacgaagagagaagaaaaatggaagcggttttagcaatagatttaggtgcgacttctggaagagcaatcgttggttacctttctga

SEQ ID NO: 1639 - DNA, 774 bp, Streptococcus pneumoniae
atgataaaagatgaacgtgtacttgaattgattgaaattattataaagaaaaaaagaattgccgtaaaagagctggcagaaatcactttctccagcacaagtaccttacgtcgtgatttaattttcttagaaaatcaaggtcttatcaaaagaaagcacggatacgtgaccctgtcctctatgaacacaattgaactttctcatcaaatacgggaaggagaaagtactaggcaaaaaagactaatcgctagtctcgctaaagactttattcggtctggtatgtgtatctatctggattccagtacgactgtctacgaactctgtccctatctttctgaacttgataatttgattatttttacaaatggtttacatactgcacaaaccctatctgaaactgttaaagatagctccaaaatctttatcacatctggcgaggtcaaacatcaatcctgttccgtggtcaactatgataaggaaaattctttattagatcattttaatatcgatttagcattttgttcagcaagaggtattgatgaccaatatgtttatgaagcttctctcagccaagctatttcaaaaaagaatattattgacaaagcccatgaaaccatcttactgattgatagttctaaattttacaagactggattttttaaaattaatcccctatccaaatacacaacctttatttctgacaccttgccagaccaaaaattattagatgcagtagaattatttgatggagaatgggtttctgatattcaatga

SEQ ID NO: 1640 - DNA, 219 bp, Streptococcus pneumoniae
agactttgtcgcctagaccctatatttcaagaattaagtgaccttgatgatctaaatgtattgtggtatactatttttgtcatcggttaccgattacgttcctatgggttcgtgagaggaggtgaaactaatgagccttatcatagagctcgctcttactattatagcggatgttatagctggaattatcttgtatttcgtctgcagatggctagatag

SEQ ID NO: 1641 - DNA, 207 bp, Streptococcus pneumoniae
tctacaatagttcaagtattaagtgaggttgatgatctaaatttagtgtggtatactatttttgtcatcggttaccgattacgttcctatgggttcgtgagaggaggtgaaactaatgagccttataccagagcttgctcttactattatagcagatgttatagctggaattatcttgtatttcgtctgcaaatggctagatggtaa

SEQ ID NO: 1642 - DNA, 1506 bp, Streptococcus pneumoniae
gtgaaaaaaattagcttattactagccagtctatgtgccttgtttttagtggcttgttccaatcaaaaacaggtagatggtaaactcaatatcgtgacaaccttttaccctgtctatgaatttaccaagcaagttgcaggagatacggctaatgtagaactcctaatcggtgctgggacagaacctcatgaatacgaaccatctgccaaggcagttgccaaaatccaagatgcagataccttcgtttatgaaaatgaaaacatggaaacatgggtacctaaattgctagataccttggataagaaaaaagtgaaaaccatcaaggcgacaggcgatatgttgctcttgccaggtggcgaggaagaagagggagaccatgaccatggagaagaaggtcatcaccatgagtttgacccccatgtttggttatcaccagttcgtgccattaaactagtagagcacatccgcgacagcttgtcagcagattatcctgataaaaaagagacctttgagaagaatgcagctgcctatatcgaaaaattgcaatccttggataaggcttacgcagaaggcttgtctcaagcaaaacaaaagagctttgtgactcaacacgcagcctttaactatcttgccttggactatggactcaaacaagtcgcaatctcaggcctttctccagatgcagagccatcagctgctcgcttggcagaattgacagagtatgtcaagaaaaataaaatcgcctatatctattttgaagaaaatgcctcacaagcccttgctaacacactttcaaaagaagcaggtgtcaaaactgatgtcctcaatcctttagaaagtctgacagaagaggacaccaaggatggagaaaactacatttccgtgatggagaaaaacctcaaggctttgaaacaaacaacagaccaagaagtcccagcaatcgaacctgaaaaggcagaggataccaagacagtccaaaatggttacttcgaggatgcagctgtcaaggaccgcaccttgagtgactatgcaggtaactggcaatcagtttatcctttccttgaagacggcacgtttgaccaagtctttgactacaaggctaagttgactggtaagatgacccaggctgagtacaaggcttactatacaaaaggctatcagacagatgtgactaagattaacattactgataatactatggaatttgttcaaggtggacaaagcaagaaatacacttacaagtatgtcggtaagaaaattttgacttacaagaaaggcaatcgtggcgtgcgtttcctctttgaagccacagatgctgacgctggacaattcaaatatgttcagtttagtgaccacaatgttgccccagttaaggcagaacatttccatatcttttttggaggtacaagccaagaagctctatttgaagaaatggataattggccaacctactacccagataacctatctggccaagaaatcgcccaagaaatgttggcgcattga

SEQ ID NO: 1643 - DNA, 807 bp, Streptococcus pneumoniae
atgcttagtttattatcttacgactttatacaacgcgcctttttggcggttattgctatgagtcttttctcaccggtattgggaaccttcctcatcttgcgtcgtcagagtttgatgagtgatacccttagccacgtctcactttcaggtgtagcctttggtctggttttggggatttctccaactgtttctactattgccattgtcttgattgcggcggtctttctggagtatctccgtacggtttacaagagctttatggaaatcgggacagctatcctcatgtcaacaggtctggctgtttctctgattgtcatgagcaagggtaaaagctcgagttcaatgagtttggaccaatatctctttggttcgatcgtgactatcagtgaagaacaggtcatttccctctttgtcattgcggcggttgttttgattttgacctttctctttcttcgtcctatgtatatcttaacttttgacgaagatacggcctttgtggatggcttgccagttcgtaccatgtccattctttttaacatggtgacaggggtggctattgcccttatgattcctgcagcaggagctcttctggtatcgaccattatggtcttgccagctagtattgccctgcgtctggggaaaaactttaaatcggttatgctgcttgccagtgcgattggctttttgggaatggtagcaggactttacatttcctactatgcagaaacacctgcaagtgcaagtattaccattatttttgtaactgtctttatactaatcagtttagtaagacgttttatcaaatag

SEQ ID NO: 1644 - DNA, 705 bp, Streptococcus pneumoniae
atgagatatattacggtagaggatttgtccttctattatgataaggagcctgttcttgaacatatcaattattgtgttgatagtggggaatttgttaccttgactggggaaaatggagcggctaagacgacgctcatcaaggctagtcttggaattctgcaaccacgcattggaaaggtggctatttcaaagacaaatacgcaaggtaagaaattgagaatagcctatcttcctcaacaaattgccagttttaatgctggttttccaagtacggtctatgaatttgtcaagtcgggtcgctatccgagaaaaggctggttccgtcgtttgaatgctcatgatgaggagcatatcaaggctagtctggactcagttggcatgtgggaacatcgagacaaacgcttggggtctctatctgggggacaaaagcagcgagcggtgattgcgcgtatgtttgcttctgaccctgatgtgtttatcctagacgagccgacaacggggatggatgcaggaagtaaaaatgaattttacgaactcatgcaccacagcgcccatcatcatggcaaggctgttttgatgattacccatgaccctgaagaagttaaggattatgcggatcgcaatattcatctagtccgtaaccaagactcgccatggcgttgtttcaatgttcatgagaatggccaggaggtgggccatgcttag

SEQ ID NO: 1645 - DNA, 192 bp, Streptococcus pneumoniae
aattcatttttacttcctgcatccatccccgttgtcggctcgtctaggataaacacatcagggtcagaagcaaacatacgcgcaatcaccgctcgctgcttttgtcccccagatagagaccccaagcgtttgtctcgatgttcccacatgccaactgagtccagactagccttgatatgctcctcatcatga

SEQ ID NO: 1646 - DNA, 501 bp, Streptococcus pneumoniae
atgtcaaagaatagtatttttctcttaaaaaagagaagtctaaaaggaaaggagtcagatatgagacagctagcaaaggatatcaatgcttttttgaatgaggtgattttgcaggcggaaaatcagcatgaaatcctaataggtcattgcactagcgaggtggccctgaccaatactcaggagcatatccttatgctcttgtcagaggaatctttaacaaattcagaattggcccgtcgtctcaatgtcagtcaggcggcagttaccaaggccattaagtctttggtcaaggaagggatgttggaaacatctaaagattctaaagatgcgcgtgtgattttttatcagttgactgacttggctcgtccaatcgctgaggagcaccaccatcaccatgagcatacacttttaacctatgaacaagtggcgactcagtttactccaaatgaacaaaaagtgattcagcggtttttgactgctttagtaggagaaatcaaataa

SEQ ID NO: 1647 - DNA, 1284 bp, Streptococcus pneumoniae
ttgtggagctacaaaatgcttaaacgcttatggatgatcttcggaccggtcttgatcgctggtttgttggtttttctgctcattttcttttatcctactgagatgcatcataatctaggagctgaaaagcgttcagcagtggctactactatcgatagttttaaggagcgaagtcaaaaagtcagagcactatctgatccaaatgtgcgttttgttcccttctttggctctagtgaatggcttcgttttgacggtgctcatcctgcggtattagctgagaaatacaatcgttcctaccgtccttatcttttaggacaggggggagctgcatcgcttaaccaatattttggaatgcaacagatgttaccacagctggagaataaacaagttgtgtatgttatctcacctcagtggttcagtaaaaatggctatgatccagcagccttccagcagtattttaatggagaccagttgactagttttctgaaacatcaatctggagatcaggctagtcaatatgcagcgactcgcttactgcaacagttcccaaacgtagctatgaaggatctggttcagaagttggcaagtaaagaagaattgtcgacagcagacaatgaaatgattgaattattggctcgttttaatgaacgccaagcctccttttttggtcagttttcggttagaggctatgttaactacgataagcatgtagctaagtatttaaaaatcttgccagaccagttttcttatcaagcaatagaagatgttgtcaaagcagatgctgaaaaaaatacttccaataatgagatgggaatggaaaattatttctataatgagcagatcaagaaggatttgaagaaattaaaggattctcagaaaagctttacctatctcaagtcgccagagtataatgacttgcagttggttttaacacagttttctaaatctaaggtaaacccgatttttatcattccacctgttaataaaaaatggatggactatgctggtctacgagaggatatgtaccaacaaacggtgcagaagattcgctaccagttagaaagtcaaggttttaccaatatagcagatttttctaaggacggcggggagcctttctttatgaaggacaccattcaccttggttggttgggttggttggcttttgacaaggcagttgatcctttcctatccaatcccacaccagctccgacttaccatctgaatgagcgctttttcagcaaagattgggcgacttatgatggagatgtcaaagaatttcaatag

SEQ ID NO: 1648 - DNA, 240 bp, Streptococcus pneumoniae
atggatatcaaatcagaagttattgaaattattgatgagttgtttatggaagatgtttctgacatgatggatgaagatctttttgatgcaggtgtcttggatagtatgggaacggttgagttgattgtggagattgagaaccgttttgacattcgtgtccctgtaacagagtttggtcgtgacgactggaatacagctaataaaatcatagctggtattgtggagctacaaaatgcttaa

SEQ ID NO: 1649 - DNA, 1245 bp, Streptococcus pneumoniae
atgatggagttttttcaacagcttcctcatttagagccatatggcaatcctcagtattttgtttatgtgattgctgcaaccttgcccatctttataggcctctttttcaagaaacgctttgcctggtatgaagtgttggtaagtctcttctttattgtcaccatgttggtgggtggaaagaccaatcaactagctgccttgggtatttacctttgctgggaaatattgctcctgcttttctacaagcattatcgaaaaagcaaggatggcaagtgggtcttctacttagttagttttctgtccctacttccgattatctttgtcaaggtgcaaccagctatcaatggaacgcagtctttgcttgggttcttgggaatttcttacctgacctttcgttctgttgggattatcatcgagctgagagatggagtgattaaggattttaccctctgggaattcctccgtttccttctcttcatgccaactttctcgagtggtccaatcgatcgctttaagcgatttaatgaaaattatcaggccattcctgagcgagatgagttgatggatatgctggatgaatctgtccgctatatcatgcggggctttttgtataagtttatcctagctcatgttttaggagagaccttactccctcctctgaagaatttagccttgcagtcaggtggcttctttaatctctatgccttggcagttatgtatacttttggtctggagctcttctttgactttgcaggttattctatgtttgctttggccatctcaaacttgatgggaatccgtagccctatcaactttaacaagccctttttatcaagggatttaaaggagttttggaatcgctggcatatgagtctgtctttctggttccgtgactttgtctttatgcgaatggtgatggtgttaaccagaaagaaagtctttaaaaatcgtaatgtaacctcaagcatggcctacattgtaaatatgctgattatgggattttggcatggcgtgacctggtactatatcgcctatggactctttcatggactaggcttggtcatcaatgatgcctgggttcgcaagaaaaaaacgctcaataagaaacggaaaaaagcagggaaggctgccctacctgagaatcgctggattcagtttcttggcatggttgtcactttccatgttgtcatgttgtcattcttaatcttttctggattcttgaataatctatggtttaaaaaataa

SEQ ID NO: 1650 - DNA, 1551 bp, Streptococcus pneumoniae
gtgtcaaataaaccaatagcagatatgattgaaaccattgagcattttgctcagacacagcctagctatcctgtctataatgttttggggcaggaacacacttatggcgatttaaaggctgattcggatagtttggctgcagtcattgaccaactaggcttgcctgagaagtctcctgtggttgtttttggtggccaagaatatgaaatgttggcaacctttgtagcgctgactaagtcaggtcatgcctacattccaattgatagccattcggccttggagcgagtttcagctattttagaagtagcagagccaagcttgattattgccatttcagcctttcccttggagcaggtttctacaccaatgataaatctagctcaggttcaagaagcctttgcccaagggaacaactatgaaatcacgcatccagtcaagggagatgataattactacattatctttacttctggtacgactggtaagcctaagggagtgcagatttcacatgataatctcctcagctttacaaactggatgattacggataaggaatttgcgacaccgagtcgtccgcaaatgctggcacagccaccttattcttttgacttgtctgtcatgtattgggcaccgaccttggcacttggtggtacgcttttcactcttccttcagtcatcactcaggactttaagcaactctttgcggctatcttttcattgccaatcgctatctggacatcaacaccatcctttgcagatatggccatgttgtctgaatacttcaacagtgagaaaatgcctggaatcacgcatttctactttgatggtgaagaattgacggtcaaaacagctcaaaaactgcgcgagcgtttcccaaatgcccgtatcatcaatgcttacggcccaacagaagcgacagtagctctgtcagcagttgccgtgacagacgagatgttagcgactctcaaacgcctaccaatcggctataccaaggctgattctccaacctttatcattgacgaggaaggaaataaactgccaaatggtgagcagggagaaatcattgtttctgggccagctgtttcaaaaggttatatgaacaatcctgaaaaaacagcagaagccttctttgagtttgaaaatctgccagcctatcacacaggcgatgtgggaaccatgacagatgagggcttgcttctctacggcggacgcatggacttccagattaagtttaacggttaccgcattgagttagaagatgtctctcaaaacctcaacaagtctcgctttatcgaatctgctgtcgcagtaccgcgctataacaaggaccacaaggtacaaaatctattggcttatgtcatcttaaaagacggtgttcgtgagcagtttgagcgagatatcgatattaccaaggccatcaaggaagacctgacagacatcatgatgtcctacatgatgccatctaaattcctttaccgagacagtttgccactaactccaaatggaaagattgacatcaaaggattgattaacgaggtgaataagagatga

SEQ ID NO: 1651 - DNA, 198 bp, Streptococcus pneumoniae
aaaaataagctagtaagaatcactcttattttagcgaaaaattacagaaatgaatggtttttcttgatgaaacagagaaaagaattgtacctctttcttggtcggacagccttgtattttcttatctttctagggctgctttacttctttagctatcttggtcagggtcaaggaagctttatctataatgaattttaa

SEQ ID NO: 1652 - DNA, 522 bp, Streptococcus pneumoniae
ttggaaattttttcaaatacgatttgggtttcttccattatacttgtttttgtaacggagttattaaataaaacggaaagttactggggatattctaatacagcatactctattggtattataattagtggcttaattgcttttaggctatctgaaaagttccttgctgctaaatgggaaagtattctttttcctcttgtagctatggcaatagtgacactgactattctatattttccaaacgcacagatgtttttattattttcagctttagttggtatgttatcgcaactaaaagaagttcctgaaagtgtatttcttcaggaaacagtagaggaaaatcatttagttaatgtctattccgttcttgaagtgatttctacattagcattttcagtatttgttttgctaatgagctatattactgagagttttggtattagcatcagtttttggctatcagccatttgtctgatgatagaagctattttaatttatatcagacgagattattttaaatga

SEQ ID NO: 1653 - DNA, 711 bp, Streptococcus pneumoniae
atgtctaattcatttgtcaagttgttagtctctcaattatttgcaaatttagcagatattttctttagagtaacaatcattgctaacatatacattatttcaaaatcagtaattgccacatcactagttcctatcttaataggaatatcctcttttgttgcgagtcttttagttccgttggttactaaaaggttagcgctaaatagggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaaggctaattcagccttatcaatgactggtgaagctgttcaattgataggttggggattaggtggactcttgtttgcaacaattggtctgttacctaccacgtttatcattttagtcttgtatatcatttctagctttctgatgttatttcttcctaacgctgaagtggaggtgttagagtcagaaactaatcttgaaattttgctcaaaggttggaagttagttgctagaaatcctagattaagacttttgtatcagcaaatttattggaaattttttcaaatacgatttgggtttcttccattatacttgtttttgtaa

SEQ ID NO: 1654 - DNA, 186 bp, Streptococcus pneumoniae
ggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaa

SEQ ID NO: 1655 - DNA, 189 bp, Streptococcus pneumoniae
gataaagataaaaccctatttagcgctaaccttttagtaaccaacggaactaaaagactcgcaacaaaagaggatattcctattaagataggaactagtgatgtggcaattactgattttgaaataatgtatatgttagcaatgattgttactctaaagaaaatatctgctaaatttgcaaataattga

SEQ ID NO: 1656 - DNA, 993 bp, Streptococcus pneumoniae
atgagccccatttgtgaaccccatttctcagatacgagttatggtttcagaccaaataggtcatgtgaaaaagccatcatgaagctcttagaatacttaaatgacggctatgagtggatagtggatatagacctagagaaatttttcgatacagttcctcaagatagattgatgtccttagtacataacattatcgaagacggagatacggaatccttgattcgtaagtatcttcattcaggtgttatcattaatggtcaacgttataaaacactagttggtacaccacagggaggaaatttatctcctctcttatccaatatcatgcttaatgaattggacaaggaattagaaaagaggggacttcgatttgtgcgctacgcagatgattgtgtgattacggtcgtaagcgaggcagccgctaagcgtatgatgtattcagtcagtcgttttattgaaaaacggctaggtttgaaagtaaacatgaccaagactaagattaccagaccaagagagttgaaatatctaggttttgggttctggaaatcatcagatggttggaaaagtcgtccacatcaagatagtgttcggagatttaagcttaaattgaagaaactaacacagaggaaatggagtatagacctaacaagacgtattgagcaactgaatttgtctattcgaggatggataaactatttctcattgggaaatatgaaaagtatagtcgccagcatagatgagcgcttgcgtactcgcctacgagtgattatctggaagcaatggaagaagaaatcgagacgattatggggattgcttaagttaggggttcctaaatggatagcagataaggtatctggctggggcgaccattatcaattagtagctcagaagtcggtacttaaacgtgctatatcaaaaccagtcctggaaaaacgtggactggtttcgtgtttggattattaccttgaacgacatgcgttaaaagttagttga

SEQ ID NO: 1657 - DNA, 282 bp, Streptococcus pneumoniae
atgtcaaaattgctagataagatattatcacgcgaaaatatgctggaagcctacaatcaagtaaaatccaataaaggctcagctgggattgatggaatgactatcgaagagatggataattatctcagacaaaactggcgcttgactaaggaactgataaaacagagaaaatataagcctcaaccagttcttagagttgagatacctaaaccagacggaggtatccgtcaactaggaattccaacagttatggatagaatgattcaacaggccattgtctaa

SEQ ID NO: 1658 - DNA, 246 bp, Streptococcus pneumoniae
agcctccttatccgctatatacgccttactatcacgttcctgttcgtagagccacgatttcgctatcccttcctctccctgctacctcacgatagtcaggcttgggaatcgctattgggttcaccggtagcaggtgcccaccgaggacttacacctcagatatacgacatgcccgtcgtactacaaaaaaacgacgatttaaatcgtcgttttgctaagataaatatgcattttttttttttttga

SEQ ID NO: 1659 - DNA, 198 bp, Streptococcus pneumoniae
atgcttaatgcgaaaattttttatatatttttatgtttgatcgttatcgaaactacaggcttgttgttgttgaaaagaggtctcgaaatgggttatttagacacagaagctattatcctcgcagttttttcatttgctttttacaacctatgttcattcgcttgggtctgctctacaataaaaaacaataaaaaataa

SEQ ID NO: 1660 - DNA, 588 bp, Streptococcus pneumoniae
ttgtttgtttttgctgatgatagcttatcggcaaactctaaagttgtatctggtgaggctcagtttgagaatggctcatcagtgcggttcggagatacgcaagtaaatattttaagcgatgaagttcttgaggttgtcaatccagatggaagtgtagacactattgaacgacgtgctgacggcgtctatatcaatggggcattttatatggcttatcaaaagaatgaaatcgacctaaatatatcttttagatcatacgatcctaatgtttggaattacgtcaacacaatacatgggaataaacaagctaacacattcgctaacttcatgactggtgctggaatcagttatatgattggtaggataggtgctttattgggggggccatggggtgcaataattggtggagcatattttggtatacaagcttatcagtcttacttggattcacaaagcccatatccatactacataacaagtacttatatccatgttgctcaaagaaaatggaagtttatcactgaatactatagaaactcaaactatactgggtatgtaaaaaccgtaacaacctatgtgaatttctaa

SEQ ID NO: 1661 - DNA, 204 bp, Streptococcus pneumoniae
gtgccgaaatggtcaaatcctgattatgtcaacgaattagacccaaaaatcgttgatatgctagtagaatttcacaagtcacaaggcactttggaaactcccgaggcgcaagcagaaatcgcccaaaaacgtgaagaaatcgagcaaaggagagctgagcttgagggtaaaaaacaagagcttttgaaccgcttgaacaaatag

SEQ ID NO: 1662 - DNA, 759 bp, Streptococcus pneumoniae
gtggagggcagcattccttgtcgcccgtcccttctttttaatggagacagaaagatgatgaatgaattatttggagaatttctagggactttaatcctgattcttctaggaaatggtgttgttgcaggtgtggttcttcctaaaaccaagagcaatagctcaggttggattgtgattactatgggttgggggattgcagttgcggttgcagtctttgtatctggcaagctcagtccagctcatttaaacccagctgtgaccatcggtgtggccttaaaaggtggtttgccttgggcttccgttttgccttatatcttagcccagttcgcaggggccatgctgggtcagattttggtttggttgcaattcaaacctcactatgaggcagaagaaaatgcaggcaatatcctggcaaccttcagtactggaccagccatcaaggatactgtatcaaacttgattagcgaaatccttggaacctttgttttggtgttgacaatctttgctttgggtctttacgattttcaggcaggtatcggaacctttgcagtgggaactttgattgtcggtatcggtctatcactaggtgggacaacaggttatgccttgaacccagctcgtgaccttggacctcgtatcatgcacagcatcttgccaattccaaacaagggagacggagactggtcttacgcttggattcctgttgtaggccctgttatcggagcagccttggccgtgcttgtattctcacttttctaa

SEQ ID NO: 1663 - DNA, 1827 bp, Streptococcus pneumoniae
atggaattttcaaagaaaacacgtgaattgtcaattaaaaaaatgcaggaacgcaccctggacctcttgattatcggtggaggaatcacaggggctggtgtagccttgcaggcggcagctagcggtcttgagactggtttgattgaaatgcaagactttgcagaaggaacatctagtcgttcaacaaaattggttcacggaggacttcgttacctcaaacaatttgacgtagaggtggtctcagatacggtttctgaacgtgcagtggttcaacaaatcgctccacacattccaaaaccagacccaatgctcttaccagtttacgatgaagatggagcaacctttagccccttccgtcttaaagtagccatggacttgtacgaccttttagcaggtgtgagcaacacaccaactgcgaacaaggttttgagcaagaaagaagtcttggaacgccagccaaacttgaagaaggaaggcttggtaggaggtggagtgtatcttgacttccgtaacaacgatgcgcgtctcgtgattgaaaacatcaaacgtgccaaccaagacggtgccctcattgccaaccacgtgaaggcagaaggcttcctctttgacgaaagtggcaagattacaggtgttgtagctcgtgatctcttgacagaccaagtatttgaaatcaaggcccgtctggttattaatacaacaggtccttggagtgataaagtacgtaatttgtctaataagggaacgcaattctcacaaatgcgcccaactaagggagttcacttggtagtggattcaagcaaaatcaaggtttcacagccagtttactttgacacaggtttgggtgacggtcgtatggtctttgttctcccacgtgaaaacaagacttactttggtacaactgatacagactacacaggtgatttggagcatccaaaagtaactcaagaagatgtagattatctacttggcattgtcaacaaccgctttccagaatccaacatcaccattgatgatatcgaaagcagctgggcaggtcttcgtccattgattgcagggaacagtgcctctgactataatggtggaaataacggtaccatcagtgatgaaagctttgacaacttgattgcgactgttgaatcttatctctccaaagaaaaaacacgtgaagatgttgagtctgctgtcagcaagcttgaaagtagcacatctgagaaacatttggatccatctgcagtttctcgtgggtctagcttggaccgtgatgacaatggtcttttgactcttgctggcggtaaaatcacagactaccgtaagatggctgaaggagctatggagcgcgtggttgacatcctcaaagcagaatttgaccgtagctttaaattgatcaattctaaaacttaccctgtttcaggtggagaattgaacccagcaaatgtggattcagaaatcgaagcctttgcgcaacttggagtttcacgtggtttggatagcaaggaagctcattacctagcaaatctttacggttcaaatgcaccgaaggtctttgcacttgctcacagcttggaacaagcgccaggactcagcttggcagatactttgtcccttcactatgcaatgcgcaacgagttggctcttagcccagttgacttccttcttcgtcgtaccaaccatatgctctttatgcgtgatagcttggatagcatcgttgagccagttttggatgaaatgggacgattctatgactggacagaagaagaaaaagcaacttaccgtgctgatgtcgaagcagctctcgctaacaacgatttagcagaattaaaaaattaa

SEQ ID NO: 1664 - DNA, 300 bp, Streptococcus pneumoniae
caaatctttacggttcaaatgcaccgaaggtctttgcacttgctcacagcttggaacaagcgccaggactcagcttggcagatactttgtcccttcactatgcaatgcgcaacgagttggctcttagcccagttgacttccttcttcgtcgtaccaaccatatgctctttatgcgtgatagcttggatagcatcgttgagccagttttggatgaaatgggacgattctatgactggacagaagaagaaaaagcaacttaccgtgctgatgtcgaagcagctctcgctaacaacgatttag

SEQ ID NO: 1665 - DNA, 1509 bp, Streptococcus pneumoniae
atgtcacaagaaaaatacatcatggccattgaccagggaactacaagttctcgtgccatcattttcaacaaaaaaggggaaaaggttagctcgagtcaaaaagagtttactcagattttccctcaagcaggttgggttgagcacaatgccaatgaaatttggaactctgttcagtcagttattgcgggtgctttcatcgaaagtggtgtcaagccaaatcaaatcgaggcaatcgggattaccaaccaacgtgaaacaacggttgtctgggataagaaaacaggacttcctatctacaatgctatcgtttggcagtcacgccagacagcacctttggctgagcaactaaaaagccaaggttatgtggaaaaattccatgaaaagactggtttgattattgatgcttacttctctgctaccaaggttcgttggattttggatcatgtagaaggtgctcaagagcgagcagaaaaaggggaattgctctttggtactatcgatacttggttggtttggaaattgactgacggtgcggctcacgtgactgactactcaaatgcagctcgtaccatgctttataacattaaagaactcaaatgggatgatgagattttggaaatccttaacattccgaaggctatacttccagaagttcgttctaactccgaaatctacggcaagacagctccattccatttctacggtggagaggtgccaatctcaggtatggctggggaccaacaagcagccctctttggacagttggcttttgagccaggtatggttaagaatacttatggaacaggctctttcatcatcatgaatactggggaagagatgcagttgtctgaaaacaacctcttgacaaccattggttacggaatcaacggtaaggtttattatgccttggaaggttctatcttcatcgcaggaagtgctattcagtggcttcgtgacggtcttcgcatggttgaaaattcaccagaatctgaaaaatacgctcgtgattctcacaacaacgatgaagtttatgtcgttccagcctttacaggtctaggcgctccatactggaaccaaaatgctcgtggttccgtctttggtttgactcgtggaacaagcaaagaagactttatcaaggcgactttgcaatctattgcttatcaagtgcgtgacatcatcgacaccatgcaagtggatactcagactgccattcaagtattgaaggtggatggtggtgcagccatgaacaacttcctcatgcagttccaggcggatattttaggcattgatattgcacgtgctaaaaacttggaaacaacagctctaggagcggccttcctagcaggtttatcagtagggtactggaaaaacttggacgagttgaaactcttgaacgagacaggagaactctttgagccatctatgaatgaatctcgcaaggaacaactctacaagggctggaagaaggctgtgaaagcaactcaagtctttgcggaagtagacgactaa

SEQ ID NO: 1666 - DNA, 1428 bp, Streptococcus pneumoniae
atgtatttaggagatttgatggagaaagccgagtgtggtcaattttcaatcctttcctttctattacaagagtctcagacgaccgtcaaggctgtaatggaagaaacaggattttcaaaagcaaccctaaccaaatatgtcaccctgctcaatgacaaggctttggatagtggcttagagctgactattcactcagaagatgaaaatctgcgtctgtctatcggtgcagctaccaaggggagagatattcggagcttgtttttggatagtgctgttaaataccagattttggtttatcttctctaccaccaacagtttttagcccatcagctggctcaagaattggtgattagcgaggctacgcttggtcgtcacttggctggtttaaatcagattttgtcagaatttgatttatccatccaaaatggacgctggcgaggtccagagcatcagattcgctatttctatttctgtcttttccgaaaggtctggtcgagtcaggaatgggaaggtcacatgcagaaaccagagagaaaacaggagattgccaatttagaggaaatctgcggtgcaagtttgtctgcggggcagaaattggacttggttctctgggctcacatcagtcaacaacgtcttcgggtcaatgcttgtcagtttcaagttatagaagagaaaatgcgagggtattttgacaatatcttctatcttcgtttgctgagaaaggttccgtccttttttgctgggcaacatattccactaggagttgaggatggtgagatgatgatattcttctcttttctcctatctcatcgcattcttcctcttcatactatggagtatattcttggttttggagggcagttggcagatttactgacgcaattgattcaagaaatgaagaaggaggaactattgggggattatacagaggaccatgtcacctatgaactcagtcagctttgtgctcaagtctatctctataagggctatattttacaggatcgctacaagtaccagttagagaatcgtcatccatatttactgatggaacatgattttaaagagacagcagaggagatttttcatgctctacctgcttttcaacaggggacagatttagataagaagattctctgggaatggctccagttaatcgaatatatggctgaaaacggtggccagcatatgcggattggtctggatttgacatctggttttcttgtcttttcaaggatggcagccattttgaaacggtatttggaatacaatcgttttattaccattgaagcttatgaccctagtcggcattatgatttgctggttaccaataacccgattcataagaaggaacagaccccagtctattatttaaaaaatgacttggatatggaagatttggcagggattcgtcagttattattcacttaa

SEQ ID NO: 1667 - DNA, 198 bp, Streptococcus pneumoniae
tatagttttaataattttatccatagctactattttagcataaaaatgcccaaagggggagccgtgtgtttactgattttcaggataatggaccaggaaatcagcatgaaaataaaaagagaaacagattatttcagcatttgtaagatttatgctatgcttaaggtagaaaatgaaaggggtaacaaatgtatttag

SEQ ID NO: 1668 - DNA, 873 bp, Streptococcus pneumoniae
atggataaaattattaaaactatatcagaaagcggagcctttcgtgcttttgtccttgatagcacggaaaccgtccgcactgctcaagaaaaacatcaaacccaagctagctcaactgtagcgcttggtcgaactcttatcgccagccagattctcgcagccaatgaaaaaggaaataccaaacttacagttaaggtgttgggatctagctctctaggtgctattatcaccgtcgctgataccaaggggaacgtcaaaggctacgttcaaaatcctggtgttgacatcaaaaagactgcgactggtgaagtcctagtcggaccttttgttggaaatggtcaattcctcgttatcacagactacggtactggaaatccttacaattctataactcccctcatctctggagaaatcggtgaagaccttgccttttaccttactgaaagccaacaaacgccttcagcggtcggcctcaatgtccttttggacgaggaagacaaggtcaaggttgcaggtggtttcctagttcaagtcttgccaggagccaagaaagaagagattgctcgctttgaaaaacgcatccaagaaatgccagctatctctactcttctcgaaagcgacgaccatatcgaagccctcctcaagactatctacggggacgaagcctacaagcgtctttctgaagaagaaatccgtttccaatgtgactgtagccatgaacgctttatgaacgctcttgccagccttccaagctcagacttacaggaaatgaaagaggaagaccacggggtagaaatcacttgtcaattctgccaaactacttacaactttgatgaaaaggacctggaggaactcattcgtgacaaatcttaa

SEQ ID NO: 1669 - DNA, 981 bp, Streptococcus pneumoniae
gtgacaaatcttaatacaccttttatgattggcaatgttgagattcccaatcgtaccgttttagcgcctatggctggcgtgaccaactcagcctttcgtaccatcgcaaaagagctcggagctggactcgttgtaatggaaatggtctctgacaagggaatccaatacaacaacgaaaaaaccctgcacatgcttcatatcgatgagggcgaaaaccctgtctctatccaactttttggtagcgatgaagacagcctagcacgcgcagcagaattcatccaagaaaataccaagaccgatatcgtcgatatcaacatgggctgccctgtcaacaaaatcgtgaagaacgaagctggtgctatgtggctcaaggatcctgacaagatctactctatcatcaacaaggtccagtctgtccttgatatcccacttactgtcaaaatgcgtaccggctgggcggacccatctcttgcagtagaaaatgccctcgctgctgaggctgcaggtgtttctgccctcgccatgcatggccgtacccgtgaacaaatgtatactggccacgcagaccttgagaccctttacaaggttgcccaagctctaaccaagattccattcatcgccaacggtgatatccgtactgtccaagaagccaagcaacgcatcgaagaagttggtgctgacgcagtcatgattggccgagctgccatgggaaatccttacctcttcaaccaaatcaaccattactttgaaacaggagaaatcctacctgatttgacctttgaagacaagatgaagatcgcctacgaacacttgaaacgattgattaacctcaaaggagaaaacgtcgcagttcgtgaattccgcggcctcgctcctcactatctccggggaacatctggcgctgccaaactccgtggagccatttcgcaagctagcaccctggcagagattgaagccctcttgcaattggaaaaagtataa

SEQ ID NO: 1670 - DNA, 189 bp, Streptococcus pneumoniae
gacaaaagtataatattaaatataaaaagcgaacaaaatcagttatctgacactcagaattctgtcttgttcgcttttttgtctaatctatcgattttaaaaatttataataaagaattcctaaaatcaaaatctttttatcccagactcttttcttttaagccgaatactttttacaaacatttttga

SEQ ID NO: 1671 - DNA, 666 bp, Streptococcus pneumoniae
atcaatcactatttcattcttttcttagcaagaatggttgcccccgccaaggtaagaagacctgcaatttcaagtgctagatttgaaatagatccagttgatggcaatgacttcttcggtttatttgttgctttttcgtttgttgaagcttggttagaaggttgcttgtccttgcttaaattatttgtagttgatggcttcttatcatctgcttgtggcttgctattatctggttttggtttttctggttgcggtttaacctctggttttggtttttctggttgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttctggttgcggtttaacctctggttttggtttttccagctgcggtttaacctctggttga

SEQ ID NO: 1672 - DNA, 1353 bp, Streptococcus pneumoniae
atgaaagcggtcagtgaatatgtaggaaaaatggtgagagatgcctatgtaaaatcagatagaaaacgacataaaaatactgtagctctagttaaccagttgggaaacattaagaacaggtatttgaatgaaatagttcattcaacctcaaaaagccaactacaggaactgatgatgaagagtcaatcagaagtagatgaagctgtgtctaaatttgaaaaggactcattttcttcgtcaagttcaggatcctccactaaaccagaaactccgcagccggaaaatccagagcatcaaaaaccaacaactccatctccggataccaaaccaagccctcaaccagaaggcaagaaaccaagcgtaccagacattaatcaggaaaaagaaaaagctaagcttgctgtagtaacctacatgagcaagattttagatgatatacaaaaacatcatctgcagaaagaaaaacatcgtcagattgttgctcttattaaggagcttgatgagcttaaaaagcaagctctttctgaaattgataatgtaaataccaaagtagaaattgaaaatacagtccacaagatatttgcagacatggatgcagttgtgactaaattcaaaaaaggcttaactcaggacacaccaaaagaaccaggtaacaaaaaaccatctgctccaaaaccaggtatgcaaccaagtcctcaaccagaggttaaaccgcagctggaaaaaccaaaaccagaggttaaaccgcaaccagaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcaaccagaaaaaccaaaaccagaggttaaaccgcaaccagaaaaaccaaaaccagataatagcaagccacaagcagatgataagaagccatcaactacaaataatttaagcaaggacaagcaaccttctaaccaagcttcaacaaacgaaaaagcaacaaataaaccgaagaagtcattgccatcaactggatctatttcaaatctagcacttgaaattgcaggtcttcttaccttggcgggggcaaccattcttgctaagaaaagaatgaaatag

SEQ ID NO: 1673 - DNA, 549 bp, Streptococcus pneumoniae
caaaagaaccaggtaacaaaaaaccatctgctccaaaaccaggtatgcaaccaagtcctcaaccagaggttaaaccgcagctggaaaaaccaaaaccagaggttaaaccgcaaccagaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcagccggaaaaaccaaaaccagaggttaaaccgcaaccagaaaaaccaaaaccagaggttaaaccgcaaccagaaaaaccaaaaccagataatagcaagccacaagcagatgataagaagccatcaactacaaataatttaa

SEQ ID NO: 1674 - DNA, 528 bp, Streptococcus pneumoniae
ttgtggcttgctattatctggttttggtttttctggttgcggtttaacctctggttttggtttttctggttgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttccggctgcggtttaacctctggttttggtttttctggttgcggtttaacctctggttttggtttttccagctgcggtttaacctctggttgaggacttggttgcatacctggttttggagcagatggttttttgttacctggttcttttggtgtgtcctgagttaa

SEQ ID NO: 1675 - DNA, 546 bp, Streptococcus pneumoniae; identical to SEQ ID NO: 729

SEQ ID NO: 1676 - DNA, 753 bp, Streptococcus pneumoniae; identical to SEQ ID NO: 1270

SEQ ID NO: 1677 - DNA, 195 bp, Streptococcus pneumoniae; identical to SEQ ID NO: 728

SEQ ID NO: 1678 - DNA, 165 bp, Streptococcus pneumoniae
atgtttaaatcaaatcatgagcgaagaatgcgttattccattcgtaaatttagtgtaggagtagctagcgtagctgttgccagtctttttatgggaagtgttgtacatgcgacagagaaagagggaagtacccaagcagccaatgtcattaagttagtgatctaa

SEQ ID NO: 1679 - DNA, 1257 bp, Streptococcus pneumoniae; identical to SEQ ID NO: 293

SEQ ID NO: 1680 - DNA, 696 bp, Streptococcus pneumoniae
atgtggtacttctacaatactgatggttcaatggcgacaggatggctccaaaacaatggttcatggtactacctaaacagcaatggcgctatggcgacaggatggctccaaaacaatggttcatggtactatctaaacgctaatggttcaatggcaacaggatggctccaaaacaatggttcatggtactatctaaacgctaatggttcaatggcaacaggatggctccaaaacaatggttcatggtactacctaaacgctaatggtgatatggcgacaggatggctccaatacaatggttcatggtactacctaaacgctaatggtgatatggcgacaggatggctccaatacaatggttcatggtactacctaaacgctaatggtgatatggcgacaggatggctccaatacaatggttcatggtactacctaaacagcaatggtgctatggtaacaggatggctccaaaacaatggctcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaa

SEQ ID NO: 1681 - DNA, 330 bp, Streptococcus pneumoniae
atgaaccattgttttggagccatcctgtcgccattgaaccatcagtattgtagaagtaccacataccgttttcttgtttccagcctatttttggtgcaggagctggttgctctggtttttgcggttgctgttgagtctatcgattatattcttcatctgatctaccagcatagtcttcttcagcttgttgatcatctgttttttctgcttttggttgttcagctggcttctctggttttggtgcgggagctggattctcaggctcttcagttggtttttctggttgaggagccggcgctggttgtggttgttcagctggtttttctttaa

SEQ ID NO: 1682 - DNA, 315 bp, Streptococcus pneumoniae
aaaaaatcaagacagatcgtaaaaaagcagaagaagaagctaaacgaaaagcagcagaagaagataaagttaaagaaaaaccagctgaacaaccacaaccagcgccggctcctcaaccagaaaaaccaactgaagagcctgagaatccagctcccgcaccaaaaccagagaagccagctgaacaaccaaaagcagaaaaaacagatgatcaacaagctgaagaagactatgctggtagatcagatgaagaatataatcgatagactcaacagcaaccgcaaaaaccagagcaaccagctcctgcaccaaaaatag

SEQ ID NO: 1683 - DNA, 642 bp, Streptococcus pneumoniae
ggcggagaaaacgaagagtttctgagagagcaagcaacacgtgataaaaaagaaaatgatgcgaagtcttcagattctagcgtaggtgaagaagctcttccaagcccatccctgaaaccagaaaaaaaggttgcagaagctgagaagaaggttgcagaagctgagaaaaaagccaaggctcaaaaagaagaagatcgccgtaactacccaaccaatacttacaaaacgcttgaacttgaaattgctgagtccgatgtgaaagttaaagaagcggagcttgaactagtaaaagaggaagctaaggaatctcgaaacgaggaaaaagttaatcaagcaaaagcgaaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctcctcaaccagaaaaaccaactgaagagcctgagaatccagctcccgcaccaaaaccagagaagccagctgaacaaccaaaagcagaaaaaacagatgatcaacaagctgaagaagactatgctggtagatcagatgaagaatataatcgatag

SEQ ID NO: 1684 - DNA, 219 bp, Streptococcus pneumoniae
ttgttgatcatctgttttttctgcttttggttgttcagctggcttctctggttttggtgcgggagctggattctcaggctcttcagttggtttttctggttgaggagccggcgctggttgtggttgttcagctggtttttctttaactttatcttcttctgctgcttttcgtttagcttcttcttctgcttttttacgatctgtcttgattttttctaa

SEQ ID NO: 1685 - DNA, 315 bp, Streptococcus pneumoniae
ttgcttgctctctcagaaactcttcgttttctccgcccctttggtttatcttgctctgaagtcgctacattcttttcaacagcttccttcaacttagcttctgctcttcgtttagcttcttcttctgctttttcacgatctgtcttgatgttttctaaccttgtagcctcagcttttttactctcaactttcgcttctgcttgcttaattttttcatcgtctcgagattccttagcttcctcttttactagttcaagctccgcttttttaacttccacatcggactcagcaatttcaagttcaagcgttttgtaa

SEQ ID NO: 1686 - DNA, 828 bp, Streptococcus pneumoniae
atgtttgcatcaaaaagcgaaagaaaagtacattattcaattcgtaaatttagtattggagtagctagtgtagctgttgccagtcttgttatgggaagtgtggttcatgcgacagagaaggaggtaactacccaagtagccacttcttctaatagggcaaatgaaagtcaggcaggacataggaaagctgctgaacaattcgatgaatatataaaaacaatgatccaattagatagaagaaaacatacccaaaatttcgccttaaacataaagttgagcagaattaaaacggagtatttgcgtaaattaaatgttttagaagagaagtcgaaagctgagttgccgtcagaaacaaaaaaagagatagacgcagcttttgagcagtttaaaaaagataccaacagaaccaaaaaaacggtagcagaagctgagaagaaggttgaagaagctaagaaaaaagccaaggctcaaaaagaagaagatcaccgtaactacccaaccaatacttacaaaacgcttgaacttgaaattgctgagtccgatgtggaagttaaaaaagcggagcttgaactagtaaaagaggaagctaaggaatctcgagacgatgaaaaaattaagcaagcagaagcgaaagttgagagtaaaaaagctgaggctacaaggttagaaaacatcaagacagatcgtgaaaaagcagaagaagaagctaaacgaagagcagaagctaagttgaaggaagctgttgaaaagaatgtagcgacttcagagcaagataaaccaaaggggcggagaaaacgaagagtttctgagagagcaagcaacacgtga

SEQ ID NO: 1687 - DNA, 528 bp, Streptococcus pneumoniae
atggtattagcgattattttagtaacattccttattcgattgatttttttaaagcgttcgatagagaatgagaaacgaatccttagcaatggcgggaaagaatttggagttgagaatacaaaacgattaacgttggctcatattgttttttatctctcttgcctcgttgaagcaatggtgcataagacaatgtttgatggtatgagcatggttggtttagtcttgcttattttttctatgctgatgttgatgttggtgattcacttgttgggagatatttggacagtgaagcttatgcttgtcaataatcacaaatatgtagatcatatcttgtttaggacagtaaaacatcctaattactttttaaatattttacctgagttgattggcttgaccttgttgagtcatgcctatatgacttttgttttagtctttccagtttatgcagttattttgtatcgacgaatagctgaagaggaaaagctattacatgaagttataatcccaaatggaagcataaagagataa

SEQ ID NO: 1688 - DNA, 1341 bp, Streptococcus pneumoniae
atgataaaaaatcctaaattattaaccaagtcctttttaagaagttttgcaattctaggtggtgttggtctagtcattcatatagctatttatttgacctttcctttttattatattcaactggagggggaaaagtttaatgagagcgcaagagtgtttacggagtatttaaagactaagacatctgatgaaattccaagcttactccagtcttattcaaagtccttgaccatatctgctcaccttaaaagagatattgtagataagcgactccctcttgtgcatgacttggatattaaagatggaaagctatcaaattatatcgtgatgttagatatgtctgttagtacagcagatggtaaacaggtaaccgtgcaatttgttcacggggtggatgtctacaaagaagcaaagaatattttgcttttgtatctcccatatacatttttggttacaattgctttttcctttgttttttcttatttttatactaaacgcttgctcaatcctcttttttacatttcagaagtgactagtaaaatgcaagatttggatgacaatattcgttttgatgaaagtaggaaagatgaagttggtgaagttggagaagttggaaaacagattaatggtatgtatgagcacttgttgaaggttattcatgagttggaaagtcgtaatgagcaaattgtaaaattgcaaaatcaaaaggtttcctttgtccgtggagcatcacatgagttgaaaacccctttagccagtcttagaattatcctagagaatatgcagcataatattggagattacaaagatcatccaaaatatattgcaaagagtataaataagattgaccagatgagccacttattggaagaagtactggagtcttctaaattccaagagtggacagagtgtcgtgagactttgactgttaagccagttttagtagatattttatcacgttatcaagaattagctcattcaataggtgttacaattgaaaatcaattgacagatgctaccagggtcgtcatgagtcttagggcattggataaggttttgacaaacctgattagtaatgcaattaaatattcagataaaaatgggcgcgtaatcatatccgagcaagatggctatctctctatcaaaaatacatgtgcgcctctaagtgaccaagaactagaacatttatttgatatattctatcattctcaaatcgtgacagataaggatgaaagttccggtttgggtctttacattgtgagtaatattttagaaagctatcaaatggactatagttttctcccttatgaacacggtatggaatttaagattagcttgtag

SEQ ID NO: 1689 - DNA, 654 bp, Streptococcus pneumoniae
atgaacattttagttgcagatgacgaggaaatgattagagaaggaattgcagcatttctgacagaagagggttatcatgtcattatggctaaggatggacaagaggtcttggaaaaatttcaagatctccctatccatctcatggtactggatttaatgatgcctaggaagagtggttttgaagtgttaaaagaaatcaatcaaaagcacgatattcctgtcatcgtcttgagtgctctgggagatgaaactactcagtcacaggtatttgatctctatgctgatgatcatgtgacaaaacctttttctttggtactgcttgtcaagcgtattaaggcgcttatcagacgttactacgtcatagaggatctttggcgatatcaggatgtaacagtggattttacctcttacaaagcacattataaaaatgaagaaattgatctcaaaccaaaggaattactggtactaaagtgtttgattcagcataaaaatcaagttttaagtagagagcagatattggaagaaatttcaaaagatgtagctgatttaccttgtgatagggtcgttgatgtctatattcgtactcttcgcaaaaaattagctttagattgtatcgtgactgtgaaaaatgttgggtataagattagcttatga

SEQ ID NO: 1690 - DNA, 225 bp, Streptococcus pneumoniae
ttgattttcattgagtttcactccactgtgacttatggtcagatgctgatacttttattcttttatgcaatatcaaattttaactggcctgctttgacaccaatcttaagtgtgctgcctgccactaaatctcccttaagaagaagttctgccaacttgtcctccacttctgtttgcagggttctgcgaagtgggcgagctcccatctctgggtcatatccttga

SEQ ID NO: 1691 - DNA, 2433 bp, Streptococcus pneumoniae
atgaactattcaaaagcattgaatgaatgtatcgaaagtgcctacatggttgctggacattttggagctcgttatctagagtcttggcacttgttgattgccatgtctaatcacagttatagtgtagcaggggcaactttaaatgattatccgtatgagatggaccgtttagaagaggtggctttggaactgactgaaacggactatagccaggatgaaacctttacggaattgccgttctcccgtcgtttgcaggttctttttgacgaagcagagtatgtagcgtcagtggtccatgctaaggtgctagggacagagcacgtcttctatgcgattttgcatgatggcaatgccttggcaactcgtatcttggagagggctggtttttcttatgaagacaagaaagatcaggtcaagattgctgcccttcgtcgaaatttagaagaacgggcaggctggactcgtgaagacctcaaggctttacgccaacgccatcgtacagtagctgacaagcaaaattctatggccaatatgatgggcatgccgcagactcctagtggtggtcttgaggactatacgcatgatttgacagagcaagcgcgttctggcaagttagaaccagtcatcggtcgggacaaggaaatctcacgtatgattcaaatcttgagccgtaagactaagaacaaccctgtcttggttggggatgctggtgtcgggaaaacagctctggcccttggtcttgcccagcgtattgctagtggtgacgtgcctgcggaaatggctaagatgcgcgtgttacaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccaccactcaggaagaatatcaaaaacatatcgaaaaagatgcggctctttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgacctcttggacgaagcagcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgtgtcatcggtcaagatcaagctgtttcaagcattagccgtgccattcgccgtaatcagtcaggaattcgcagtcacaagcgtccgatcggttcctttatgttcctaggacccacaggtgtcggtaagaccgagttggccaaggctttggcagaagttctctttgatgacgaatcagcccttatccgctttgatatgagtgagtatatggagaaattcgcagccagccgtctaaatggagctcctccaggctatgtgggttacgaagaaggtggggagttgacagagaaggttcgcaataaaccctattccgttctcctctttgatgaggtagagaaggcccacccagatatctttaatgttctcttgcaggttctggatgacggtgtcttgacagatagcaagggacgcaaggtcgatttttcaaataccattatcattatgacatcgaacctaggtgcgactgcctttcgtgatgataagactgttggttttggggctaaggatattcgttttgaccaggaaaatatggaaaaacgcatgtttgaagaactgaaaaaagcttatagaccggaattcatcaaccgtattgatgagaaggtggtcttccatagcctatctagtgaccatatgcaggaagtggtgaagattatggtcaagcctttagtggcaagtttggctgaaaaaggcattgacttgaaattacaagcttcagctctgaaattgttagcaaatcaaggatatgacccagagatgggagctcgcccacttcgcagaaccctgcaaacagaagtggaggacaagttggcagaacttcttcttaagggagatttagtggcaggcagcacacttaagattggtgtcaaagcaggccagttaaaatttgatattgcataa

SEQ ID NO: 1692 - DNA, 522 bp, Streptococcus pneumoniae
atgagaaaatttcggtataatagtcaaacaaggtcaaggtttaaagagagaggtgggtttgttatgagatttaaaaatacatcggatcatattgaggcctacatcaaggcgattttagatcaatctggtatcgtggagttgcaacggagtcagttggcagatacctttcaggttgttcctagtcagattaactacgtgatcaagacacgctttacggaaagtagaggctacttggttgaaagtaagcgtggtggcggaggctacattcgtataggacggattgagttttctagtcatcatgaaatgctccgggagctgctttactcgattggtgagcgagtcagtcaagaaatttatgaggatattctccagcttttggttgagcaggaattgatgaccaagcaggagatgaatttgctagaatcagtagctttggatcgcgttttaggagaagaagctccagttgttcgagcaaacatgctacgtcagatcatacaagaggtagatagaaaagggaagtaa

SEQ ID NO: 1693 - DNA, 729 bp, Streptococcus pneumoniae
atgacagaaattagactagagcacgtcagttatgcctatggtcaggagaggattttagaggatatcaacctacaggtgacttcaggcgaagtggtttccatcctaggcccaagtggtgttggaaagaccaccctctttaatctaatcgctgggattttagaagttcagtcagggagaattgtccttgatggtgaagaaaatcccaaggggcgcgtgagttatatgttgcaaaaggatctgctcttggagcacaagacggtgcttggaaatatcattctgcccctcttgattcaaaaggtggataaggcagaagctatttcccgagcggataaaattcttgcgaccttccagctgacagctgtaagagacaagtatcctcatgaacttagcggtgggatgcgccagcgtgtagccttactccggacctacctttttgggcacaagctctttctcttagatgaggcctttagcgccttggatgagatgacaaagatggaactccacgcttggtatcttgagattcacaagcagttgcagctaacaaccctgatcatcacgcatagtattgaggaggccctcaatctcagcgaccgcatctatatcttgaaaaatcgccctgggcagattgtttcagaaattaaactagattggtctgaagatgaggacaaggaagtccaaaagattgcctacaaacgtcaaattttggcggaattaggcttagataagtag

SEQ ID NO: 1694 - DNA, 1008 bp, Streptococcus pneumoniae
atgaagaaaacatggaaagtgtttttaacgcttgtaacagctcttgtagctgttgtgcttgtggcctgtggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaataa

SEQ ID NO: 1695 - DNA, 408 bp, Streptococcus pneumoniae
ttgatttcctcttttctttttcaaaaacgctctattttaagtacgtttccatttaatcacatatttttcactgatatcgaccagcttcatacccaaaagactgataatcgacaccagaataataatggcaaacatggtatcatactgaaacagttttttagactgaatcatataaacaccaagaccttcaaaacctcccaaccactcagataccacagttgtgataaaggcgtaggagacactgaccctcagacctgcataaaagtaaggcaggctaaccgggattttaaaatgccacaggatttgccaagggtttgctcgcatcagactaaacaaagtcagcatatccttgtcacaatgcctaaaaccgtccaaaatactaacgatgatgggaaaggttgttgttaa

SEQ ID NO: 1696 - DNA, 750 bp, Streptococcus pneumoniae
ttgaaaagtatactgagacgacacattagtctattgggctttctcggagtattgtcaatctggcagttagcaggttttcttaaacttctccccaagtttatcctgccgacacctcttgaaattctccagccctttgttcgtgacagagaatttctctggcaccatagctgggcgaccttgagagtggctttactggggctgattttgggagttttgattgcctgtcttatggctgtgctcatggatagtttgacttggctcaatgacctgatttaccctatgatggtggtcattcagaccattccgaccattgccatagctcctatcctggtcttgtggctaggttatgggattttgcccaagattgtcttgattatcttaacaacaacctttcccatcatcgttagtattttggacggttttaggcattgtgacaaggatatgctgactttgtttagtctgatgcgagcaaacccttggcaaatcctgtggcattttaaaatcccggttagcctgccttacttttatgcaggtctgagggtcagtgtctcctacgcctttatcacaactgtggtatctgagtggttgggaggttttgaaggtcttggtgtttatatgattcagtctaaaaaactgtttcagtatgataccatgtttgccattattattctggtgtcgattatcagtcttttgggtatgaagctggtcgatatcagtgaaaaatatgtgattaaatggaaacgtacttaa

SEQ ID NO: 1697 - DNA, 291 bp, Streptococcus pneumoniae
atgaaagcaagcattgccttgcaagttttacccctagcacaggggattgatcggatagctgttattgatcaggtcattgcttatctgcaaactcaagaagtgacgatggtagtgacaccatttgaaacggtcttggaaggggagtttgatgagcttatgcgcattctaaaagaagcgctggaagtggcagggcaggaggcagacaatgtctttgccaatgtcaaaataaatgtaggagagattttaagtattgatgagaaacttgaaaagtatactgagacgacacattag

SEQ ID NO: 1698 - DNA, 852 bp, Streptococcus pneumoniae
atgacaggatttattcattttaaagatttggatggtgccagtgttgggaatagtcatccttcaacttcaccaggcggaactcattattttaagaccaagtctgctattaaaactgaacctctagctagcggaactgtgattgattactattatcctggggagaaggttcattatgatcagatacttgaaaaagacggctataagtggttgagttatactgcctataatggaagctatcgttatgttcaattggaggctgtgaataaaaatcctctaggtaattctgttctttcttcaacaggtggaactcattattttaagaccaagtctgctatcaaaactgaacccctagttagtgcaactgtgattgattactattatcctggagagaaggttcattatgatcaaattctcgaaaaagacggctacaagtggttgagttatacggcttataacggaagtcgtcgctatatacagctagagggagtgacttcttcacaaaattatcagaatcaatcaggaaatatctctagctatggatccaataatagttcaactgtcggttggaagaaaataaatggtagttggtatcatttcaaatcaaatggttctaaatcaacaggatggctgaaagacggttctagctggtattatttgaaattatctggtgaaatgcagacaggatggttaaaggagaatggctcgtggtattatctgggtagttcaggggcaatgaaaacaggctggtaccaggtctctggtaagtggtattattcttactcttcaggcgccttagctgttaatacgacggtggatggctacagagtaaacagtgatggagaacgagtatag

SEQ ID NO: 1699 - DNA, 414 bp, Streptococcus pneumoniae
atgaaaattttaccgtttatagcaagaggaacaagttattacttgaagatgtcagttaaaaagcttgttccttttttagtagtaggattgatgctagcagctggtgatagtgtctatgcctattccagaggaaatggatcgattgcgcgtggggatgattatcctgcttattataaaaatgggagccaggagattgatcagtggcgcatgtattctcgtcagtgtacttcttttgtagcctttcgtttgagtaatgtcaatggttttgaaattccggcagcttatggaaatgcgaatgaatggggacatcgtgctcgtcgggaaggttatcgtgtagataatacaccgacgattggttccattacttgttctactccaggaactaatgttcatggtgcctgggtgtcaaagtaa

SEQ ID NO: 1700 - DNA, 267 bp, Streptococcus pneumoniae
atgtcagatgcatttacagatgtagccaagatgaaaaaaatcaaagaagaaatcaaggcacatgagggacaagtcgtagaaatgactttggagaatggtcgtaagcgccaaaaaaatagattgggtaagctaattgaagtttatccatccctatttattgtggagtttggggatgtggaaggagataaacaagttaatgtttacgttgaatcctttacttactcagatattcttacagaaaagaatttgattcattatcttgactaa

SEQ ID NO: 1701 - DNA, 1353 bp, Streptococcus pneumoniae
atggcagaagtagaagagttacgagtacaacctcaagatatcttagctgagcaatccgttttaggggctatctttattgatgagagtaaacttgtttttgtgcgagaatacattgagtctcgggacttttttaagtatgcccatcgtttgattttccaagccatggtcgatttatccgatcgtggtgatgccatagatgcaacaacggttcgtactatccttgataatcaaggtgatttacagaatattggtggcttgtcttacttggttgagattgttaattctgtgccaacttctgctaatgcggagtattatgctaagattgttgcagaaaaagcaatgctacgtcgtttaattgccaagttgacagagtctgtcaaccaagcttacgaagcgtcacaaccagctgatgaaattattgctcaggcagaaaaagggttgattgatgtcagtgaaaatgcaaatcgaagcgggtttaagaacattcgagatgtgttgaatctcaactttggaaatctggaagctcgctcgcaacaaacgaccgatattacaggtattgcgacaggttatcgtgatttggatcatatgacaacaggacttcatgaggaggagttgattatcttagcagctcgtccagcagttggtaagacagcatttgccttgaatatcgctcagaacattgggactaagttggacaaaacggttgctattttttcactcgaaatgggtgcggaaagcttggtagatcgtatgttagctgcagaaggcttggtggagtcacattctatccgtacagggcaattgacagatgaggagtggcaaaaatatactattgctcagggtaatctagctaacgccagtatctatatcgatgatacgccaggtattcggattacagagattcgttctcgttctcgtaaattggctcaagaaactggaaatcttggtttgattgtgatagactatttgcaacttatcacgggaactggtcgagaaaatcgtcaacaagaagtttctgaaatttctcgtcagttgaaaatactagccaaggaattgaaggttccagtaatcgctctgagtcagctttctcgtggtgtagaacaacgtcaggacaagagaccggtcttgtctgatattcgtgaatctgggtctattgagcaggacgctgatatcgtagcttttctctatcgcgatgactactatgaacgtggtggtgaagaagaggagggtatcccaaataataaggtggaagttattatcgagaaaaaccgtagtggagctcgtggaacagtggaattgattttccaaaaagaatacaataaattttcaagtatctcaaagagggaggcataa

SEQ ID NO: 1702 - DNA, 453 bp, Streptococcus pneumoniae
atgaaagtaatctttttagcagatgttaaaggaaaaggtaaaaaaggcgaaattaaggaagtaccaacagggtatgcgcaaaactttcttatcaaaaagaatctagccaaagaagcgactgctcaagctgtaggtgaacttcgtggtaaacaaaaatcggaagaaaaagctcacgctgagatgattgcagaaggaaaagcaattaaagcacaacttgaagcagaagaaactgttgtagaatttgttgaaaaagttggtccagatggtcgtacctttggttctattaccaataagaagattgcagaagaattgcaaaagcaatttggaattaagattgataaacgtcatattcaagtacaagctccgattcgagcggttggtttgattgatgtgccagtgaaaatctatcaagatatcacaagtgtaatcaatcttcgtgtgaaagaaggataa

SEQ ID NO: 1703 - DNA, 1974 bp, Streptococcus pneumoniae
atgaaaaaattttatgtaagtccaatttttcctattctagtaggattgattgcgtttggagtcttatccactttcattatttttgttaataataatctgttgacggttttaattttgtttctttttgtaggaggctatgtttttttatttaagaaactgagagtgcattatacaaggagtgatgtagaacagatacagtatgtaaaccaccaagcggaagaaagtttgacatctctattggaacagatgcctgtaggtgttatgaaattgaatttatcttctggagaggttgagtggtttaatccctatgctgaattgattttgaccaaggaagatggtgattttgatttggaagctgttcaaacgattatcaaggcttcagtaggaaatccgtctacttatgccaagcttggtgagaagcgttatgctgttcatatggatgcttcttcaggtgttttgtattttgtagatgtatccagggaacaagccataacagatgaattggtaacaagtcgaccagtgattgggattgtctctgtggataattatgatgatttggaggatgcaacttctgagtcagatattagtcaaatcaatagttttgtagctaattttatatcagagttttcagaaaaatacatgatgttttctcgtcgggtaagtatggatcgattttatctatttactgactacacggtgcttgagggcttgatgaatgataaattttctgttattgatgctttcagagaagagtcgaaacagagacagttgcccttgaccttaagtatgggattttcttatggcgatggaaatcatgatgagatagggaaagttgctttgctcaatttgaacttggctgaagtacgtggtggcgaccaggtggttgttaaggaaaacgacgaaacgaaaaatccagtttattttggtggtgggtctgctgcttcaatcaagcgtacacggactcgtacgcgcgctatgatgacagctatttcagataagattcggagtgtagatcaggtttttgtagtcggtcacaaaaatttagacatggatgctttgggctctgctgtaggtatgcagttgttcgccagcaatgtgattgaaaatagctatgctctttatgatgaagaacaaatgtctccagatattgaacgagctgtttcattcatagaaaaagaaggagttacgaagttgttgtctgttaaggatgcaatggggatggtgaccaatcgttctttgttgattcttgtagaccattcaaagacagccttaacattatcaaaagaattttatgatttatttacccaaaccattgttattgaccaccatagaagggatcaggattttccagataatgcggtcattacttatatcgaaagtggtgcaagtagtgccagtgagttggtaacggaattgattcagttccagaattctaagaaaaatcgtttgagtcgtatgcaagcaagtgttttgatggctggtatgatgttggatactaaaaatttcacctcgcgagtaactagtcggacatttgatgttgctagctatctcagaacgcgcggaagtgatagtattgctatccaggaaatcgctgcgacagattttgaagaatatcgtgaggtcaatgaacttattttacaggggcgtaaattaggttcagatgtactaatagcagaggctaaggacacgaaatgctatgatacagttgttattagtaaggcagcagatgccatgttagccatgtcaggtattgaagcgagttttgttcttgcgaagaatatacaaggatttatctctatctcagctcgaagtcgtagtaaactgaatgtacaacggattatggaagagttaggcggtggaggccactttaatttggcagcagctcaaattaaagatgtaaccttgtcagaagcaggtgaaaaactgacagaaattgtattaaatgaaataaaggaaaaggagaaagaagaatga

SEQ ID NO: 1704 - DNA, 549 bp, Streptococcus pneumoniae
atgattaaatatagtatccgtggtgaaaacctagaagtaacagaagcaattcgtgattatgtagtttctaaactcgaaaagatcgaaaagtacttccaaccagaacaagagttggatgcccgaattaacttaaaagtttatcgtgaaaaaacggctaaagtggaagtaacgattccgcttggatctattactctccgcgcagaagatgtatctcaagatatgtatggttcaattgaccttgtaactgataaaattgaacgtcagattcgtaaaaataaaacaaaaatcgagcgtaaaaataaaaataaggtagcaactggtcaattatttacagatgctttggtggaagattcaaatgttgtccagtctaaagttgttcgttcaaaacaaattgatttaaaaccaatggatttggaagaagcaattctacaaatggatttattggggcatgatttctttatctatgtagatgttgaagatcagacaaccaatgtgatttatcgtcgtgaggatggtgaaattggtttgttagaggttaaagaatcttaa

SEQ ID NO: 1705 - DNA, 663 bp, Streptococcus pneumoniae
atgaagtgcttgttatgtgggcagactatgaagactgttttaacttttagtagtctcttacttctgaggaataatgactcttgtctttgttcagactgtgattctacttttgaaagaattggggaagagaactgtccaaattgtatgaaaacagagttgtcaacaaagtgtcaagattgtcaactttggtgtaaagaaggagttgaagtcagtcatagagcgatttttacttacaatcaagctatgaaggattttttcagtcggtataagtttgatggagacttcctgttaagaaaagttttcgcttcatttttaagtgaggagttgaaaaagtacaaagagtatcaatttgttgtaattcccctaagtcctgatagatatgctaacagaggatttaatcaggttgagggcttggtagaggcagcaggctttgagtatctggatttattagagaaaagagaagagagagccagttcttctaaaaatcgttcagagcgcttggggacagaacttcctttctttattaaaagtggagtcactattcctaaaaaaatcttacttatagatgatatctatactacaggagcaactataaatcgtgttaagaaactgttggaagaagctggtgctaaggatgtaaaaacattttcccttgtaagatga

SEQ ID NO: 1706 - DNA, 1299 bp, Streptococcus pneumoniae
atgaaagtaaatttagattatctcggtcgtttatttactgagaatgaattaacagaagaagaacgtcagttggcggagaaacttccagcaatgagaaaggagaaggggaaacttttctgtcaacgttgtaatagtactattctagaagaatggtatttgcccatcggtgcttactattgtcgagagtgcttgctgatgaagcgagtcagaagtgatcaaactttatactattttccgcaggaggattttccgaagcaagatgttctcaaatggcgcggccaattaactccttttcaagagaaggtgtcagagggactgcttcaagcagtagacaagcaaaagccaaccttagttcatgcggtaacaggagctggaaagacagaaatgatttatcaagtagtggctaaagtgatcaatgcgggtggtgcagtgtgtttggctagtcctcgcatagatgtttgtttggagctgtacaagcgcctgcaacaggatttttcttgcgggatagctttgctacatggagaatcggaaccttattttcgaacaccactagttgttgcaacaacccatcagttattgaagttttatcaagcttttgatttgctgatagtggatgaagtagatgcttttccttatgttgataatcccatgctttaccacgctgtcaagaatagtgtaaaggagaatggattgagaatctttttaacagcgacttcgaccaatgagttagataaaaaggtccgtttaggagaactaaaaagactgaatttaccgagacggtttcatggaaatccgttgattattccaaaaccaatttggttatcggattttaatcgctacttagacaagaatcgtttgtcaccaaagttaaagtcctatattgagaagcagagaaagacagcttatccgttactcatttttgcttcagaaattaagaaaggggagcagttagcagaaatcttacaggagcaatttccaaatgagaaaattggctttgtatcttctgtaacagaggatcgattagagcaagtacaagcttttcgagatggagaactgacaatacttatcagtacgacaatcttggagcgtggagttaccttcccttgtgtggatgttttcgtagtagaggccaatcatcgtttgtttaccaagtctagtttgattcagattggtggacgagttggacgaagcatggatagaccgacaggagatttgcttttcttccatgatgggttaaatgcttcaatcaagaaggcgattaaggaaattcagatgatgaataaggaggctggtctatga

SEQ ID NO: 1707 - DNA, 636 bp, Streptococcus pneumoniae
atggaatttaggacaattaaagaggacggccaagtccaagaagaaatcaaaaaatctcgctttatctgccatgccaagcgtgtttatagcgaagaagaggctcgtgacttcattactgccatcaaaaaagaacactacaaagcgacacataactgctctgcctttattattggagaacgtagtgaaattaaacgtacaagtgatgatggtgagcctagtggtactgctggtgttcccatgcttggggtactagaaaatcacaatctcaccaatgtctgtgtggtcgtgacacgctactttggtggtattaaactaggcgctggaggactaattcgtgcttacgccggcagtgtcgccttagctgtcaaagaaattggtattattgaaataaaagaacaggctggcattgctattcaaatgtcttatgctcagtaccaagagtacagtaacttccttaaagaacatgatctcatggagctggatacaaactttacagatcaagtcgatacgatgatttatgttgataaggaagaaaaagaaactattaaagctgcacttgtggagttttttaatggaaaagtcactttaactgaccaaggtttacgagaggttgaagttcctgtaaacttagtgtaa

SEQ ID NO: 1708 - DNA, 927 bp, Streptococcus pneumoniae
atgtctatttataacaacattactgaattaatcggtcaaacaccgattgttaaacttaacaacatcgtgccagaaggtgctgcagacgtctatataaagcttgaagcatttaatcctggttcatctgtaaaagaccgtattgcccttagcatgattgaaaaagctgaacaagatggtattctgaaacctggttctactattgttgaagcaacaagtggaaacactggtattggactttcatgggtaggtgctgctaaagggtataaagtcgtcatcgttatgcctgaaactatgagtgtagaacgacgtaaaattatccaagcttatggtgctgaactcgtcctaactcctggtagcgagggaatgaaaggtgctattgctaaggctcaagaaatcgctgctgaacgtgatggtttccttcctcttcaatttgacaatccagctaatccagaagtacacgaaagaacaacaggagctgagatactagctgctttcggtaaagatggattagatgcctttgttgctggagtaggtaccggtggaacgatttctggtgtttctcatgcactcaaatcagaaaattctaacattcaagtttatgcagtggaagctgatgaatctgctattctatctggtgaaaaacctggtcctcacaaaattcaaggtatctcagctggatttattcctgatacacttgatactaaagcctatgatggtatcgttcgtgtaacatcagatgatgctcttgcactcggacgtgaaattggtggaaaagaaggcttccttgtagggatttcctcagctgcagctatctacggagccatcgaggttgccaaaaaattaggtacaggtaaaaaagtccttgctctagcaccagataacggtgaacgttatctctctacagcactctatgaatttgaagtttag

SEQ ID NO: 1709 - DNA, 1041 bp, Streptococcus pneumoniae
atggcagaaattacagctaaacttgtaaaagagttgcgtgaaaaatctggtgccggtgttatggacgctaaaaaagcgcttgtagaaacagacggtgacatcgaaaaagcgattgaattgcttcgtgaaaaaggtatggctaaggcagctaagaaagctgaccgtgttgctgcagaaggtttgactggtgtttatgttaacggtaatgttgcagcagttattgaagtaaacgctgaaactgacttcgttgcaaaaaacgctcaattcgttgaattggtaaatactacagctaaagtcattgctgaaggaaaacctgctaacaatgaagaagctcttgctttgataatgccttcaggtgaaactcttgaagctgcatacgtatctgcaacagcaactatcggagagaaaatctcattccgtcgctttgcattgattgaaaaaacagacgcacaacactttggagcataccaacataacggtggacgtatcggtgttatttcagttgttgaaggtggagacgaagcacttgctaaacaattgtcaatgcacatcgcagcgatgaaaccaacagttctttcttacaaagaattggatgagcaattcgttaaagatgagttggcacaattgaatcacgttatcgaccaagacaacgaaagccgtgcaatggttaataaaccagctcttccacacttgaagtatggatcaaaagctcaattaactgatgatgttattgctcaagctgaagctgacatcaaagctgaattggctgcagaaggcaaaccagaaaaaatctgggacaaaattattccaggtaaaatggatcgcttcatgcttgataacactaaagttgaccaagcttacacacttcttgcacaagtttacatcatggatgacagcaagacagttgaagcataccttgaatcagttaacgcttcggtagttgagtttgctcgctttgaagttggtgaaggtatcgagaaagctgcaaacgacttcgaagctgaagttgcagctacaatggcagcagccttgaataactaa

SEQ ID NO: 1710 - DNA, 387 bp, Streptococcus pneumoniae
ttgagcgttttttgcaacgaagtcagtttcagcgtttacttcaataactgctgcaacattaccgttaacataaacaccagtcaaaccttctgcagcaacacggtcagctttcttagctgccttagccatacctttttcacgaagcaattcaatcgctttttcgatgtcaccgtctgtttctacaagcgcttttttagcgtccataacaccggcaccagatttttcacgcaactcttttacaagtttagctgtaatttctgccattttaattctcctatattttttgaaaataggagagccgggctaagccccgccctcctaggtaattactatttgtataaattaagcgttgtcaccttctacaacttcaacgatttcttcaattga

SEQ ID NO: 1711 - DNA, 864 bp, Streptococcus pneumoniae
ttgatgaattgtgaagcagttgcccttgggtcgttttgcgagttgaagtcaagaagaggaaaaaaacaaaaaggagaaatactcatggcagtaatttcaatgaaacaacttcttgaggctggtgtacactttggtcaccaaactcgtcgctggaatcctaagatggctaagtacatctttactgaacgtaacggaatccacgttatcgacttgcaacaaactgtaaaatacgctgaccaagcatacgacttcatgcgtgatgcagcagctaacgatgcagttgtattgttcgttggtactaagaaacaagcagctgatgcagttgctgaagaagcagtacgttcaggtcaatacttcatcaaccaccgttggttgggtggaactcttacaaactggggaacaatccaaaaacgtatcgctcgtttgaaagaaattaaacgtatggaagaagatggaactttcgaagttcttcctaagaaagaagttgcacttcttaacaaacaacgtgcgcgtcttgaaaaattcttgggcggtatcgaagatatgcctcgtatcccagatgtgatgtacgtagttgacccacataaagagcaaatcgctgtcaaagaagctaaaaaattgggaatcccagttgtagcgatggttgacaccaatactgatccagatgatatcgatgtaatcatcccagctaacgatgacgctatccgtgctgttaaattgatcacagctaaattggctgacgctattatcgaaggacgtcaaggtgaggatgcagtagcagttgaagcagaatttgcagcttcagaaactcaagcagattcaattgaagaaatcgttgaagttgtagaaggtgacaacgcttaa

SEQ ID NO: 1712 - DNA, 225 bp, Streptococcus pneumoniae
ttgttacagctgttgaatcaacaacacgtatccaagtatcagaatcaaattatgcaggtaatcgtacaattggaaatcaccgtggatggttcaatccaacaacaacttctgaaggttttgttacatatatttatgcagattaatttacagagggactcgaatagagccctcttttcaggttttaccgtgacaatccctattaaaaattatatcaaaatagcttga

SEQ ID NO: 1713 - DNA, 1179 bp, Streptococcus pneumoniae
atgaagaaaaaaatcttagcgtcacttttattaagtacagtaatggtttctcaagtagctgttttaacaactgcgcatgcagaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaagggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctagccaacaacaatcagtacttgcttcagcaaacactaacttaacagctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaacttctgaaggttttgttacatatatttatgcagattaa

SEQ ID NO: 1714 - DNA, 240 bp, Streptococcus pneumoniae
ttttattatcttgagcagcaattttgtcatcagtcgtttctgcatgcgcagttgttaaaacagctacttgagaaaccattactgtacttaataaaagtgacgctaagatttttttcttcatattacgtagatactccttcttttaaagacaatactagtataccaaaaaaaggcctaataaatattacgcctttgttacatttatatgtcgttcttatagataatatttttcaaaaataa

SEQ ID NO: 1715 - DNA, 495 bp, Streptococcus pneumoniae
atgagacagttgaagcgagttggagtatttttattgcttcctttctttgttctaattgacgcccatattagccagcttctgggctcatttttcccccatgtacatttggctagtcattttctttttctatttctcttatttgagacgatagaagtatcagagtatctctacctagtctattgttttgttataggcttggtttatgatgtttactttttccatctaatagggattacaactctcttatttatcttattgggagccttccttcataaattgaatagtgttattttgttgattcgttggacaagaatgctagctatgattgtgctgacattcctgtttgaaatgggtagttatcttttggcttttatggtagggttgacagtagatagcatgtcgatttttatagtctatagcttggtaccgacgatgattttaaattttttatggattactgtttttcaatttatttttgaaaaatattatctataa

SEQ ID NO: 1716 - DNA, 819 bp, Streptococcus pneumoniae
atgaaccgttttaaaaaatcaaaatatgtcattattgtttttgtcactgttctgcttgtgtcagctctcttagcgacgacttattcaagtacaattgtgacaaaattaggagatggaatctcattggttgatagagttgtacaaaaaccttttcagtggtttgattctgtcaaatcagatttggctcatttgacacgaacatataatgaaaatgaaagtttgaagaaacagctttaccaattagaagttaaatcaaatgaggtggaaagtttaaagacagaaaatgaacaactgcgccaattgcttgatatgaagtctaaattgcaagccacaaagactttagcagcagatgttattatgcgttctccggtatcttggaagcaggagttgaccttagatgcaggtagatcaaaaggtgcttctgagaacatgttagctattgcaaatggtggcttgattgggagtgtttcaaaagtagaggagaaatctactatagtcaaccttctgacaaatacggaaaatgctgataagatttctgttaaaattcaacatggctctactacaatttatggaattattattggctatgacaaggaaaatgacgttcttaaaattagccaattaaatagtaatagcgatattagtgcgggagataaggtgactactggtggattaggaaactttaacgttgctgatattcctgttggtgaagtggttgccacaacgcatagtacagactatttgacacgagaagtaactgttaaattgagtgcagatactcataatgtagatgtgatagaattagtggggaattcataa

SEQ ID NO: 1717 - DNA, 795 bp, Streptococcus pneumoniae
atggatagtatgattttagggcgttatatcccaggggattcgattgttcaccgattggatccacgtagcaaattgcttgctatgatgctactgattttgattgtgttttgggctaataaccccttgacgaatctgattctttttatagcgacagggatatttattgccttgtcaggagtatctctttcattttttattcagggcttgaagtctatgtttttcttgattgccttcacaactatttttcaactatttttcatttctaatgggaatgttttatttgagttttcgtttgtgagaatcacggattatgctttgcaacaagctgggattattttttgtcgctttgtattgattattttcttttcaactttgttaaccttaacaaccatgcctttaagtttggcatcagctgtcgaagctttattagcacctttaaagcgtgtgaaagttccagttcatgaaattggattgatgctgtctatgagtttgcgttttgtcccaaccttgatggatgatacgacgcggattatgaatgcacagaaagctcgtggagtggattttggagaaggaagcatcgttcaaaaagtaaaggcgatgattcccattttgattcctctttttgcgacaagtttaaaacgtgcagattccttggctatcgctatggaagcgcgtggctatcagggtggaaaaggcagaagtcaataccgacaattgaaatggactctaaaggatacgctgaccattcttgttattctcgtacttggttgttgtttatttttcttaaaatcttag

SEQ ID NO: 1718 - DNA, 171 bp, Streptococcus pneumoniae
gtggatccaatcggtgaacaatcgaatcccctgggatataacgccctaaaatcatactatccatttagcgactccttgaactcctctatcttaaccggtaatcgtttaaatgacacgcctctatcagccaatcgtttacaaaaggccgtaattttaggtactcccaactga

SEQ ID NO: 1719 - DNA, 840 bp, Streptococcus pneumoniae
atgggaattgctctagaaaatgtgaattttacatatcaagaaggtactcccttagcttcagcagctttgtcggatgtttctttgacgattgaagatggctcttatacagctttaattgggcacacaggtagtggtaaatcaactattttacaactcttaaatggtttattggtgccaagtcaagggagtgtgagggtttttgataccttaatcacctcgacttctaaaaataaagatattcgtcaaattagaaaacaggttggcttggtatttcagtttgctgaaaatcagatttttgaagaaacggttttgaaggacgttgcttttggaccgcaaaattttggagtttctgaagaagatgctgtgaagactgcgcgtgagaaactggctctggttggaattgatgaatcactttttgatcgtagtccgtttgagctgtcagggggacaaatgagacgtgttgccattgcaggcatacttgccatggagccagctatattagtcttagatgagccaacagctggtctagatcctctagggagaaaagagttgatgaccctgttcaaaaaactccaccagtcagggatgaccatcgtcttggtaacgcatttgatggatgatgttgctgaatatgcgaatcaagtctatgtaatggaaaagggacgtttagtaaaggggggcaaaccaagtgatgtctttcaagacgttgtttttatggaagaagttcagttgggagtacctaaaattacggccttttgtaaacgattggctgatagaggcgtgtcatttaaacgattaccggttaagatagaggagttcaaggagtcgctaaatggatag

SEQ ID NO: 1720 - DNA, 348 bp, Streptococcus pneumoniae
gcatattcagcaacatcatccatcaaatgcgttaccaagacgatggtcatccctgactggtggagttttttgaacagggtcatcaactcttttctccctagaggatctagaccagctgttggctcatctaagactaatatagctggctccatggcaagtatgcctgcaatggcaacacgtctcatttgtccccctgacagctcaaacggactacgatcaaaaagtgattcatcaattccaaccagagccagtttctcacgcgcagtcttcacagcatcttcttcagaaactccaaaattttgcggtccaaaagcaacgtccttcaaaaccgtttcttcaaaaatctga

SEQ ID NO: 1721 - DNA, 786 bp, Streptococcus pneumoniae
atgaaatcaataattgatgtaaaaaatctttcttttcgctataaagaaaatcagaactactacgatgtgaaggatattacgtttcacgtgaaacgtggagaatggctttcgattgtagggcataatggtagtggtaaatcaacgacggttcgattaattgatggcttactggaagcagaatccggagagattgtaattgatggccaacgtttgactgaggaaaatgtttggaatatacgtcgtcaaatcggtatggtttttcaaaatccagacaatcaatttgttggagcgactgttgaagatgatgttgcttttggtttggaaaatcagggactttctcgtcaagaaatgaaaaagagagtggaagaagctctggctttagttggcatgttggactttaaaaagagagagccagcgcgtctatcaggtggccaaaagcaacgtgtggccattgcaggtgttgtagccctaagaccagctattttaatcttagatgaagcaacgagtatgttggatcctgaggggcgtagagaacttattgggacagtaaaaggaattcgaaaagactatgatatgacagtcatttctattacccatgatttggaagaagtcgccatgagtgatcgcgtattggtcatgaaaaaaggggaaattgaatcaactagtagtccaagggagcttttctctcgaaatgatttagatcaaattggattagacgatccttttgctaatcaattaaaaaaatctttgaccagaatggctatgatttacctgaaaattatttga

SEQ ID NO: 1722 - DNA, 225 bp, Streptococcus pneumoniae
tcttttcgaattccttttactgtcccaataagttctctacgcccctcaggatccaacatactcgttgcttcatctaagattaaaatagctggtcttagggctacaacacctgcaatggccacacgttgcttttggccacctgatagacgcgctggctctctctttttaaagtccaacatgccaactaaagccagagcttcttccactctctttttcatttcttga

SEQ ID NO: 1723 - DNA, 546 bp, Streptococcus pneumoniae
atgaaaaaagaacaaattcccaatctcttaacaataggtcgaattctctttatacctatttttatctttattttaacgataggaaattcgatagagagtcatatagttgcagctattatctttgctgttgccagtattaccgactatttagatggatatttagctcgtaaatggaatgtggtcagtaattttggtaaatttgcagatcctatggcggataagttactagttatgtcggcttttattatgttgattgagttaggtatggctccggcttggattgttgcagtgattatctgtcgtgagttagctgtgacaggtttaaggcttttattggttgaaactggtggaacaattttagcagcagcaatgcctggaaaaattaaaacttttagtcagatgtttgccattattttcttgctattacattggactttgcttggtcaagttctactttatgtagccttatttttcactatctactctggctatgactatttcaagggtagtgcctatgtatttaaagggacatttggttcgaaatga

SEQ ID NO: 1724 - DNA, 831 bp, Streptococcus pneumoniae
atgacaagtatgagaaaaaaaacaattggagaggttttacgattagctagaatcaatcagggattgagtttagatgaattgcagaaaaagacagaaatccagttagatatgttggaagcaatggaagcagacgatttcgatcaacttccaagtcctttttacacgcgttctttcttgaaaaaatatgcatgggctgttgagttagatgaccaaattgttttggatgcttatgattctgggagtatgattacttatgaggaagtagatgttgatgaagatgagttgacaggtcgtagacgttcaagtaagaaaaagaagaaaaaaacatcatttttacctttattttattttatcctttttgctttatcgattttaatttttgtgacttattatgtttggaactatattcaaactcaaccagaggagccttctctttctaattacagtgtggttcaatcaacaagttcaactagctctgttccccactcctcaagtagtagttcttctagtatagaatcagctataagtgtatcaggcgaaggaaatcatgtagaaatcgcttataagacaagtaaggaaacagttaaattgcaattggcagtttcagatgttacaagttgggtcagtgtttcagaaagcgaacttgagggcggtgtaaccttatcgccaaagaagaaaagtgcagaagcaacagttgcaactaaaagtcctgtaacaattacgttaggtgttgtaaaaggtgttgatttgacagtagataatcagactgttgatttatcgaaattaacagctcagactggacaaatcactgtaacctttactaaaaattaa

SEQ ID NO: 1725 - DNA, 1284 bp, Streptococcus pneumoniae
atgacaaaggttgtttttgaagaaaaatactatccagctgtaaaagaaatggtttatcgaactcgtttggccaacggattgacagttgctcttttgcctaaaaaggaatttaaagaggtttacgggagtgtcactgtacagtttggttcggtagatacgtttgtcacagaagttgacggagatgtaaaacaatatcctggaggaattgctcattttcttgaacataaattatttgagagagaagattctagtgatttgatgtcggcttttacgagtctaggtgcagatagtaatgcctttacaagctttacaaaaacaaactatcttttttcagcaacggattattttttagaaaatttagatttacttgatgaattggtaacatcagcacactttactgaagcttccattctgacagagcaggatattattcagcaagaacgagaaatgtaccaagatgatccagattcgtgtttattcttttcaactttagcgaatttgtatcctggtacacctttagcaactgatatagttggaagtgaggagtccatttcccaaatcaatctaactaatttgcaagaaaattttacaaagttttacaaacctgtaaacatgtctctgtttttagttggtaattttgatgtggagcgagtacaggactattttgaaagcaaagaactgaaagattcagattttcaggaagtagcaagagaaaagttgtttttacagcctgtaaagctaacagatagtatgagaatggaagtatcttctcccaaactagcgattggagttagaggtaagcgagaagtttctgaagcggattgctatcgacatcatattttattaaaattattgtttgcaatgatgtttggttggacttcggatcgttttcaaaaatgttatgaatcaggtaaaattgatgcgtccttatctctggaagttgaaataacaagtcgctttcattttgtcatgttgacaatggatacgaaagagccagttgctttgtctcatcaatttaggaaggctattcgtaattttacaaaggatttagatattacagaggaacatttagatattatcaaaagagagatgtttggcgaatttttcagtagcatgaactctcttgaatttattgcaacgcaatatgatgcttttgaaaatggtgagacaatttttgatttgccgaaaattttacaggaaattactttagaggatgtccttgatgctggacatcatttaatagatgatggtgacatagttgattttacaatattcccatcgtag

SEQ ID NO: 1726 - DNA, 1251 bp, Streptococcus pneumoniae
atggagttagtgcatggaatttcaacacattttatccaatcaaaaaagtttaaaacaaacaaaattaccgtgcgttttaccgctccattatcccttgatacgattgcaggtcacatgttgagtgcaagtatgctagagactgctaatcagatgtaccccacttctcaagatttgaggagacacttggccagtctatacggtacagatatgtcaaccaattgtttcagaagagggcaaagccacattatagaattgacatttacctatgttcgtgatgagtttttaagtaggaaaaacgtgctaacctctcagattttggaacttgtaaaagaaactcttttttcacccgtagtagttgataatgggtttgatccggccttatttgaaattgagaaaaaacaattgctagcaagtttagcagctgatatggatgattctttttattttgcacataaagaattggataaattgttttttcatgatgaacgtcttcaattggaatatagtgatttacgaaatcgtattttagctgaaactccacaaagttcttactcttgtttccaagaatttttagccaatgatcgaatagatttctttttcctaggtgattttaatgaggttgaaattcaaaatgtattagaatcatttggctttaaaggtcgaaaaggagatgtgaaggttcagtattgtcaaccttattctaatatccttcaggaaggtatggttcggaaaaatgtgggacaatccattttggaattaggttatcattaccgttctaaatatggtgatgaacaacatttacccatgattgtaatgaatggtttacttggtggatttgctcactctaagctctttacaaatgtccgtgaaaatgctggattagcttataccatttcaagtgagcttgatttatttagtggattcttgaggatgtatgctggtatcaatcgagaaaatcgtaaccaggctcgtaaaatgatgaataatcaactgcttgatttaaaaaaaggttattttacagagtttgagttaaatcagaccaaggaaatgattcgttggtcgttgttactttctcaagataatcaatcttcattgattgaacgtgcttatcaaaatgccttatttggaaaatcttcagcagactttaaaagttggattgcaaagcttgaacaaattgacaaagatgctatttgtagagtagctaataatgtgaaactacaagcgatttactttatggaaggaatagaatga

SEQ ID NO: 1727 - DNA, 369 bp, Streptococcus pneumoniae
atggaatacaaattatttgaagaatttattaccctccaagcactactcaaagaacttggaattacacatagcggaggagctattaaatcatttctctctgaacattctgtttactttaatagggaattagagagtcgtcgtggaaaaaaacttcgtattggcgataaagttgacatccctgacatgaacattgacatcttgttgacacaacctacttctgaagaacaagatgaataccaagctgataaagttgaaaaagaacggatcgctaaacttgtcaaaaagatgaataagggagttaaaaaagacaaatcgaaacctgcttcatcacctaaaagccaacaagctccacgattccctggtagataa

SEQ ID NO: 1728 - DNA, 1098 bp, Streptococcus pneumoniae
atgtggctacaacatctatctctcaagacttttcgtaattacaaagaaacgaaaatagactttaatcctaaattgaatgtctttttgggacgtaatgcacaaggaaaaacaaacatgttagaggctatctattttttagccttaacgcgtagtcatcgaactcgaacagataaaaatctcattcattttgatgaggaacaacttcatctttcaggtctcgttcagaaaaaaactggatccattcccctagaaatcgaactaacacaaaaaggccgtgtaacaaaagttaatcacttaaaacaggcacgcctttcagattatgtaggacacatgaatgttgtcttatttgctcctgaagatttacaactaattaaaggagcaccttcgattcgacgaaaattcattgatatggaacttgggcaaattaagccaatctatttatctgacttaaccaattataaccacatcctaaagcaaagaaacacttacctaaaatcagctcaaaaaatagatgaaacattcctttctgtgttagatgatcagctagttgattatggatgtcgtgtaatgaatcaccgcttagatttcataaaaaaactagaatcatttgggcgtaagaaacattttgaactctctaatcagatcgaagagttgtcaatatcctatcaatcttctgtcaatataactgacaaacaaaacttatccgaatctttcaaaattgctttagaaaaaagtagatccagagatttatttaaaaagaatactggtgtcggtcctcatcgagatgacatttctttttatataaatgggatggatgctagtttcggaagccaaggtcaacatcgtagtctcgtcctctcgataaaattagcagaaatcgaattaatggaaagcattaccacagaatctccgatattactgcttgacgatgtgatgagtgaacttgacaacactagacagttaaaattattagaaacgatttctcaatcaatccaaacctttatcacaacaacaagcttagaccatcttcaaaatctgccagaaaatctaagtatcttcactattcaggatggtaaagctgctgtaaatggaaattga

SEQ ID NO: 1729 - DNA, 1479 bp, Streptococcus pneumoniae
atgtctaattgggacactaaatttttgaaaaaaggttttacctttgatgatgtattgcttattccagctgaaagtcatgtgttgcctaacgatgcagatttaacaactaaattggcagataatttgactttaaatatcccaattattaccgctgccatggacacagttacagagagtcaaatggccattgctattgctcgtgcaggcggtctcggagttatccataaaaacatgtcaattgctcaacaagcagacgaggttcgtaaggtaaaacgttctgaaaatggagttattattgatccgttcttcttgacgcctgaacatacaattgctgaagcagatgagcttatgggtcgttaccgcatcagtggtgttccagttgttgaaacacttgaaaatcgtaaattggttggtattttgacaaaccgagatcttcgttttatttcagattataatcaaccaatttcaaaccatatgactagtgaaaatcttgttactgctcctgtgggtacggatcttgcaacggctgagagtattcttcaagagcatcgtattgaaaaacttccgttggtcgatgaagaaggcagtctttctggtttgatcactatcaaagatattgaaaaagttattgagtttccaaatgcggctaaagatgagtttggtcgtcttctagttgcaggtgcagtaggtgttacttcagatacatttgaacgtgcagaggctctttttgaggcaggagcggatgcgattgttattgatactgcacatggtcattctgcaggtgtcttgcgtaaaattgccgagattcgtgctcatttcccagatcggactttgattgctggaaatattgctactgctgaaggtgcacgtgccctttatgaagcgggtgtagacgttgttaaggttggtattggaccaggttctatctgtactactcgtgtgattgctggtgttggtgttccgcaagtaacagctatctacgatgctgcagctgttgcgcgcgaatatggtaaaacgattattgctgacggtgggatcaagtattctggagatattgtaaaagcacttgctgcaggtggaaatgctgttatgcttggatctatgtttgctggaactgatgaagctccaggcgaaactgaaatcttccaaggacgtaaattcaagacttaccgtggtatgggatcaattgctgctatgaagaaaggttcaagcgaccgttatttccaaggttctgtcaatgaagcaaacaagcttgttccagaaggaattgaaggtcgtgttgcttataaaggagcggcagctgatattgttttccaaatgattggtggtattcgctctggtatgggttactgtggtgcagctaaccttaaagaactacacgataatgctcaatttattgaaatgtctggtgctggtttgaaagaaagccatcctcatgatgtgcaaattactaatgaggcaccaaattattctatgtaa

SEQ ID NO: 1730 - DNA, 147 bp, Streptococcus pneumoniae
actgcacctgcaactagaagacgaccaaactcatctttagccgcatttggaaactcaataactttttcaatatctttgatagtgatcaaaccagaaagactgccttcttcatcgaccaacggaagtttttcaatacgatgctcttga

SEQ ID NO: 1731 - DNA, 1026 bp, Streptococcus pneumoniae
atgactaaacccattattttaacaggagaccgtccaacaggaaaattgcatattggacattatgttggaagtctcaaaaatcgagtattattacaggaagaggataagtatgatatgtttgtgttcttggctgaccaacaagccttgacagatcatgccaaagatcctcaaaccattgtagagtctatcggaaatgtggctttggattatcttgcagttggattggatccaaataagtcaactatttttattcaaagccagattccagagttggctgagttgtctatgtattatatgaatctagtttcgttagcacgtttggagcgaaatccaacagtcaagacagagatttctcagaaaggatttggagaaagcattccgacaggattcttggtctatccaatcgctcaagcagctgatatcacagctttcaaggctaattatgttcctgttgggacagatcagaaaccaatgattgagcaaactcgtgaaattgttcgttcttttaacaatgcatataactgtgatgtcttggtagagccggaaggtatttatccagacaatgagagagcagggcgtttgcctggtttagatggaaatgctaaaatgtctaaatcactaaataatggtatttatttagctgatgatgcggatactttgcgtaaaaaagtaatgagtatgtatacagatccagatcatatccgcgttgaggatccaggtaagattgagggaaatatggttttccattatctagatgtttttggtcgtccagaagatgctcaagaaattgctgatatgaaagaacgttatcaacgaggtggtcttggtgatgtgaagaccaagcgttatctacttgaaatattagaacgtgaactgggtcctattcgtgagcgccgtattgaatttgctaaggatatgggagaagtttataatatgattcaaaaaggtagtgaaagagcgcgtgaagttgcgggtcaaaccctatctgaggtaaaaggggcaatgggacttcattactttaactaa

SEQ ID NO: 1732 - DNA, 1623 bp, Streptococcus pneumoniae
ttgcttacagtatctgatgtttcactacgttttagtgatcgcaaactttttgatgatgtcaatatcaaatttacagaaggaaatacttacggattaatcggtgctaatggtgccggaaaatcaacctttttaaaaattttagctggagatatcgaacctactactggtcacatctctcttggtccagatgaacgtctctctgttcttcgtcaaaatcactttgactacgaagatgaacgtgccattgatgtcgttatcatgggaaatgaaaaactttatagcatcatgaaagagaaagatgctatctacatgaaggaagatttctcagacgaggacggggttcgtgctgccgaactcgaaggagagtttgccgaacttggaggttgggaagcagagagtgaagcctctcaactacttcaaaacctaaacattccagaagaattacactaccaaaacatgagcgaattggccaacggtgaaaaagtaaaggttctcctcgccaaagcactttttggtaaaccagatgttcttctcttggacgagcctactaacggtttggatatccaatcgattacttggttagaagacttcttaattgactttgataacacagttatcgtagtatcccacgaccgtcacttcttaaacaaagtttgtactcacatggccgaccttgactttggaaaaatcaaactctatgtcggaaactacgacttctggaaggaatcttctgagcttgctgctaaattgctagcagaccgtaatgctaaagcagaagaaaaaattaaacaattgcaagaattcgttgctcgtttctctgccaatgcttctaagtcaaggcaggcaacatcacgtaagaaaatgcttgataagattgagctagaagagattgtaccatctagtcgtaaatatccatttatcaactttaaagcggaacgtgagattggtaatgatctcttgacagtagaaaatctaactgtaaagattgatggtgaaactatcttggataatattagtttcatcttgcgtccagatgataagacagcacttattggacaaaatgatattcaaacgactgcattaattcgtgcaatcatgggagatattgactatgaaggaactgtcaagtggggagttacaactagtcaatcttacctaccaaaagataactcagctgattttgcaggaggagaatcaattcttgactggttgcgtcaattcgcaagtaaagaagatgatgacaatactttcctacgtggtttcctcggccgtatgctcttctctggagatgaagttaacaaacctgtaaatgtcttgtcagggggagaaaaagttcgtgtcatgctttcaaaactcatgctcttaaaatcaaatgtccttgtacttgatgatccaacaaatcacttggacttggaatctatctcaagcttgaatgatggattgaaaaactttaaagaatcaatcatctttgccagccatgaccacgaatttattcaaactttggctaaccatatcattgtcttatctaaaaatggcgtcattgaccgtatcgatgaaacctacgatgaattcctagaaaatgcagaagtacaagcaaaagttaaagaactttggaaagactaa

SEQ ID NO: 1733 - DNA, 2553 bp, Streptococcus pneumoniae
atgaaatcatttttaaaaacatatcgaacctattttatttctttcatcattcctgtagtgattatgtctggagtatatctatctcaaggtatctactggaatagcgacaactctcctctattaggagatggctttcatcaatacgttatttttgatatagccttacgaaatatcctacatggaaatagtagtctgttttacacctttacaagtggtctagggctaaacttctatgccctatctagttattacttgggtagttttctcgcgcctctggtttacttttttgatctaacgaatatgccagatgctatctatctgacaactctcttaaaatttggattgattggtctgtcaaccttttttagtttgaataaattgtttcaatctatccctcagactttaaaactagccttatctacttcctatgctctgatgagtttcactgtcagtcaattagagataaaaacctggctagatgtttttatcttgattcctttaattataactggtttacatctactgataactgaaaagaaactcctattgtactttacaagtctgtcaatcttatttattcaaaattattattttggatatatgacagtattgtttcttattttctggtatctctgtcaaatttcgtgggactttaagactcgaaaatcatctgttcttgatttcatagttatctcctttttagctggtatggctagtttgattatgactcttcccactctatttgatttacagacacatggggaaaaattgactgaagttacaaagtttcaaactgaaagtagctggtatcttgatctctttgctaagcaattcattggttcctttgacacaacaaagtatggggccatcccaatgatttttgttggactacttccctttattttgaccattttattttttacgctgaaatctattaagtttcacgtgaaactcatatatgtaatattctttgcatttctaattgcaagcttttacatagaagctcttgacttattttggcaaggcatgcatactccaaacatgtttttacatcgctatgcttggattttctctaccttgttaatttacacagcagcagaagtcttaaagcgtctgaaagaacttaaagtctggaattttttagtttcgctttttcttgtagtagcaggatttttagctaccatctatctaaaatcgcattattcttttttaacagatttgaatattctgcttactcttgaatttttggttgtctattctcttttactccttgcagttatcaaaaagtttatatctgtgaatctatttgccattctaatctctttatttatactggttgaaatgagtttaaatgcttcatctcaaatggacggaattgctaaggaatggggatttgcttctcgaagtgcttatagtcgagatatcccagctatggaatctttctcaacatatattggaaatcaatttactcgtactgaaaaactacaaactcagacaggaaatgacagtatgaaattcaactacaatggaatctctcaattttcatctgttcgaaatcgttcatcaagctctactttagataaacttggttttaaatcctctgggactaatctcaatctccgatatgcaaataatagtattttggctgatagtttatttggtatccagtacaatatctcagacagtcctattgataagtatggctttaaagatatctatcaaaaagataatcttaccctatatgaaaatcaatactctcttccgattgcagttgctagtcaatctgtttacaatgatgtcaagttcaatgaacataccttggataatcaggcctcatttttaaatcaacttgctaacgtcaattttgattatttttctccaataccttatgaaaaaacagaaaaaatagaaaatactaatgatttgattagtgtcacaagttcttcaaatgaagatgcagcaatccagtatcaaattgaagttccagaaaacagccaagtttatctctctttcataaaccttcacttttctaacgataaacaaaagaaggttgacatccttgtaaatggtgaaaaaaagacttttacaactgataatgtcttctccttctttaatctaggatatactaaagagaaaaaaactttcaatatcaatgttagtttccctggaaattcacaagtatcatttgaatctcctaccttctatcgtttagataccaaaactttcaccgaggcaattcaaaaaattaaagaacaacctgtcacagtatcaacttctaaaaacaaggtttttgctacatatgatgtccaacaagatacatctattttcttcaccattccttatgacaaaggttggtctgcctaccaagatggtaagaaaatagaaattaaacaagctcaaactggatttatgaaagttgacattcccaaggggaaaggaactattacactttccttcattccctatggttttattactggagcaatctgttcctttacttctctcttactatttggaatctataatcacagacgaaagtcatctaaggcataa

SEQ ID NO: 1734 - DNA, 315 bp, Streptococcus pneumoniae
ttggcaggaattttggtatatggaggagttcagcttattggtttaactgctaatcatgagatgagaatatttattctcatcatcctaacaagtttagtattcatgtctatggtgaccactttagcaacgtggaatagccgtataggagcttttttctcacttattttgcttttactacagttagcatcaagtgcaggtacttatccacttgctttgacaaatgatttctttagatctattaatccctggttaccaatgagctattcagtttcgggattacgacaaacaatctctatcaacaagtcattttcctag

SEQ ID NO: 1735 - DNA, 339 bp, Streptococcus pneumoniae
ttggcagatggatctaggaaactagcagaaggtggaacaaagttaacttctggattggaagatttacagacaggacttgcttctttaggacaaggactaggtaatgctagtgatcaactcaaatcagtatcaacagaatctaaaaatgcagagattttgtcaaatccactcaatctttcaaaaacagacaatgatcaagttcctgtaaatggaatcgcaatagctccttatatgatatcagttgctctttttgttgcagcaatatcaacaaatatgatatttgcgaaattgccttcaggacgtcatccagagagccgttgggcttggttgaaatcttga

SEQ ID NO: 1736 - DNA, 768 bp, Streptococcus pneumoniae
atgatcgggatttctcttattccagatctgtacaatatcatatttttgtcatcaatgtgggatccatatgggcaattgtctgacttacctgtggcagttgtaaataatgataaagaggcttcctataatggtaatactatggcaataggaaaagacatggtgtccaatttaaaagaaaataaaaccttggattttcattttgtagatgaagaggaaggaaagaagggattggaagatggcgattactatatggtagtgactttaccaagtgatttatctgacaaaacaactacattatccaatattcaatcgacagcagcttatcaatcattgacaagtgagcaacaaactgagataagtgattctgtatctcaaaattcaactgatagtattcaatcggctcagtcaattgtagctttagtacaagatttacagggaagtttagaaaacttacaaaatcaatcttctaatctttcgactttaaaaaatcaagctaatcaagtatcacctattacttctacttctttgataggattgtcaagtggattaacagagatacaaggagatgttactagcaaattagttcctgccagtcagtcgattgcatcaggtgtaaacgcatatactacaggtgttgataaagtttctcagggcgcaagtcaactaagtgaaaaaaatgccaccttgacaggtagtttggataaactagtttcaggctcaaacaccttgacacaaaaatcttctagattgacagcaggagttggttaa

SEQ ID NO: 1737 - DNA, 543 bp, Streptococcus pneumoniae
atgcaagaaagtaacaaacgcttaaaaacaaagcgaactattgaaaatgctatggtacaattactgatggaacagccatttgataaaatttctactgtcaaattagtagaaaaagccggaattagtcgttccagcttctatactcactataaggataagtatgatatgattgagcactatcaaagcaagctattccatacatttgaatatatttttcaaaaacatgctcatcacaaaagagacgctattttagaagtttttgaatatctagagtcagaaccacttctggctgtccttctttctgaaaatgggactaaagaaatccaaaatttcttacgaaataaacttcatatcatgcttagtacagatttacaaaagcgatttatgcaactgaatctaaataccaccgaattagaatatagtagcatctatctaactcatgcactttttggtgtctgccaaacttggattgcacatggaaaaaaagaaagttctcaagaaataacagacttccttatgaaaatgcttggtgatacaaattga

SEQ ID NO: 1738 - DNA, 753 bp, Streptococcus pneumoniae
atgaaagttttaattttagaagatgttattgaacatcaagtgagactagagagaatattggatgaaatttcgaaagaatcgaatattccaatatcatacaagacaacgggaaaagtccgtgaatttgaagaatacattgaaaatgatgaagtaaatcaactttatttcctagatatcgatattcatggaattgagaaaaagggatttgaagtggctcagctcattcgtcattacaatccttacgctattatcgtctttatcactagtcgatcagagtttgcgactctaacctataaataccaggtatcagccctagattttgttgataaggatatcaatgatgagatgtttaagaagagaattgagcaaaatatcttctacacgaagagtatgttacttgaaaatgaagatgttgtagattatttcgactacaattacaagggaaatgatttaaaaattccttaccatgatattttgtatattgaaacaacaggggtatctcataaattgcgcattattggtaagaattttgcaaaagagttttatggtaccatgacagatattcaggaaaaggacaaacatactcagcgattttattctcctcacaagtcatttttggtaaatataggcaatatcagagaaattgatcgaaaaaacttagaaattgttttctatgaagaccatcgttgtcctatttcaagattaaaaattagaaaattaaaagatattttagagaaaaaatctcaaaagtga

SEQ ID NO: 1739 - DNA, 1326 bp, Streptococcus pneumoniae
atggatttatttggatttgggacggttattgttcattttttaattattagtcacagttaccattttatttgtaaaggtcaaataaatagaaaagaattattcgtttttggtgcttatacattactaacagaaatagtatttgattttcccttatatattctatatttagatgggttagggattgaaagatttttatttcctttgggattatattcctattttcgatggatgaaacagtatgagagggatagaggactattcctaagtttactactatctcttttatatgagagcactcataactttctgtccgtaactttctcctctataacaggagataattttgttttacaatatcatttcccattctttttcgttgtgacggtgttaacctattttgttacattaaaaatcatttactatttccatttggaactagcctattttgacgaggactacctttatcctttcttgaaaaaagtattttttgctttactattgctacatattgtatctttcgtttcagatatggtaagtacgattaaacatttgaatagttttggaagtattttgtcatctattgtctttatctctctccttttgaccttctttgcaatgaattctcataaagttcaaatggagaaagagattgctttgaagcagaagaaatttgaacagaaacatttacagaattacacagatgaaattgttggtctgtataatgaaatccgtggttttcgacatgattatgctggaatgcttgtcagcatgcagatggcaattgacagtggtaatttacaggaaattgacagaatttacaatgaagttttagtcaaagcaaatcataaattgcgttcagataagtacacttactttgatttgaacaacatagaagactcagctttacgaagtttggttgctcagtcaattgtctatgctcgaaataatggtgtagagtttacactggaagtaaaagatacgattaccaagcttccaattgaactattggatttggttcgtatcatgagcgttttattgaataatgctgtcgaaggatcggctgatagctataaaaagcagatggaagtagcagttattaagatggaaactgaaacagttattgtgattcagaattcatgtaaaatgacgatgactccttcaggagatctatttgccttaggattctccactaagggaagaaatcgcggagtcggattaaataatgtgaaagaactactagataagtacaacaatattattttagaaacagagatggaaggcagtacatttagacaaatcattagatttaagagggaatttgaatga

SEQ ID NO: 1740 - DNA, 480 bp, Streptococcus pneumoniae
atgaaaattaaagttgtaacagttgggaaactgaaagaaaagtatttaaaagatggtatcgcagagtattcaaaacgaatttctagatttgctaagtttgaaatgattgagttatcagatgaaaaaacaccagataaggccagtgaatcagaaaatcaaaagattttagaaatagaaggtcagagaattttatcaaaaattgctgaccgtgatttcgttattgtgttagccattgaagggaaaactttcttctcagaagaatttagtaagcagttagaagaaacttctataaaaggattttctactcttacttttattattgggggaagtttaggattgtcatcatctgtaaaaaatagagccaatctttctgtcagttttggtcgcctaaccttaccccatcagttaatgagactagttcttgttgaacaaatctatcgcgcttttacgattcagcagggattcccctaccataaatag

SEQ ID NO: 1741 - DNA, 1194 bp, Streptococcus pneumoniae
atggaggcaaatatgaaacatctaaaaacattttacaaaaaatggtttcaattattagtcgttatcgtcattagcttttttagtggagccttgggtagtttttcaataactcaactaactcaaaaaagtagtgtaaacaactctaacaacaatagtactattacacaaactgcctataagaacgaaaattcaacaacacaggctgttaacaaagtaaaagatgctgttgtttctgttattacttattcggcaaacagacaaaatagcgtatttggcaatgatgatactgacacagattctcagcgaatctctagtgaaggatctggagttatttataaaaagaatgataaagaagcttacatcgtcaccaacaatcacgttataaatggcgccagcaaagtagatattcgattgtcagatgggactaaagtacctggagaaattgtcggagctgacactttctctgatattgctgtcgtcaaaatctcttcagaaaaagtgacaacagtagctgagtttggtgattctagtaagttaactgtaggagaaactgctattgccatcggtagcccgttaggttctgaatatgcaaatactgtcactcaaggtatcgtatccagtctcaatagaaatgtatccttaagatcggaagatggacaagctatttctacaaaagccatccaaactgatactgctattaacccaggtaactctggcggcccactgatcaatattcaagggcaggttatcggaattacctcaagtaaaattgctacaaatggaggaacatctgtagaaggtcttggtttcgcaattcctgcaaatgatgctatcaatattattgaacagttagaaaaaaacggaaaagtgacgcgtccagctttgggaatccagatggttaatttatctaatgtgagtacaagcgacatcagaagactcaatattccaagtaatgttacatctggtgtagttgttcgttcggtacaaagtaatatgcctgccaatggtcaccttgaaaaatacgatgtaattacaaaagtagatgacaaagagattgcttcatcaacagacttacaaagtgctctttacaaccattctatcggagacaccattaagataacctactatcgtaacgggaaagaagaaactacctctatcaaacttaacaagagttcaggtgatttagaatcttga

SEQ ID NO: 1742 - DNA, 759 bp, Streptococcus pneumoniae
atggaaaaatttgaaatgatttctatcacagatatacaaaaaaatccctatcaaccccgaaaagaatttgatagagaaaaactagatgaactagcacagtctatcaaagaaaatggggtcattcaaccgattattgttcgtcaatctcctgttattggttatgaaatccttgcaggagagagacgctatcgggcttcacttttagctggtctacggtctatcccagctgttgttaaacagatttcagaccaagagatgatggtccagtccattattgaaaatttacagagagaaaatttaaacccaatagaagaagcacgcgcctatgaatctctcgtagagaaaggattcacccatgctgaaattgcagataagatgggcaagtctcgtccatatatcagcaactccattcgtttactttccttgccagaacagattctttcagaagtagaaaatggcaaactatcacaagcccatgcgcgttccctagttgggttaaataaggaacaacaagactatttctttcaacggattatagaagaagatatttctgtaaggaaattagaagctcttctgacagagaaaaaacaaaagaaacagcaaaaaactaatcatttcatacaaaatgaagaaaaacagttaagaaaactactcggattagatgtagaaattaaactatctaaaaaagacagtggaaaaatcattatttctttttcaaatcaagaagaatatagtagaattatcaacagcctgaaataa

SEQ ID NO: 1743 - DNA, 1362 bp, Streptococcus pneumoniae
ttgaaagaaaaacaattttggaatcgtatattagaatttgcacaagaaagactgactcgatccatgtatgatttctatgctattcaagctgaactcatcaaggtagaggaaaatgttgccactatatttctacctcgctctgaaatggaaatggtctgggaaaaacaactaaaagatattattgtagtagctggttttgaaatttatgacgctgaaataactccccactatattttcaccaaacctcaagatacgactagctcacaagttgaagaagctacaaatttaactctttataactatagtccaaagttagtatctattccttattcagatacgggattaaaagaaaagtatacctttgataactttattcaaggggatggaaatgtttgggctgtatcagccgctttagctgtctctgaagatttggctctgacctataaccctctttttatctatggaggaccaggccttggtaagactcacttattaaacgctattggaaatgaaattctaaaaaatattcctaatgcgcgtgttaaatatatccctgccgaaagctttattaatgactttcttgatcacctaagacttggggaaatggaaaagtttaaaaagacctatcgtagtcttgatcttttgttaatcgatgatatccagtcactcagcggaaaaaaagttgcaactcaggaagaatttttcaatacctttaacgcccttcatgacaagcaaaaacagattgtcctaacgagtgatcgtagtccaaaacatctagaagggctcgaggagaggcttgtcacgcgttttagttggggattgacacaaactatcacaccccctgactttgaaacacgtattgccattttacaaagtaaaacggaacatttaggctacaatttccaaagtgatactctagaatacctagctgggcaatttgattcaaatgttcgagatcttgagggagccatcaacgacatcactttaattgccagagtaaaaaaaatcaaggatatcactattgatattgctgcagaagccattagagcccgcaaacaagatgttagccaaatgctcgtcatcccaattgataaaatccaaactgaagttggtaacttttatggtgttagtatcaaagaaatgaagggaagtagacgccttcaaaatattgttttggcccgtcaagtagccatgtatttatctagagaactaacagataatagtcttccaaaaattgggaaggaatttgggggaaaagatcataccacagtcattcatgcccatgccaaaataaaatctttgattgatcaagacgataatttacgtttagaaattgaatcaatcaaaaagaaaatcaaataa

SEQ ID NO: 1744 - DNA, 1137 bp, Streptococcus pneumoniae
atgattcatttttcaattaataaaaatttatttctacaagcattaaatactactaagagagctattagttctaaaaatgccattcctattttatcaacagtaaaaattgacgtgaccaatgaaggtattactttaattggttcaaatggtcaaatttcaattgaaaattttatttctcaaaaaaatgaagatgctggtttgttaattacttctttaggttcgatccttcttgaagcttctttctttatcaatgtagtatctagtttacctgatgtaactcttgattttaaagaaattgaacaaaatcaaattgttttaaccagtggcaaatcagaaattaccctaaaaggaaaagatagcgaacaatatccacgaatccaagaaatttcagcaagcactcctttaatacttgaaacaaaattactcaagaaaattattaatgaaacagcctttgctgcaagtacacaagagagtcgtccgattttaacaggtgtccacttcgtattgagtcaacacaaagagttaaaaacagttgcaacagactctcatcgcctaagccagaaaaaattgactcttgaaaaaaatagtgatgattttgatgtcgtaattcctagccgttctctacgcgaattttcagcggtatttacagatgatatcgaaactgtagagattttctttgccaataaccaaatcctctttagaagcgaaaatattagcttctatactcgtctcctagaaggaaactatcctgatacagatcgcttgattccaacagactttaacactactattacttttaatgtggtaaacttacgccagtcaatggagcgtgcccgtcttttatcaagtgcgactcaaaatggtactgtgaaacttgaaattaaggatggggttgttagcgcccatgttcactctccagaagttggtaaagtaaacgaagaaatcgatactgatcaggttactggtgaagatttgaccattagtttcaacccaacttacttgattgattctcttaaagctttaaatagcgaaaaggtgaccattagctttatctcagctgttcgtccatttactcttgtgccagcagatactgacgaagacttcatgcagctcattacaccagttcgtacaaattaa

SEQ ID NO: 1745 - DNA, 195 bp, Streptococcus pneumoniae
atgtatcaagttggaaattttgttgagatgaaaaaatcacacgcttgtacaatcaagtcgactggtaaaaaggctaatcgttgggaaattacacgtgtaggagcagatatcaaaataaaatgcagtaattgtgagcatgttgtcatgatggggcgatatgattttgagcgaaaaatgaataaaattattgactga

SEQ ID NO: 1746 - DNA, 1125 bp, Streptococcus pneumoniae
atgagaaatatggctttgacagcaggtatcgttggtttgccaaacgttggtaaatcaacactatttaatgcaattacaaaagcaggagcagaggcagcaaactacccatttgcgactattgatccaaatgttggaatggtggaagttccagatgaacgcctacaaaaactaactgaaatgataactcctaaaaagacagttcccacaacatttgaatttacggatattgcagggattgtaaaaggagcttcaaaaggagaagggctagggaataaattcttggccaatattcgtgaagtagatgcgattgttcacgtagttcgtgcttttgatgatgaaaatgtgatgcgcgagcaaggacgtgaagacgcctttgtagatccacttgcagatattgatacaattaatctggaattaattcttgctgacttagaatcagtgaacaaacgatatgcgcgtgtagaaaagatggcacgtacgcaaaaagataaagaatcagtagcagaattcaatgttcttcaaaagattaaaccagtcctagaagacgggaaatcagctcgtaccattgaatttacagatgaggaacaaaaggttgtcaaaggtcttttccttttgacgactaaaccagttctttatgtagctaatgtggacgaggatgtggtttcagaacctgactctatcgactatgtcaaacaaattcgtgaatttgcagcgacagaaaatgctgaagtagtcgttatttctgcgcgtgctgaggaagaaatttctgaattggatgatgaagataaaaaagagtttcttgaagccattggtttgacagaatcaggtgtagataagttgacgcgtgcagcttaccacttgcttggattgggaacttacttcacagctggtgaaaaagaagttcgcgcttggactttcaaacgtggtatgaaggctcctcaagcagctggtattatccactcagactttgaaaaaggctttattcgtgcagtaaccatgtcatatgaagatctagtgaaatacggatctgaaaaggccgtaaaagaagctggacgcttgcgtgaagaaggaaaagaatatatcgttcaagatggcgatatcatggaattccgctttaatgtctaa

SEQ ID NO: 1747 - DNA, 570 bp, Streptococcus pneumoniae
atgaccaaattacttgtaggcttgggaaatccaggggataaatattttgaaacaaaacacaatgttggttttatgttgattgatcaactagcgaagaaacagaatgtcacttttacacacgataagatatttcaagctgacctagcatcctttttcctaaatggagaaaaaatttatctggttaaaccaacgacctttatgaatgaaagtggaaaagcagttcatgctttattaacttactatggtttggatattgacgatttacttatcatttacgatgatcttgacatggaagttgggaaaattcgtttaagagcaaaaggctcagcaggtggtcataatggtatcaagtctattattcaacatataggaactcaggtctttaaccgtgttaagattggaattggaagacctaaaaatggtatgtcagttgttcatcatgttttgagtaagtttgacagggatgagtatatcggtattttacagtctgttgacaaagttgacgattctgtaaactactatttacaagagaaaaattttgagaaaacaatgcagaggtataacggataa

SEQ ID NO: 1748 - DNA, 3510 bp, Streptococcus pneumoniae
atggtgaccttattagatttattctcagaaaatgatcagattaaaaaatggcatcaaaatttaacagataagaaaagacaactaatacttggtttatcaacatctactaaggctcttgcaattgcaagcagtttagaaaaagaagataggattgtgttattgatgtcaacttatggagaagcagaaggacttgttagtgatcttatatctatcttgggtgaggaactcgtctatccatttttggtagatgatgctcctatggtggagtttttgatgtcttcacaggaaaaaattatttcacgggttgaagccttgcgttttttgactgattcatctaagaaagggattttagtttgtaatatcgcagcaagtcgattgattttaccgtctcccaatgcattcaaagatagtattgtaaaaatctcagttggtgaagaatatgatcaacacgcgtttatccatcagttaaaggaaaatggctatcgaaaagttactcaagtacaaactcagggcgaatttagtcttcgaggagatattttagatatttttgaaatatcccagttagaaccttgtcgaattgagttttttggtgatgaaattgatggtatcaggtcatttgaagtagaaacacaattatcgaaagaaaataagacagaactcactatctttccagctagtgatatgcttttgagagaaaaggattatcaacgaggacagtcagctttagaaaaacaaatttcaaaaactttatcacctattttgaaatcatacctagaagaaattctttcaagttttcaccaaaaacaaagtcatgcagactctcggaagtttttatctttgtgctatgataagacatggactgtctttgattatattgaaaaagatactccaatattctttgatgattatcaaaaattgatgaatcagtatgaagtctttgaaagagaattagcgcagtactttacagaagaattacagaatagtaaagcattttctgatatgcagtatttttctgatattgaacaaatctataaaaaacaaagtccagtgacctttttttctaatcttcaaaagggtttaggaaatctcaaatttgacaaaatttatcaattcaatcaatatcctatgcaggaatttttcaatcagttttcttttctaaaagaagaaattgaacgatataaaaaaatggattacaccattattctgcagtctagcaattcaatgggaagtaaaacattggaggatatgttagaggaatatcagattaaattggattctagagataagacaaatatctgtaaagaatctgtaaacttaatagagggtaatctcagacatggttttcattttgtagatgaaaagattttattgataactgaacatgagatttttcaaaagaaattaaagcgtcgttttcgaagacaacatgtttcaaatgcagagagattaaaagattacaatgaacttgaaaaaggggactatgttgtccatcatatccatgggattggtcaatatctaggaattgaaaccattgaaatcaagggaattcatcgtgattatgtcagtgtccaataccaaaatggtgatcaaatttctattcccgtggaacagattcatctactgtccaaatatatttcaagtgatggtaaagctccaaaactcaataaattaaatgacggtcattttaaaaaggccaagcaaaaggttaagaaccaggtagaggatatagctgatgatttaatcaaactctactctgaacgtagtcagttgaagggttttgctttctcagctgatgatgatgatcaagatgcctttgatgatgctttcccttatgttgaaacggatgatcaacttcgtagtattgaggaaatcaagagggatatgcaggcttctcagccaatggatcgacttttagttggggatgttggttttggaaagactgaagttgctatgcgtgcagcctttaaagcagtcaatgatcacaaacaggttgtcattctagttccgacgacggttttagcgcaacagcactatacgaattttaaggaacgattccaaaattttgcagttaatattgatgtgttgagtcgctttagaagtaaaaaagagcagactgcaacacttgaaaaattgaaaaacggtcaagtcgatattttgattggaacacatcgtgttttgtcaaaagatgttgtgtttgctgatttgggcttgatgattattgatgaggaacagcgatttggtgtcaagcataaggaaactttgaaagaactgaagaaacaagtggatgtcctaaccttgaccgctacgccaatccctcgtaccctccatatgtctatgctgggaatcagagatttatctgttattgaaactccgccgactaatcgctatcctgttcagacctatgttttggaaaagaatgatagtgtcattcgtgatgctgtcttgcgtgaaatggagcgtggaggtcaagtttattatctttacaacaaagttgacacaattgttcagaaggtttcagaattacaggagttgattccggaggcttcgattggatatgttcatggtcgaatgagtgaagtccagttggaaaatactctattagactttattgagggacaatacgatatcttggtgacgactactattattgagacaggggtggacattccaaatgctaatactttatttattgaaaatgcggaccatatgggcttgtcaaccttatatcagttaagaggaagagtcggtcgtagtaatcgtattgcttatgcttatctcatgtatcgtccagaaaaatcaatcagtgaagtctctgaaaagagattagaagcgattaaaggatttacagaattgggctctggctttaagattgcaatgcgagatctttcgattcgtggagcaggaaatcttttaggaaaatcccagtctggtttcattgattctgttggttttgaattgtattcgcagttattagaggaagctattgctaaacgaaacggtaatgctaacgctaacacaagaaccaaagggaatgctgagttgattttgcaaattgatgcctatcttcctgatacttatatttctgatcaacgacataagattgaaatttacaagaaaattcgtcaaattgacaaccgtgtcaattatgaagagttacaagaggagttgatagaccgttttggagaatacccagatgtagtagcctatctgttagagattggtttggtcaaatcatacttggacaaggtctttgttcaacgtgtggaaagaaaagataataaaattacaattcaatttgaaaaagtcactcaacgactgtttttagctcaagattattttaaagctttatccgtaacgaacttaaaagcaggcatcgctgagaataagggattaatggagcttgtatttgatgtccaaaataagaaagattatgaaattttagaaggtttgctgatttttggagaaagtttattagagataaaagagtctaaggaagaaaattccatttga

SEQ ID NO: 1749 - DNA, 297 bp, Streptococcus pneumoniae
ttgccaaagcgaatttcaacttggtcattaactttcaagtccgttgaacttttggccaagattccattaaccttgattctacctttatctgctacttcctttgcgactgtacgacgcttgataattcgcgatacttttaaatatttatctaatctcatccttattacctcaatttattattgtaccatttttatctattttatagaagaaaaatatcaaatggaattttcttccttagactcttttatctctaataaactttctccaaaaatcagcaaaccttctaaaatttcataa

SEQ ID NO: 1750 - DNA, 267 bp, Streptococcus pneumoniae
atgagattagataaatatttaaaagtatcgcgaattatcaagcgtcgtacagtcgcaaaggaagtagcagataaaggtagaatcaaggttaatggaatcttggccaaaagttcaacggacttgaaagttaatgaccaagttgaaattcgctttggcaataagttgctgcttgtaaaagtactagagatgaaagatagtacaaaaaaagaagatgcagcaggaatgtatgaaattatcagtgaaacacgggtagaagaaaatgtctaa

SEQ ID NO: 1751 - DNA, 369 bp, Streptococcus pneumoniae
atgtctaaaaatattgtacaattgaataattcttttattcaaaatgaataccaacgtcgtcgctacctgatgaaagaacgacaaaaacggaatcgttttatgggaggggtattgattttgattatgctattatttatcttgccaacttttaatttagcgcagagttatcagcaattactccaaagacgtcagcaattagcagacttgcaaactcagtatcaaactttgagtgatgaaaaggataaggagacagcatttgctaccaagttgaaagatgaagattatgctgctaaatatacacgagcgaagtactattattctaagtcgagggaaaaagtttatacgattcctgacttgcttcaaaggtga

SEQ ID NO: 1752 - DNA, 222 bp, Streptococcus pneumoniae
atgaagattatgctgctaaatatacacgagcgaagtactattattctaagtcgagggaaaaagtttatacgattcctgacttgcttcaaaggtgataaaatggaaaatttattagacgtaatagagcaatttttgagtttgtcagatgaaaagctggaagaattggctgataaaaatcaattattgcgtttacaagaagaaaaggaaaggaagaatgcgtaa

SEQ ID NO: 1753 - DNA, 1338 bp, Streptococcus pneumoniae
atgaaaagctggaagaattggctgataaaaatcaattattgcgtttacaagaagaaaaggaaaggaagaatgcgtaaattcttaattattttgttgctaccaagttttttgaccatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctgggaaattgactcccaaaacaagttttcaaataaccgagtggcgcttaaataaacaaggaattccagtatttaagctatcaaatcatcaatttatagctgcggacaaacgatttttatatgatcaatcagaggtaactccaacaataaaaaaagtatggttagaatctgactttaaactgtacaatagtccttatgatttaaaagaagtgaaatcatccttatcagcttattcgcaagtatcaatcgacaagaccatgtttgtagaaggaagagaatttctacatattgatcaggctggatgggtagctaaagaatcaacttctgaagaagataatcggatgagtaaagttcaagaaatgttatctgaaaaatatcagaaagattctttctctatttatgttaagcaactgactactggaaaagaagctggtatcaatcaagatgaaaagatgtatgcagccagcgttttgaaactctcctatctctattatacgcaagaaaaaataaatgagggtctttatcagttagatacgactgtaaaatacgtatctgcagtcaatgattttccaggttcttataaaccagagggaagtggtagtcttcctaaaaaagaagataataaagaatattctttaaaggatttaattacgaaagtatcaaaagaatctgataatgtagctcataatctattgggatattacatttcaaaccaatctgatgccacattcaaatccaaaatgtctgccattatgggagatgattgggatccaaaagaaaaattgatttcttctaagatggccgggaagtttatggaagctatttataatcaaaatggatttgtgctagagtctttgactaaaacagattttgatagtcagcgaattgccaaaggtgtttctgttaaagtagctcataaaattggagatgcggatgaatttaagcatgatacgggtgttgtctatgcagattctccatttattctttctattttcactaagaattctgattatgatacgatttctaagatagccaaggatgtttatgaggttctaaaatga

SEQ ID NO: 1754 - DNA, 1278 bp, Streptococcus pneumoniae
atgagggaaccagattttttaaatcattttctcaagaagggatatttcaaaaagcatgctaaggcggttctagctctttctggtggattagattctatgtttctatttaaggtattgtctacttatcaaaaagagttagagattgaattgattctggctcatgtgaatcataagcagagaattgaatcagattgggaagaaaaggaattaaggaagttggctgctgaagcagagcttcctatttatatcagcaatttttcaggagaattttcagaagcgcgtgcacgaaattttcgttatgatttttttcaagaggttatgaaaaagacaggtgcgacagctttagtcactgcccaccatgctgatgatcaggtggaaacgattttgatgcgcttgattcgaggaactcgcttgcgctatctatcaggaattaaggagaagcaagtagtcggagagatagaaatcattcgtcccttcttgcattttcagaaaaaagactttccatcaatttttcactttgaagatacatcaaatcaggagaatcattattttcgaaatcgtattcgaaactcttacttaccagaattggaaaaagaaaatcctcgatttagggatgcaatcttaggcattggcaatgaaattttagattatgatttggcaatagctgaattatctaacaatattaatgtggaagatttacagcagttattttcttactctgagtctacacaaagagttttacttcaaacttatctgaatcgttttccagatttgaatcttacaaaagctcagtttgctgaagttcagcagattttaaaatctaaaagccagtatcgtcatccgattaaaaatggctatgaattgataaaagagtaccaacagtttcagatttgtaaaatcagtccgcaggctgatgaaaaggaagatgaacttgtgttacactatcaaaatcaggtagcttatcaaggatatttattttcctttggacttccattagaaggtgaatcaattcaacaaatacctgtttcacgtgaaacatccatacacattcgtcatcgaaaaacaggagatgttttgattcaaaatgggcatagaaaaaaactcagacgtttatttattgatttgaaaatccctatggaaaagagaaactctgctcttattattgagcaatttggtgaaattgtctcaattttgggaattgcgaccaataatttgagtaaaaaaacgaaaaatgatataatgaacactgtactttatatagaaaaaatagataggtaa

SEQ ID NO: 1755 - DNA, 543 bp, Streptococcus pneumoniae
atgttagaaaacgatattaaaaaagtcctcgtttcacacgatgaaattacagaagcagctaaaaaactaggtgctcaattaactaaagattatgcaggaaaaaatccaatcttagttgggattttaaaaggatctattccttttatggctgaattggtcaaacatattgatacacatattgaaatggacttcatgatggtttctagctaccatggtggaacagcaagtagtggtgttatcaatattaaacaagatgtgactcaagatatcaaaggaagacatgttctatttgtagaagatatcattgatacaggtcaaactttgaagaatttgcgagatatgtttaaagcaagagaagcagcttctgttaaaattgcaaccttgttggataaaccagaaggacgtgttgtagaaattgaggcagactatacctgctttactatcccaaatgagtttgtagtaggttatggtttagactacaaagaaaattatcgtaatcttccttatattggagtattgaaagaggaagtgtattcaaattag

SEQ ID NO: 1756 - DNA, 1959 bp, Streptococcus pneumoniae
atgaaaaaacaaaataatggtttaattaaaaatccttttctatggttattatttatctttttccttgtgacaggattccagtatttctattctgggaataactcaggaggaagtcagcaaatcaactatactgagttggtacaagaaattaccgatggtaatgtaaaagaattaacttaccaaccaaatggtagtgttatcgaagtttctggtgtctataaaaatcctaaaacaagtaaagaaggaacaggtattcagtttttcacgccatctgttactaaggtagagaaatttaccagcactattcttcctgcagatactaccgtatcagaattgcaaaaacttgctactgaccataaagcagaagtaactgttaagcatgaaagttcaagtggtatatggattaatctactcgtatccattgtgccatttggaattctattcttcttcctattctctatgatgggaaatatgggaggaggcaatggccgtaatccaatgagttttggacgtagtaaggctaaagcagcaaataaagaagatattaaagtaagattttcagatgttgctggagctgaggaagaaaaacaagaactagttgaagttgttgagttcttaaaagatccaaaacgattcacaaaacttggagcccgtattccagcaggtgttcttttggagggacctccggggacaggtaagactttgcttgctaaggcagtcgctggagaagcaggtgttccattctttagtatctcaggttctgactttgtagaaatgtttgtcggagttggagctagtcgtgttcgctctctttttgaggatgccaaaaaagcagcaccagctatcatctttatcgatgaaattgatgctgttggacgtcaacgtggagtcggtctcggcggaggtaatgacgaacgtgaacaaaccttgaaccaacttttgattgagatggatggttttgagggaaatgaagggattatcgtcatcgctgcgacaaaccgttcagatgtacttgatcctgcccttttgcgtccaggacgttttgatagaaaagtattggttggccgtcctgatgttaaaggtcgtgaagcaatcttgaaagttcacgctaagaacaagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatgattgcacttcctaaagaggatcaaatgcttctatctaaagaagatatgaaagagcaattggctggcttaatgggtggacgtgtagctgaagaaattatctttaatgtccaaactacaggagcttcaaacgactttgaacaagcgacacaaatggcacgtgcaatggttacagagtacggtatgagtgaaaaacttggcccagtacaatatgaaggaaaccatgctatgcttggtgcacagagtcctcaaaaatcaatttcagaacaaacagcttatgaaattgatgaagaggttcgttcattattaaatgaggcacgaaataaagctgctgaaattattcagtcaaatcgtgaaactcataagttaattgcagaagcattattgaaatacgaaacattggatagtacacaaattaaagctctttacgaaacaggaaagatgcctgaagcagtagaagaggaatctcatgcactatcctatgatgaagtaaagtcaaaaatgaatgacgaaaaataa

SEQ ID NO: 1757 - DNA, 624 bp, Streptococcus pneumoniae
cgtccaacagcatcaatttcatcgataaagatgatagctggtgctgcttttttggcatcctcaaaaagagagcgaacacgactagctccaactccgacaaacatttctacaaagtcagaacctgagatactaaagaatggaacacctgcttctccagcgactgccttagcaagcaaagtcttacctgtccccggaggtccctccaaaagaacacctgctggaatacgggctccaagttttgtgaatcgttttggatcttttaagaactcaacaacttcaactagttcttgtttttcttcctcagctccagcaacatctgaaaatcttactttaatatcttctttatttgctgctttagccttactacgtccaaaactcattggattacggccattgcctcctcccatatttcccatcatagagaataggaagaagaatagaattccaaatggcacaatggatacgagtagattaatccatataccacttgaactttcatgcttaacagttacttctgctttatggtcagtagcaagtttttgcaattctgatacggtagtatctgcaggaagaatagtgctggtaaatttctctaccttagtaacagatggcgtgaaaaactga

SEQ ID NO: 1758 - DNA, 108 bp, Streptococcus pneumoniae
atgacgataatcccttcatttccctcaaaaccatccatctcaatcaaaagttggttcaaggtttgttcacgttcgtcattacctccgccgagaccgactccacgttga

SEQ ID NO: 1759 - DNA, 480 bp, Streptococcus pneumoniae
atgattaaagaattgtatgaagaagtccaagggactgtgtataagtgtagaaatgaatattaccttcatttatgggaattgtcggattgggaccaagaaggcatgctctgcttacatgaattgattagtagagaagaaggactggcagacgatattccacgtttaaggaaatatttcaaaaccaagtttcgaaatcgaattttagactatatccgtaagcaggaaagtcagaagcgtagatacgataaagaaccctatgaagaagtgggtgagatcagtcatcgtataagtgagggaggtctctggctagatgattattatctctttcatgaaacactaagagattatagaaacaaacaaagtaaagagaaacaagaagaactagaacgcgtcttaagcaatgaacgatttcgagggcgtcaaagagtattaagagacttacgcattgtgtttaaggagtttactatccgtacccactag

SEQ ID NO: 1760 - DNA, 246 bp, Streptococcus pneumoniae; identical to SEQ ID NO: 1035

SEQ ID NO: 1761 - DNA, 150 bp, Streptococcus pneumoniae; identical to SEQ ID NO: 1036

SEQ ID NO: 1762 - DNA, 186 bp, Streptococcus pneumoniae; identical to SEQ ID NO: 1037

SEQ ID NO: 1763 - DNA, 261 bp, Streptococcus pneumoniae; identical to SEQ ID NO: 1038

SEQ ID NO: 1764 - DNA, 408 bp, Streptococcus pneumoniae
ttcattggcattcggagtttatctgagattggtaatccgggatggacccctcacccaaatagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaaggcgccctattcagactcggtttccctacggctccgtctcttcaacttaacctcgcatcataacgtaactcgccggttcattctacaaaaggcacgctctcacccattaacgggctcgaacttgttgtag

SEQ ID NO: 1765 - DNA, 156 bp, Streptococcus pneumoniae
atgcgttccagcactcctcacggtataccttcatcacacatagaacgctctcctaccatacctataaaggtatccacagcttcggtaaattgttttagccccggtacattttcggcgcagggtcactcgactagtgagctattacgcactctttga

SEQ ID NO: 1766 - DNA, 156 bp, Streptococcus pneumoniae; identical to SEQ ID NO: 272

SEQ ID NO: 1767 - DNA, 246 bp, Streptococcus pneumoniae; identical to SEQ ID NO: 273

SEQ ID NO: 1768 - DNA, 234 bp, Streptococcus pneumoniae; identical to SEQ ID NO: 274

SEQ ID NO: 1769 - DNA, 207 bp, Streptococcus pneumoniae
atggacaatgcaagattccatagaatgggtaagctagaacttttatgtgaagagtttgggcataaacttttacctcttcttccctactcacctgagtacaatcctattgagaaaacatgggctcatatcaaaaagaacctcaaaaaggtattaccacgttgccataccttttacgaggctcttttgtcctgctcttgtttcaattga

SEQ ID NO: 1770 - DNA, 246 bp, Streptococcus pneumoniae
aacaccactataatctctatcagctcttgcttttccaccctgtttaaaaccttcctcaaagataaagagaaaatcgtcaacgcccttcaattaccttattccaacgccaaactggaagccaccaataatctcatcaaacttatcaagcacaatgcctttggttttaggaactttgaaaacttcaaaaaagaaaggacgaaatttgtcctttctagatcttcgctttcttcaacccactacagttga

SEQ ID NO: 1771 - DNA, 141 bp, Streptococcus pneumoniae
atgagctttattgctcaggactttgataagctcaatatcataactgttcttgagagcagaacacaagccatcatccgaaatcccatgaatacaaggctatcaagcgatactgaaagctcattcaacaagatagtcagaaac

SEQ ID NO: 1772 - DNA, 273 bp, Streptococcus pneumoniae
tataaaaaaattcaaactagaattcttcttagaaaaggccgttttaagtgctatcattgctcaaaaatggaggtcgctgagacttctatcgtcaagaagaatcatcaaattccttgtatcatcaaccaaaagattgatcagaagctaattgaaaagacttctatgaccgacattgatcatcagttgtctatttcaacttcaactgtcattcgcaagatcaatgattttcactttgagcatgatttttcgcgtcttcctgagattatgtcctag

SEQ ID NO: 1773 - DNA, 243 bp, Streptococcus pneumoniae
ttgattatgttacaaaaaatttatgagcagatgactaatttctatgatagtattgaagaagagtatggtcctacatttggtgataattttgactgggaacatgttcattttaaatttttaatttattatttagtgagatatggcattggttgtcgtaaggattttatcgtttaccattatcgtgttgcttatcgtttgtatcttgaaaaattggtaatgaatcggggttttatttcttgttga

SEQ ID NO: 1774 - DNA, 1329 bp, Streptococcus pneumoniae
atgtatgtgagaaaggaagagcctgagggctcagacaaaattatgacttcagttgttgttgtaggtacccaatggggtgatgaaggtaaagggaagattacagacttcctttcagcgaatgcagaagtgattgcacgttaccaaggtggtgataatgctggtcacacgattgtgattgacggtaagaaatttaagttgcacttgattccatctgggattttcttccctgaaaaaatatctgtcattgggaatggtatggttgtaaatcctaaatctcttgtaaaagagttgagctatcttcatgaggaaggtgtaacaactgataacttgcgtatttctgatcgtgcgcatgttattttgccttatcatatcgagttggatcgcttgcaagaagaagctaagggcgacaataagattggtacgacaattaagggaattggtccagcttatatggacaaggctgctcgtgttggaattcgtattgcagatcttttagataaagatattttccgtgagcgtttagaacgtaaccttgctgaaaagaatcgtctttttgaaaaattgtatgacagtaaagcgattgttttcgatgatatttttgaagaatattacgaatatggtcaacaaatcaagaaatacgtgatagatacatctgttatcttgaatgatgcgcttgataatggcaaacgtgtgctttttgaaggtgcacaaggtgttatgctagatatcgaccaaggtacttatccatttgttacgtcatcaaaccctgtagctggtggtgtgacaattggttctggtgtcggtccaagcaagattgacaaggttgtaggtgtatgtaaagcttatacgagtcgtgtaggagatggtcctttcccaactgagttgtttgatgaagtgggagaacgtatccgtgaagtgggtcatgagtatggtacaacaactggtcgtccacgtcgtgtaggttggtttgactcagttgtgatgcgtcatagccgtcgtgtttctggtattactaacctttctttgaactctattgatgttttgagcggtttggatactgtgaaaatctgtgtggcctatgatcttgacggtcaacgtattgactactatccagctagtcttgagcaattgaaacgttgcaagcctatctatgaagagttgccaggttggtcagaagatattaccggagttcgcaatttggaagatcttcctgagaatgcgcgtaactatgttcgtcgtgtgagtgaattggttggcgttcgtatttctactttctcagtaggtcctggtcgtgaacaaacaaatattttagaaagtgtttggtcctaa

SEQ ID NO: 1775 - DNA, 423 bp, Streptococcus pneumoniae
ttgagagaggctgagattgctcttgaacacgatgaaattccaattggttgtgtgattgtcaaagatggggaaatcattggtcgtgggcataatgcgcgtgaggaattacagcgagcggttatgcatgcggaaattatggctatagaggatgcgaacttgagtgaggagagctggcgcttgctggattgcacactttttgtgaccattgaaccttgtgtcatgtgtagtggagcgattgggcttgcccgcattccaaatgtggtctatggggctaaaaaccagaaatttggcggtgctgggagtttgtacaatatcttgacagatgagcgtctcaatcatcgtgtggaggttgaaataggaattttggaagatgaatgcgcagctatcatgcaggatttttttagaaatagacggaaaaaataa

SEQ ID NO: 1776 - DNA, 444 bp, Streptococcus pneumoniae
atgaaaattcgtggttttgaattggtttcgagttttacagatgaaaatttattgcccaagcgtgagacagcgcatgcggctggttacgacttaaaggttgctgtgcgtacagttgttgcgccaggagagattgtcttggttccgacaggggttaaggcttatatgcagccgactgaggttctctacctctatgatcgttcttcaaatcctcgtaagaagggcttggttttaattaactcagttggggtcattgatggggattattatggaaatcctggaaatgaagggcatatttttgcgcagatgaagaatatcacagaccaagaggttgttcttgaagttggggagcgtattgtccaggctgtttttgctactttcttaattgcagatggagatgcggctgatggcgttcgaactggtggatttggatcgacagggcactag

SEQ ID NO: 1777 - DNA, 558 bp, Streptococcus pneumoniae
atggcgttcgaactggtggatttggatcgacagggcactagaatgaagattatctttgtacgtcatggggagccagattaccgtgagttagaggagcgttcttatataggatttgggatagatttggcacccttgtctgagatgggacggcagcaagtccagaaattgagcaaaaatcctttactctcgtcagctgaaataatcgtatcttctgcagtcacaagagctttagaaacggcttcgtatgtggtctgtgctacgggttttcctttaagagtagagcctttattacatgaatggcaggtctataaaacaggaatagaaaactttgaaacagctagaagactgtttttagaaaacaagggggagttgcttcctaatagtcctattcaatatgagacagctacggaaatgaagtctcggtttctagaatgtatgtctaagtatcgagaacatcagactgtggtagttgttgctcatcgaatgctcatgcgccagtttgtgccaaatgagaagattgatttttgccaagtgattgagtgtgagttagagatatag

SEQ ID NO: 1778 - DNA, 204 bp, Streptococcus pneumoniae
acctgccattcatgtaataaaggctctactcttaaaggaaaacccgtagcacagaccacatacgaagccgtttctaaagctcttgtgactgcagaagatacgattatttcagctgacgagagtaaaggatttttgctcaatttctggacttgctgccgtcccatctcagacaagggtgccaaatctatcccaaatcctatataa

SEQ ID NO: 1779 - DNA, 1365 bp, Streptococcus pneumoniae
gtcatcgcaaagaaaaaagcgacatttgtatgtcaaaattgtgggtataattcccctaaatatctgggacgttgccccaactgtgggtcttggtcttcttttgtggaagaggttgaggttgccgaggtcaagaatgcgcgtgtgtccttgacaggtgagaaaaccaagcccatgaaactagctgaggtgacttccatcaatgtcaatcgaaccaagacggagatggaggaattcaaccgtgtgcttggaggcggagtggtaccaggaagtctcgtcctcatcggtggggatcctgggattgggaaatcaactcttctcctacaagtctcaacccagttgtcccaagtggggacagttctctatgtcagtggggaggagtctgcccagcagattaaactacgtgcagagcgcttaggtgatattgatagtgagttttatctctatgcagagaccaatatgcagagtgttcgtgcagaagtggagcgtatccagccagactttctcattattgattccatccagaccatcatgtctcctgagatttcaggggtgcaggggtctgtttctcaggtacgtgaagtgaccgctgaactcatgcagttggccaagaccaataacattgccatctttatcgtaggtcatgtgaccaaagaaggaaccttggctgggcctcgtatgttggagcatatggtggatacggtgctttactttgaaggggagcgtcaccacacctttcgtattttgagagcggtcaaaaatcgttttggttccactaatgagattgggatttttgagatgcagtcgggcggcttggttgaggtactcaatccgagtcaagttttcctagaagagcgtttggatggggcgactggttcctccatcgttgtaaccatggaagggacgcgtccgattttggcggaggttcaggctttggtaacaccgaccatgtttggaaatgccaagcgtactacgacaggacttgattttaaccgtgctagcttgattatggctgttttggaaaaacgggcagggcttctcttgcaaaatcaggatgcctatctcaaatctgctggtggtgttaaattggatgaacctgccattgacttggctgttgcagttgctattgcttcgagctacaaagacaagccaactaatcctcaggaatgttttgtcggagaactgggcttgacaggagagattcggcgcgtgaatcgtattgagcaacgcatcaacgaagctgctaaactgggctttactaagatttatgtacctcagaattccttgacaggaatcactctgcctaaggaaattcaggtcattggcgtgacaacgattcaggaagtcttgaaaaaggtctttgcataa

SEQ ID NO: 1780 - DNA, 621 bp, Streptococcus pneumoniae
ttgcataaactgttcaaaatacgacacgattccctccttgaaaatttgatagtcaaatatttctcctatcttatcatttttaagagaatttgtcacggattatgcaaagacctttttcaagacttcctgaatcgttgtcacgccaatgacctgaatttccttaggcagagtgattcctgtcaaggaattctgaggtacataaatcttagtaaagcccagtttagcagcttcgttgatgcgttgctcaatacgattcacgcgccgaatctctcctgtcaagcccagttctccgacaaaacattcctgaggattagttggcttgtctttgtagctcgaagcaatagcaactgcaacagccaagtcaatggcaggttcatccaatttaacaccaccagcagatttgagataggcatcctgattttgcaagagaagccctgcccgtttttccaaaacagccataatcaagctagcacggttaaaatcaagtcctgtcgtagtacgcttggcatttccaaacatggtcggtgttaccaaagcctgaacctccgccaaaatcggacgcgtcccttccatggttacaacgatggaggaaccagtcgccccatccaaacgctcttctag

SEQ ID NO: 1781 - DNA, 498 bp, Streptococcus pneumoniae
gtgtcgtattttgaacagtttatgcaagccaatcaggcttatgttgccctacatgggcagttaaatctgccacttaaacctaaaaccagagtagccattgtgacctgtatggactcacgtttgcacgttgcgcaagctctaggtttggcacttggggatgctcatattttgcggaatgcaggtggtcgagtgactgaagacatgattcgttcgctagttatttcccagcaacaaatggggacaagagagattgtggtattgcaccatacagactgtggtgctcagacctttgaaaatgaaccttttcaggagtatttaaaagaggaattaggtgtagatgtgtcagaccaggatttcttgcccttccaagatatagaagagagtgtacgcgaggatatgcaactgcttatcgagtctcccctaataccagacgatgtcattatctctggtgccatttacaatgttgatacaggaagtatgacagtcgtagaattataa

SEQ ID NO: 1782 - DNA, 792 bp, Streptococcus pneumoniae
gtgtatgaagaaaagcagtattttatttttattttattgctatgtattggtttacagtatgaaaccatctactatacggacggttcgaggtcaggtgcggaatatggactaatgggagtttctatctttctagctctcttttacatgattccggctctttattttctcttccgtattgggaaaaaatgggaattgccaaagaaggttttgattctgtctttattgggagggatgttccttgcaggctggttgtctagttttgctaatacttatatccatgatttactgggggttcttttcccagatagtccatttttaaatgcctttgaaagtgctattgtggctcctttggtagaagaacccttgaaattattgccacttgtttttgttttggctttgattcctgtgcgaaaattaaaatttttgtttttacttggaattgcttccggtttgggattccaaatgattgaggatattggttatattcgtacggatttgccagagggctttgactttactatttcgcgaattttagagcgtatcatctcaggaattgcctctcactggactttttcaggtctagctgtagtaggtgtttacttgctttacagagcctataaaggacagaaggttggcaagaaacagggtcttatttttctaggtttagccttgggaactcacttcttgtttaactctcccttttgtggagttggaaacagagttgcctttagcgattccagtggttacggctattgctctctatggtttttatcatgcttattgctttgttga

SEQ ID NO: 1783 - DNA, 969 bp, Streptococcus pneumoniae
atgtctttttctgatttaaagctgtttgccctttcttctaataaagaattggcagaacgtgtggcgcaggagattgggatagagttggggaaatcaagtgttcgccaattttcagatggagagattcaggtcaacattgaagaatcaatccgtgggaaacacgtctttatcctacaatcaactagttcgcctgtaaatgacaatctgcttgaaattttgattatggtagatgctttgaagcgtgcgagtgcagaatctgtcaatgttgtcatgccttactatgggtatgcacgtcaggatagaaaggcgagagcgcgtgagccaatcacttcaaaacttgtcgcaaatatgcttgaagtagctggagtggatcgtttattgaccatcgacttgcatgctgcgcaaattcaaggattctttgatattcctgtggatcatttgatgggtgctcctctgattgcagattattttgagcgtcgtggtatggttggttctgactatgtggttgtcagcccagaccatggaggggtgactcgtgctcgtaagttggcagaatttttgaaaacatctatcgctattattgataaacgtcgtagcgttgataagatgaatactagtgaagttatgaacatcatcggtaaggttgaaggcaagacttgtatcttgattgatgatatgattgataccgctggaacgatttgtcatgcggcagatgctcttgcggaagctggtgctgttgaagtctatgcaagctgtacgcacccagttctttctggtcctgctacggacaatatccaaaaatcagctattaagaaattggttgttttggataccatctatctgccagaagagcgtttgattgataagattgagcagatttcaatcgctcatctcctaggggatgctatcgtacgtattcatgaaaaacgaccactttctccacttttcgatattgagaaaaaaatttaa

SEQ ID NO: 1784 - DNA, 480 bp, Streptococcus pneumoniae
atggaacaattacattttatcacaaaattactagacattaaagaccctaatgtccagattttaaacatcatcaataaggatacacacaaggaaatcatcgccaaactggactacgacgccccatcttgccctgagtgcggaaaccaattgaagaaatatgactttcaaaaaccttctaaaattccttatcttgaaacgactggtatacctactagaattctccttagaaagcgtcgattcaagtgctatcactgttcaaaaatgatggtcgctgaaacttctgatgacgtacagtcatatttcttctctttttattatatcacagttttaaatctagctttactagattcaccgctactatctatttattcggaaaaaagacgaaaaaacctgagaatcatctcaggcttggtcattaaatttttttctcaatatcgaaaagtggagaaagtggtcgtttttcatgaatacgtacgatag

SEQ ID NO: 1785 - DNA, 339 bp, Streptococcus pneumoniae
ttggagtttttcggcaacaagccctttacccagcaaccgcaacgagccattagccaagcaaatcaactgctggactacaagagctggtccgaggaggacaggaaaatgtttagtcaactacatatgcgagaagaacaagtcttgttagcacaggactatgccttggaaactgctagggctgaagaccttgaacaaggactagagcgtgggaaagttgaaggaagggcagaaaggaaactttttgccttcctagacatagtacgccaaggtcttctgacttctgaggttgccagccagcaattaggtatgtcagtatctgaatttgaggcactgttgtaa

SEQ ID NO: 1786 - DNA, 366 bp, Streptococcus pneumoniae
atctacaaacacatcgctcctgtttacgtcattgctatcgtggatagtaattatttctcagatgacctggcttttcatagctttagtatgcgcgaagacacaacaggtgaggtattggcgattaccaacaatggacaggaaaaccatctggttaagatggcattcttggaattaaaaaatacagagaaaccagcaaagacaaggttcgcaagccatggttggagtttttcggcaacaagccctttacccagcaaccgcaacgagccattagccaagcaaatcaactgctggactacaagagctggtccgaggaggacaggaaaatgtttagtcaactacatatgcgagaagaacaagtcttgttag

SEQ ID NO: 1787 - DNA, 393 bp, Streptococcus pneumoniae
gtgtttgtagatctagtgagtatcaccttctcgctgatgaattttttcaagattttgattaacctgactgcacaggtaagcccacaagtgattgatgaaaaaattctgatgatggacttgaatctcaataattacttgagtaccgttatccaactccgccaagacgtctatactggtataaaaatcctgcaccgagtagggcatggaaggcaagacatgaatgttacttccctccaaaatagtcacatttttggctggcaagtccagcatatcgcggataaattgacaagtgatttctgggttgctgaaaattttcttagcaaccaagtcattggtcgggctaattcccagatgtctgagaatcatccttttcctccttctatagtgaattga

SEQ ID NO: 1788 - DNA, 354 bp, Streptococcus pneumoniae
atgattctcagacatctgggaattagcccgaccaatgacttggttgctaagaaaattttcagcaacccagaaatcacttgtcaatttatccgcgatatgctggacttgccagccaaaaatgtgactattttggagggaagtaacattcatgtcttgccttccatgccctactcggtgcaggatttttataccagtatagacgtcttggcggagttggataacggtactcaagtaattattgagattcaagtccatcatcagaattttttcatcaatcacttgtgggcttacctgtgcagtcaggttaatcaaaatcttgaaaaaattcatcagcgagaaggtgatactcactag

SEQ ID NO: 1789 - DNA, 2670 bp, Streptococcus pneumoniae
atggtattttttgattctttcctttataatgggtgtatggataagaaaaaattattattgattgatgggtcttctgtagcttttcgggcgttttttgcgctgtatcagcagttggaccgttttaagaatgcggctggtttgcataccaatgcgatttatggtttccagttgatgttgagtcatttgttggagcgggttgagccgagtcatattttggtggcttttgatgcgggaaagacgaccttccggacagagatgtatgcggactataagggtggtcgggccaagactcctgatgagtttcgtgagcaatttcctttcattcgtgagttgctggatcatatggggattcgtcactatgagctggctcagtatgaggcggatgacatcattgggacgctggataagctagcagagcaggatggttttgatattaccattgtcagtggggacaaggatttgattcagctgacggatgagcatacggtggttgaaatttccaagaaaggtgtggctgagtttgaggcctttacgccagattacctcatggaagaaatgggcctcacaccagctcagtttatcgatctcaaggcgctcatgggtgataagtcggataatatccctggggtgaccaaagtcggtgaaaagacgggtattaagctcttgctggagcatggttcgcttgaggggatttatgaaaatattgatggaatgaagacttctaagatgaaggaaaatctcatcaatgacaaggaacaggcctttttgtctaaaacactagcgaccattgataccaaggcaccgattgcgattggtttagaggacttggtctatagtggtccagatgttgaaaatcttgggaaattttacgatgagatgggattcaaacagctcaagcaggctttaaatgtgtcgtcagctgatgtggctaagggtttggattttactattgttgaccaaatcagtcaagatatgctgagtgaagagtctatcttccactttgagctttttggtgagaattaccatacggataatttggttggatttgcctggtcttgtggggataagctctatgccacagacaagcttgagctgttgcaagacccgattttcaaggatttcttagaaaaaacatctctgagagtttatgactttaagaaggttaaagttcttttgcaacgttttggtgtggatttgcaggcgcctgcttttgacatccgtttggctaaatacctcctttcgactgtggaggacaatgaaattgcgaccatcgctagtctttatggtcagacttacttggttgatgatgaaactttctacggtaagggtgttaaaaaggccattcctgaacgtgagaaattcttggaacacttagcttgtaaacttgctgttttggtagaaacagagcctattttacttgaaaaactcagcgaaaatgggcaattagagcttctttatgatatggagcaacctctggcttttgttcttgccaagatggaaattgctgggattgtggtcaagaaagagaccttgcttgagatgcaggctgaaaatgagcttgtcattgaaaaactgactcaagagatttacgagctggctggtgaggagtttaatgtcaactcgcctaagcagttgggcgtgcttctctttgagaaattgggacttcctctagaatacactaagaaaaccaagacaggttattcgacagcagtggatgtgttggagcgtctcgctcctattgctccgattgttaagaaaatcctggattaccgtcaaattgctaagattcaatctacttatgtaattggcttgcaggactggattttggctgatggaaagattcatactcgctatatgcaggatttgacccagaccgggcgtttgtctagtgtggatccaaacttgcaaaatattcctgcccgattggaacaagggcgcttgattcggaaggcttttgtgccagagtgggaggatagtgtgctactcagctctgactattcacagattgaattgcgcgttttggcgcatatttctaaggatgagcacttgattaaggccttccaagagggggcagatatccatacttcgacagccatgcgggtctttggcattgagcgtcctgataatgtgactgcaaatgaccgtcgcaatgccaaggcagttaactttggagtggtttatgggatttcagactttggcttgtctaataatttgggaattagtcgtaaggaagccaaagcctacattgatacctactttgaacgttttccaggtattaaaaactacatggatgaagtggtgcgggaggcgcgtgataagagctatgtagagaccctctttaagcgtcgccgtgagttgccagatatcaattcgcgcaacttcaatattcgtggttttgcggagcgaactgctatcaactcacctatccagggttcggcagcagatattctcaagattgccatgattcagctggataaagccttggttgcaggtggttatcagaccaagatgctgttacaagtgcacgatgaaatcgtccttgaagtgcctaaatctgaattggtagagatgaaaaaattggtgaaacaaaccatggaagaagccattcaactcagtgttcctcttatcgcagatgagaatgaaggggcaacctggtacgaggctaaataa

SEQ ID NO: 1790 - DNA, 372 bp, Streptococcus pneumoniae
ttgctgtggtgggtttgtctgaccgtgaaaaaaacaaccagtaatcgagtaacaaaggaaatgcaggctcggggctataaaatcatcccagtcaatcccaagacggcaggtggcgaaatcttgggtgaaaaggcttatgctagcctcgctgaaattccttttcctgtagatattgtcaatgtttatcgtcgcagtgaatttctgcccgatgtggcgcgtgattttctcaaagctgatgccaagattttttgggcacagctaggacttgaaagtttagaagcgaaagagattttgcgtgatggtggatgtgatgatatcgtgatgaatcgctgtatcaagagagaacatactcgcttgattgaggaagcataa

SEQ ID NO: 1791 - DNA, 411 bp, Streptococcus pneumoniae; identical to SEQ ID NO: 1407
  unsure (48),(49),(51): n at each above location is unknown.

SEQ ID NO: 1792 - DNA, 315 bp, Streptococcus pneumoniae
  unsure (276),(278),(279): n at each above location is unknown.
ttgaggaagcataagaaaaaggtagctgatgggctaccttttgtgttatactcaatgaaaatcaaagagcaaactaggaaactagctgcgggttgctcaaaacactgttttgaggttgcagatagaactgacgaagtcagctcaaaacaccgttttgaggttgtagatagaactgacgaagtcagctcaaaacaccgttttgaggttgtagatagaactgacgaagtcagctcaaaacactgttttgaggttgcagatagaactgacgaagcatancnnccacacctacggcaaagtgaatctgaagtggtttga

SEQ ID NO: 1793 - DNA, 717 bp, Streptococcus pneumoniae
atgaaagtctttcagcatgtaaatatcgtgacttgtgatcaagatttccatgtttatcttgatggaatcttagcagtcaaggattctcaaatcgtctatgtcggtcaagataagccagcgtttttagagcaagctgagcagattatagactatcagggagcttggattatgcctggtttggtcaattgtcacacccattctgcaatgacaggtctgagagggatccgagatgacagcaatctccatgaatggctcaatgactatatttggccagcagaatctgagtttactcccgacatgactaccaatgcggtcaaagaagccctgacagagatgctccagtcaggaacaacaacctttaacgatatgtataatcccaatggtgtggatatccagcaaatttatcaggtggtgaaaacttccaagatgcgttgttatttttctccgactctcttttcttcagagacagaaacaactgctgagactataagtagaactcgatccatcatagacgaaatcttaaaatataaaaatccaaatttcaaggttatggtagcacctcattctccgtatagctgcagtagagacttgctggaagcgagtttggaaatggcaaaagagctaaatattccgctccatgtccatgtggcggagaccaaggaggagtcaggaattatcctcaaacgatactgcaaacgccccccttgcttttcttga

SEQ ID NO: 1794 - DNA, 513 bp, Streptococcus pneumoniae
ttgctcacggggtcgaatttaaacgagagagaaattgaacgcttggcatcttctcaagtggctatcgcccacaatcatatcagtaacctcaaactggcatcaggaattgctccaattatccagctccaaaaagcgggagtagcagtcggaattgcgactgactcggttgcttccaataacaatctagatatgtttgaggaagaaaggattgcagttcttcttcagaagataaaaagtgggaatgccagccagtttccaatcgaaacagctctcaaggtactgacaatcgaaggggctaaggtctttggaatgaaaaatcagatagaaagtctgaaagtcggcaagcaagcagattttctggtcattcaaccacaagggaaaattcatctccaacctcaggaaaatatgctgtctcacctggtttatgcagttaaatctagtgatgtagatgatgtttatatcgccggagaacaggttgttaagcaaggtcaagtcctgacagtagaactttaa

SEQ ID NO: 1795 - DNA, 378 bp, Streptococcus pneumoniae
atgcaagatttttgcaaactttttttaaaatttttcgtaatttttcttttaaagttctactgtcaggacttgaccttgcttaacaacctgttctccggcgatataaacatcatctacatcactagatttaactgcataaaccaggtgagacagcatattttcctgaggttggagatgaattttcccttgtggttgaatgaccagaaaatctgcttgcttgccgactttcagactttctatctgatttttcattccaaagaccttagccccttcgattgtcagtaccttgagagctgtttcgattggaaactggctggcattcccactttttatcttctgaagaagaactgcaatcctttcttcctcaaacatatctag

SEQ ID NO: 1796 - DNA, 501 bp, Streptococcus pneumoniae
atgagtgaagcaattattgctaaaaaagcggaactagttgacgtagtagctgaaaaaatgaaagctgctgcatctatcgtcgttgtagacgctcgtggtttgacagttgagcaagatacagttcttcgtcgtgagcttcgtggaagcgaagttgagtataaagttattaaaaactcaatcttgcgtcgtgcagctgaaaaagctggtcttgaagatcttgcatctgtatttgttggaccatctgcagtagcattttctaatgaagatgttatcgcaccagcgaaaatcttgaacgacttttctaaaaacgctgaagcacttgaaattaaaggtggtgcaatcgaaggcgctgtcgcatctaaagaagagattcttgcacttgcaactcttccaaaccgcgaaggacttctttctatgctcctttctgtacttcaagcgccagtgcgcaacgttgctcttgcagtcaaagcggttgcagaaagcaaagaagacgcggcttaa

SEQ ID NO: 1797 - DNA, 369 bp, Streptococcus pneumoniae
atggcattgaacattgaaaacattattgctgaaattaaagaagcttcaatccttgaattgaacgaccttgtaaaagctatcgaagaagaatttggtgtaactgcagctgctcctgtagctgttgctgcagctgatgctgctgatgctggtgctgctaaagattcattcgacgttgaattgacatctgcaggcgacaaaaaagttggtgttatcaaagttgtacgtgaaatcactggtcttggtcttaaagaagctaaagaacttgttgacggtgcaccagcacttgttaaagaaggcgttgcaactgcagaagctgaagaaatcaaagctaaattggaagaagctggagcttcagttactcttaaataa

SEQ ID NO: 1798 - DNA, 345 bp, Streptococcus pneumoniae
ttgatttcttcagcttctgcagttgcaacgccttctttaacaagtgctggtgcaccgtcaacaagttctttagcttctttaagaccaagaccagtgatttcacgtacaactttgataacaccaacttttttgtcgcctgcagatgtcaattcaacgtcgaatgaatctttagcagcaccagcatcagcagcatcagctgcagcaacagctacaggagcagctgcagttacaccaaattcttcttcgatagcttttacaaggtcgttcaattcaaggattgaagcttctttaatttcagcaataatgttttcaatgttcaatgccattgttatttcctccaaataa

SEQ ID NO: 1799 - DNA, 588 bp, Streptococcus pneumoniae
atgaaaagaataattccagtttatatattccaacaagtaaatgtcctattggtatctctatacttattgaaatttctttgtatcggtgagttaactatactacagattctctatggttcgtcactcatttcttttttatggatgtatggccaacgcaaacaagctcataaggtaaatatgaaatctaggatgaaatggcttggtattggattcgttagcctactgattataagtctatgttttagcctaatccatgcgcaagaaagcacgaatcaagcaaacttaattggacttcaacatcaagttccttggttttcatttttattgtttttaatcaatgcgagtatggttgaagaatttctgtatagagaaattttatggaacttggttagaaaattagatattcgagttgctttgacaagtgttttatttgccttagcacatcatccaggaaccattatagcttggtgtttgtatgtatcgctggggatgtttttagggcttgtacgctacaaattggacttatggggcagtatggggctacatttggtgtggagcctactagtttatagtttgctgcttttttaa

SEQ ID NO: 1800 - DNA, 1515 bp, Streptococcus pneumoniae
atggattataatttcaatttggagcatcctttctttttcactaataatgattatagtacagatactagcataaagtaccaagtaagtctgccttttaattggcacgaagtaatgaataatgatgagtgggtttatcaataccctattggaaaatttgttgaaagacaagggtggaaaatacacattagttcagagtataacagttcacatgaattgttacaagatgtagcaaaaatttgccatgaaatgcgaattccatttaaacatcttagtacagaagacaaatttatcatgcgaaacgggaaattggttagtcgaggattttctggtaaatttattacatgttatccaaatcaaaatgaattagagtcggttttgcaaaggttagaaagtgccttaaagcaatataatggaccatatattttaagcgataaacgttgggatgaagcaccaatatatctgaggtatggtgtgtttaggccgtcaagggatgatgaaaagaaggttgctattgatgaattaattgttggcgatgaagttgttaaagatgaacgtttaccagtatttaaaattccaaaaggtatagtgccccctgactttttgaataaatggcttgacaagaaagataaaaaacagggagactttccctttattatagataatgcaattagattttcaaacagtggtgggatatataatgctaggctaaaagaagatgggaaaaaaataattttaaaagaggctagaccgtatacaggtctaggatttgatggtacttattcttcagagaaattagcttcggagtgcaaagcactaaaaattctaaatgaatggagtgagacgcctaaaatatactggcacggtaagatctgggagcacaccttcttaggaattgaacatatgaagggcgttccactaaatagatgggttaccaataattttcctttatatgaagttgttgataagaccaaagattatctattgagagtttcaaagatagtagaaaaactcatcgatttaacgaataagtttcattctgaaaatgtatatcatcaagatttacatttaggaaatatcttggttaaggatgaagatgagattagtataatagactgggaacaggctgtcttttcaaatgatgaaaaagttgtacataaagttgcagcccctggttttagagcatggcgagaaacacttcccagtgagatagattggtatggtattagacaaatagctcattatttatacatgccactagtaactacatcggatttgacatacaactatgtaagtcaaaccaggatagaaggaaaaaaactatttgagtctttgggttatacaagagaacatatagattatgtagaaagtttattgtcatatctagattctaaatgtccacagattgagaatatttccaggaaaaaagttttaaaacccatgcatgagattagaactatcgagagtgagcaagatatacaagattttattataaaagcttttcttttagtgaactga

SEQ ID NO: 1801 - DNA, 594 bp, Streptococcus pneumoniae
gtgatacacatgaaagatgttgtatattctattacaccagaaaataaattaagtattgacttctcatttaagtcaccatttagggtattattaacaggaacttctggtagtgggaaaacaacgattttaaatttaattaatggttctttaaagccacaaaaaggttatgtaaatttgttatcacatgggaaaaagagttcagattcaataccaacagttgatcagacaccatatatttttgacactactattcgtgagaacgtaactttatttcaaaatgaatatttttcagatgatcagataattgaggtgttaaaaaaggtaaatctatatgaagaattagaaaagatagatatactaaattatcaatgtggtgaaaatggtagtaatttgtctggaggtcaaaaacaaaaaatagctttagctagagctctgattagaaataataaagtgtacttatttgacgaaatatcagctaatttagataatgataattcaaattccatacatgatattctgttcaatttaggtatttcatttattgaagtttcacatcattatgacttaaatgacaagagatacactgatatataa

SEQ ID NO: 1802 - DNA, 291 bp, Streptococcus pneumoniae
cctttttgtggctttaaagaaccattaattaaatttaaaatcgttgttttcccactaccagaagttcctgttaataataccctaaatggtgacttaaatgagaagtcaatacttaatttattttctggtgtaatagaatatacaacatctttcatgtgtatcacatctattgatgaagtatacagtccgttattatcatgttcagcgtctataaaattcttctctccacttaagtattttaaaaacggtttccttaaatctttggttgtatttatcttatttaatgaatag

SEQ ID NO: 1803 - DNA, 741 bp, Streptococcus pneumoniae
atggataaagattatatattaaaagtgaaagggctgtatcatcaatttttactgggaaacaataaaacgttgcaagtgctgaaaaatgtttctctttctgcttcgagaggagaatttataagtattctaggaattagtggttctggaaagtcaactttattaaaatgtatttctagtttgcttgaaccaacaagtggggaagtaattttaaatggaatcaacccctataaaatcagaaatgcaaaattatcaagtataagacgtaatgaagtatcttttatatttcaagcatataatttaataccttccctgccggtaatagaaaatatagcacttcctttgcgattatcacaaaaaaaattaactattaaaaatgtagaaaacttactcaaaagaatgaagtttaatgctggcttaaacgattttgttggaactctgtctggtggagaacaacagaaggttgctatagctagagcggttattgctgatagtgatataatatttgctgatgagccaactggggctttagacagcgtttctcgtgaagtaatttttgaattattgagagagttagtaggggcgggtaagtgtgtaattatggtaacgcacgatatagaattggcctcgaaaactgatcgtgcattaatattgaaagatggaaaaattttcaaagaacttcatagacctagcggggaagagttgtataaaatcttagaggtacaatcaactacggaggaatag

SEQ ID NO: 1804 - DNA, 180 bp, Streptococcus pneumoniae
gggttgattccatttaaaattacttccccacttgttggttcaagcaaactagaaatacattttaataaagttgactttccagaaccactaattcctagaatacttataaattctcctctcgaagcagaaagagaaacatttttcagcacttgcaacgttttattgtttcccagtaaaaat

SEQ ID NO: 1805 - DNA, 387 bp, Streptococcus pneumoniae
ttgaaaatttttccatctttcaatattaatgcacgatcagttttcgaggccaattctatatcgtgcgttaccataattacacacttacccgcccctactaactctctcaataattcaaaaattacttcacgagaaacgctgtctaaagccccagttggctcatcagcaaatattatatcactatcagcaataaccgctctagctatagcaaccttctgttgttctccaccagacagagttccaacaaaatcgtttaagccagcattaaacttcattcttttgagtaagttttctacatttttaatagttaattttttttgtgataatcgcaaaggaagtgctatattttctattaccggcagggaaggtattaaattatatgcttga

SEQ ID NO: 1806 - DNA, 1320 bp, Streptococcus pneumoniae
atgctcagattagtttactatcaatttttacataataagaaacaatggttaggcgtttcaccagtaatttttgtttcgagtttagttatgggattggctgttaatggggtaattaatgttgagaataattcgcaagtatttgtcggacttccagatcctaaaccaatttttatgtttccgatagtattcggaggagtaacattattctttgtgctctctaacataataaatatgttggttgaaatttttagagatgattacgaacttctggaggtgttgggagcaagtcgccttcaactatcatttcttgtggggggacagatttttatcatttcctcgattattagttttattgcatatctatgctctatatttgttacgtcaaattattattattttttacaatactttttcggggaaaatatattacctgatatccaatttcaaatgagtgctgttggatgtatcattacagtagtgttgatttcatttttagcctttctaagtggttgcttttatacgttcaagaagattagaaataggaagagttctaaaataaggcatgttctttcaatagtaaaaagaatactgctattggctggttttagtgttatctggttgctttctttgcaacaaattttccaagatagcacaattttagcgaaggcccagataatattcaatattgtaatcttagatattgtgattatttatcaattatctccttttatacagtcatgttttatcaaactactttctataattatatttagaaataattttatgttcattgtttcgaagtggaatttactatatcgtaagccttatataaaatctatcagtgctgcaattacaggagctatattactaatttctagttttcaaatgatttctcagaatatactatctcaatttcaagatgacagtgatttagagctaaaagtggcatttattgtctatgtaggagcaccaattttgatagtacttgcaaatattatttcaattgcatttttgtcatcgcatcaagaaaggattgagattcagcaatttgaaattttaggaacttccaattaccagatggttaagattaaagttggtgaggctatatttttgacatttgttacttcattaattgcatttttacttaacattaaaattatggttttaatatactactctttagaggatattttaatagatgatatgaatcttttggggttaatacttccaaattttatagtgtctattattttatttattttaatatttattactaaaagttcctattttatctttaagaatgcaaaaattatttcttaa

SEQ ID NO: 1807 - DNA, 180 bp, Streptococcus pneumoniae
gtgagtgggataaaagtttcatttagtttattcagtacaaatttaacgggtcaagatttatatactggtggtgtttttggggctgagagaagtatcttgattttatgtgtggtttttatacttacagttgttctgctccaaagagcttgtagagaagaattagctcataaaggagattga

SEQ ID NO: 1808 - DNA, 222 bp, Streptococcus pneumoniae
atgaaggtagtaaacttgtatgatttgaaacaaatgggaaataaaggtggttgtaccatccaattgattcatcactttccttttggtatgggcttaggacatctcaaaaaagactacattgaatttaaacgtgttggtatctttgatgggaaagcagtagaagttactcttcgagaaccttattcgagagatctactgcaggttgtcaagtcaataaagtaa

SEQ ID NO: 1809 - DNA, 135 bp, Streptococcus pneumoniae
atgattatcttttattcgttatggacaatgctaatggacaatgctatatggcataaatcaagtgccttaaagattccgactaatattggctttgcatttattcctccatacacaccagaaatgaaccccattgaa

SEQ ID NO: 1810 - DNA, 264 bp, Streptococcus pneumoniae
ttggctgacagtggttatcaagggctcatgaagatatatcttcaagcacaaactccacgtaaatccagcaaactcaagccgctaacagctgaagataaagcctataaccatgcgctatctaaggggagaagcaaggttgagaatatttttgccaaagtaaaaacgtttaaaatgttttcaacaacctatcgaaatcatcgtaaacgcttcggattacgaatgaatttgattgctgatattatcaatcatgaactaggattctag

SEQ ID NO: 1811 - DNA, 699 bp, Streptococcus pneumoniae
atgtcacagattagcaaagaagccttgattgagcaaatcaaagatggaatcatcgtttcttgtcaggctcttcctcatgaaccgctttatacagaagcgggaggggtgattcccttgctggtcaaagcggctgagcaaggtggagcagtcggtatccgagcaaacagtgttcgcgatatcaaggaaattaaggaagtcactaaacttccaatcattgggattatcaaacgtgattatccacctcaggaacccttcatcacggctactatgaaagaagttgatgaattggcagaactggacatcgaggtgattgctctggattgtaccaagcgtgaacgctacgatggtttggaaattcaagagttcattcgtcaggttaaggagaaatatcctaatcagcttttgatggctgatactagtatcttcgaagaagggctagcagctgtagaagcaggaattgactttgtcggaacaaccttatcaggctacacatcctacagtccaaaagtagatggtccagattttgaattgattaagaaactctgtgatgccggtgtagatgtcattgcagaaggaaaaattcatacaccagaacaagccaaacaaatccttgaatatggagtgcgaggcatcgttgttggtggcgctattactagaccaaaagagattacagaacgttttgtagcgggattaaaatag

SEQ ID NO: 1812 - DNA, 924 bp, Streptococcus pneumoniae
atgaaaattgatgttataaatcatttagactcaccaggattagctgggatgatttgtagacggattaataatagaattttagtttatggaggtagttatttcccaaataacgatcctttaaaaagttcaaaagttcaatcaaataaaattagagtttatgatgagaaatttaatcttctatatgaacaagatggaaaaatttctccagataaaggaataacgattgaagttgaaaatgaaatctattacattctaggctcgagcatttatcgtattacgattggtgaaagtgtagaagaaacctgtatcgggaattttgatttccaactagagagtggttatggttgttattttgatggccacttattctttggatttcaggaaagttatttgttcaatattgagactcaagagctttttaaaaaatctgacttcccagtttctggtagaggccaaggtttgtcagtcaaatatcaaaatgaattgtattatttaggtggagcgaacaatgaagcttatttagatggatacaaatatagtttaaaaaaagataagtgggaaaaacttgagttcgaattaccaagctcagttctaggagcatcaagtatacaaataaatgaaagtggtttattaatacttggtggctttaatgaaattgtttataataaagcagttattgatttagcaacccctggctatagggaagaatatttttctaaagggagagatttctttaattggaatcgtagcatgcgaatactagatttagagacaggtaaggtcaagattattgcaaacgatgagcgttttgctctttgtggggcaggatttttaaaaactgataatggatattacgttgttagtggggaatgtagcccaggaagacgtacttctgacatacttttgttagaggaggaaatgtaa

SEQ ID NO: 1813 - DNA, 1629 bp, Streptococcus pneumoniae
atgaaaaaaattgttaaattagctttaacagctgcagcagttttaatagctgtagtaggattggttgcttgtagttcgggaagcaaaaaatctgatttttcagagtctggaaaagaaaaagtattctatttatcaggtttgcttcaaggaactggagatcgtatcccttacgtttggcaaaatggtgatggtttagttccatatttgttataccgtacactgttaatggcagattcaaaatatgaaaaatcaactccagatttagctaaagattggaaaaaatctgatgatgaaaaaacttatgaatttacacttaaagatggattgaaatggtctgatggagaagctttgacagcttccgatgtggaattcagtgttaaattagcattgaaagcttcagtaattaatggaattttcccttcaacattcacaaaaattgaaggagctaaagatttcaaagacgataaagcagataaaatttctggtcttacagttgatggaaataaagtaacatttaaacttactgctccagttggtgactttgagcaaatgatgactcaattctttattcttccaaaacataaattagagtctgaaaatcctcttgaattaaataatagctcattttggacagctcctgttacaagcggtatgtacaaagtaaaagaaattagtgcaggtaatttcttagagtatgacaaaaatgaaaactatgaaaatgaaaaaccaaaatttgataaagtagtattcaactatatttcagatccagttttagcattgcaagatggtaaatcatacttctattcaacaaacaaacctcaagaaattagtcagttggatgctgtatctactttaactaaaaaaccaattgatatcctattctatcgctactttatcgctaacttagcaggtgtcgaaggtaatggagattccttgattgctaatcctaaagttagagaagctattctatatgcaattaatcgtgatgaattagctaaatctgtatttagtggaattgcagatgttaataatactggtgttccttcaagcttagaagctcatctgaaatcagcaaataaatttgaatataatccagaaaaagcaaaacaacttcttaaagaagctaaatacgataatagcagaaatctaattttagcttattactataaagatcaagcctctcaagatttcatgcaagcagtaagttatcaattgaatgaggttggaatcaagaacgaagttgtccaaattacttctgatgcaacaacaggattgttcaaaacacgtaaatatgacctagcttataaaggattatcatcatttggttatgaaacttggtatggtgaatatagttcaacaaatactaactttaaaaatattacaaatggcgaaacaagttttgatgagttgagcaaaaaattgtctgaaacttctgatgtaaaagaaagaaacaaaattttagcaagtctacaaaaattagaacaagaaaaactattgaagttaaacttattcacatttaaaaacttcttgtatttaaatactgaaaaagttttaattcctgacgatgttcaatttggtaatccattctataaatttgattacaaattcgaaaaatgggatgctaaataa

SEQ ID NO: 1814 - DNA, 951 bp, Streptococcus pneumoniae
atgaaaaaatatattctaaaaaaagtattattcatgattcctatgttgttgattattagctttttagtattcattgcactagatttaacaccagcagatccattgacatatatggtatctccagatatggctagtagtgcagaacaaatcgaaaagctaagacagcaattaggtttaaatgatccagtattagttcgctatggaagatggctttggcaattactccatggtgattttggatacagtattgtaaatggtaacccaatttccaaaattgtaggacaagcattgcctgcaacttttgaattagcttttgtgtcattaattatttcaacaattgttggtattgtaattggggttatatcagccgttaaacaaaatggtattatcgataatgttgctcgttttctagctgttatcggaactgcgattccacaatttttctttggtattttaattttaaacttctttgcaattcagttaagaattttacctattggtggtagatttgccagtggagattttacatttattaatagagttgaacacttaattctaccagtaatggctatgtcaattgcattggtagctgctttaatgagatacacacgtaattctatgttggatgtttttaatgcagattatgttaaaacagctcgtgcaaaaggtgttcctgaatggaaagtttattttaaacacatatttagaaatgctatgcgaccaattttagtgttattgattttccgtctaccaatgttaattggtggatcagtaattatcgagagtgtcttttcttggcctggaattggttctatcatcctatctagtgtaacagcaggtgactatcctgtaattatgattaccacattaatgatttctgtcgtagtgttatttgctagtctacttgtagatattatggctgcaatattagacccacgtattcgttattag

SEQ ID NO: 1815 - DNA, 888 bp, Streptococcus pneumoniae
acccacgtattcgttattaggaaggaggtcaatgttatgaaacctatgcctttatggaaaagaaatttgaaaaaattctataataacaaattggcctttatcggctttatatgcttcatgctaattctattagcatgtattctagcacctttattgacaacctattctccagatgttgttgatttaggatctatgaaccgtcctccttcagcaaaacacattctgggaacagataaactaggtcgtgacgtatttgctcgaatcctatatggtggtcgagtttcaattcaagtagggatgtatggagcgatttgtggagcggttattggtactgtacttggtggtattgctggatattttggtgggaaaattgatgctcttctagttcgtctagcagaattattcttaacattcccgaatatgattgtcattctcttgctttcaagtatttttggacaaggtgtattcaatcttatcttcgtattctcagtaatgggttggatgacaacgttccgaatggttcgtaatgagttcatgtctttgaaacaagaaacatatgtggatgtatgtagagcttttggtttttctgacagtcgaattatctttaataatattttaagaaatgctatctcaccagtaattgtatcgttgtctttaaacgttgctggtttcattctcagtgaggcaggtcttagtttcttaggagtaggtgttccttctgatattcctacttggggaaatatcataaatgctgccaaaacagccgatgttattaaaaatagttggtggttgtggttagttccagggtcaatcattactcttttcgttctttctatcaactttattggtgatggattacgagatataatggatccgaaacaacagtag

SEQ ID NO: 1816 - DNA, 612 bp, Streptococcus pneumoniae
ttgtcaacctcctactgttgtttcggatccattatatctcgtaatccatcaccaataaagttgatagaaagaacgaaaagagtaatgattgaccctggaactaaccacaaccaccaactatttttaataacatcggctgttttggcagcatttatgatatttccccaagtaggaatatcagaaggaacacctactcctaagaaactaagacctgcctcactgagaatgaaaccagcaacgtttaaagacaacgatacaattactggtgagatagcatttcttaaaatattattaaagataattcgactgtcagaaaaaccaaaagctctacatacatccacatatgtttcttgtttcaaagacatgaactcattacgaaccattcggaacgttgtcatccaacccattactgagaatacgaagataagattgaatacaccttgtccaaaaatacttgaaagcaagagaatgacaatcatattcgggaatgttaagaataattctgctagacgaactagaagagcatcaattttcccaccaaaatatccagcaataccaccaagtacagtaccaataaccgctccacaaatcgctccatacatccctacttga

SEQ ID NO: 1817 - DNA, 1983 bp, Streptococcus pneumoniae
atgaatcaaacagttttagatgtaaaaaacttaaaaactgaattcatcactgataaaaaagcatttccgattattaaagatgtaaacttcactttggaaagagggaaagttttagggattgttggtgaatctggatgcggtaagagtgtaacagtgaatacagtgttaaacttattacctaaaaatggacgcattgctgaaggtgaaatcacatatttcgatgaagataagccgatagagcttcaaaaattaaagcaatatggtaaagaatttcgaaagttacgtggtgaaaacatatcaatgattttccaagatccaatgtctgcattgaatccagtatatacaattggtaatcaaattactgaagtccttcatgaacattatgacatttctaaagaggaggcaaataaacgtgctatagaaatgttagaaaaacttggaattcataatgctgcagaacgcatgaatgactatccacaccaatttagtggagggcagcgtcaaagaatagtcatagcgattgcaatggtatgtaatccagatattctaattgcagatgaaccaacaactgcccttgatgtaacaatccaagcacaaatacttgatttacttgatgatttacgtaaagagcatggaacttctattatcttaattactcacgatttaggcgttattgctcaaattgcggatgaagttgcagtgatgtatgctggtgaagtcgttgaagttggaactgtagctcagatctttgatcaacctaaacacccgtatactcgttctctattaagatctattcctaatcctgaaaatatggataaaaagctacatgttatccaggggagcgtaccttcaatttctgaaatatctgaaaaaggatgcagattcgcaaatcgtattccatggttagaaaaagaacatcatgaagaagaacctcaattgcatgatttaggtgacggacattttgtaaggtgttcttgctataaacatttctttttcgaagataaggaagaagaaacattagcggaaaaacatgtaggtaatgttgttttagaagtaaaaaatattaaaaagtactactatcctaagaagcaactattcaagccactaggttctccgttgaaagcacttgatgacgtatctctagagttaagaaaaggaactactattggtatcgtaggagagtctggaagcggtaagagtacgattgcgaaatcattaatgaaactccatgatattacagatggtgaaatcaatattgatttgaatgggaaaactcaaaatatttatggaattaaacgtaaggaagatttggatttccgtaagaaagttcaaatggtattccaagatccttatgcatcattgaacccaactaagaaaatttataattcatttgatgaaccgatgattgtccataatattggaaacaaagaggaacgctttgaacgtatgaaagaagccttgaagatggtaaacgtgccagttgagtacttggagcgttatcctcatgaattttcaggcggacaacgtcaacgtttatgtattgctcgtgccctttgtatgaaaccagaaattttaattttagatgaacctgtttcagcattagatctatctgtacaagcgcaagttttgaattatcttgttgaaatccaaaataaagaagatttgacttatgtatttatttctcatgacctaggtgttgtgaaatacatgtgtgactatctatatgttattcataaaggacgtattgtagaagctggttctcgagaagatatctacaataacccaatgcatatttacactaaaaaactattagctgctattccagaagttgattatcacttcaaagaggcattggcaacaaaacgtaaagaaaatgaagttgaatttaaagcacagtaccatgaattttatgatgaagatggccgtgcttatgatcttaagcaggtttcaccaacacattttgtagcgttaaaaccagaatag

SEQ ID NO: 1818 - DNA, 198 bp, Streptococcus pneumoniae
gttttcccattcaaatcaatattgatttcaccatctgtaatatcatggagtttcattaatgatttcgcaatcgtactcttaccgcttccagactctcctacgataccaatagtagttccttttcttaactctagagatacgtcatcaagtgctttcaacggagaacctagtggcttgaatagttgcttcttaggatag

SEQ ID NO: 1819 - DNA, 1410 bp, Streptococcus pneumoniae
atgaaattaaataaaaaaatatatttctttgataaaggaatttttaatccttatcgaatgagtaatgtaaaattaaaagttaatcaggcagtaaaggataaagaaattttcttcactgaggaaaaaccatgggaaattcgttttgataacagttatccaaatgttttctttgatgatttagcaggtgtttatcgttgctactattctacatttactgatgatgaggagtctgaaaaatactctttagaggagcgtaaggaacgtcaatatctacctcgtgcgaagcgtattgtttcactttgttatgctgaaagtaaagatggtgttaactgggtgaaaccaaatctaggtattacagaatttcgaggatcaactgaaaataatattatcggacattttttacatggtacatctgtttttctagataaacatgacgcagatgaaaatcgtcgttataaaatgtttacaaagattgattacggtaacggtgttcatttcattgctgtagcattttcaaaagatggtctacactttgatgaatacattaaagtaccaaacttcaatccacgtgcagacactcataaccatatcatatatgatgaagcattaaatcgctatgtgctaattactcgtacttggagagattcattgcgcttgccgtgtgtatctacgagtgctgatttcattaactggactccaattcaagaaattttgaatgtctgtgattatgaaaatcaaatttattctatgcctatttttaaacgtggcgattatatactaggtttagcttcagttttccatgaaggagatcaactgaacaagaattacgatacagtggaccttcaattgacttatagttatcgtcatgttggttggcattatctaaacactgatactccacttattcctcgtggtaaaggtcaatatggtgatggagaatttgactgtggatgtatctattcttctgcaccagttactatcggtgaccgtacttatttctactacatgggaggaaatggacaacatacaaacttccgtgaaacaagcttgtctcgtgcttatattgagaaagatcactttgcatattgggatactaaacgtccagaatatccaggtgttttgtataccaatggatttattttcctcaatgatcaagtttaccttgatgcagatattgcagctggaggctttgtaacaattgaattgttcgagaataatcacactccaatggaaattacagcttcccttgaaaaaatagaagatggtcgctatcaagtgttattcagcgaacctttacctcgaactcaaactcgactgaaaattagctttaaaaatgctaaaatctacgcaatcgaaggaaatttagatattttcagaattgaatcagacaatgctctattgagggggtaa

SEQ ID NO: 1820 - DNA, 489 bp, Streptococcus pneumoniae
atgaaatatgatttatatgataattgtattgaacttctaaaagaacgcgaagttacaattgaagatatggcagcgttagtaatattttcacaacaaaaatattaccctgaattaactcttgacgacgcttcatatgcaattcaacgtgtactaaaaaaacgtgaagttcagaatgtaattatgacaggaattgagttagataagttagctgaagcacaaaaactatctccagaatttcaaaagattatggagaaagataatccattgtatgggattgatgaagtaatcgtcttatcgatattgaatttatatggttctattgcctttacaaattatggctatttagataaattaaaaccactgattttagaaagattgaatgagaatcacgaaggtgtttgtaatgtatttctagatgatattgttggtgcaatagccgcagcagcatgtagtaaaattgcacacaatcatgctagtgatgaaatataa

SEQ ID NO: 1821 - DNA, 408 bp, Streptococcus pneumoniae
atgacagtaattaataaatttgttttaatggagcaagcaaaaaaagttttaaaaaatgcttactgtccgtattccaaatttcctgtaggtgcagcaattttatttaaagatggtaaagtaattacaggagcaaatatagaaaatgtatcgtttggtgtaactaactgtgcagaacgtagtgctattttttatggggcttctcaaggatatagaaaaggagatattcttgcgattgctgttgcaggtgaaactgaagactacttaccaccatgcaacatttgtcgtcaagttatggtagaattttgtgagcctgataccttagtctttctattaaatggtaagggaaacatacttgaattgcgattagaggaattagtcccatattcgttctcaagtctagaaatgtaa

SEQ ID NO: 1822 - DNA, 285 bp, Streptococcus pneumoniae
atggcgagcaagttccatactatctttagtattattgcaagcaacatgggcaataatggtcaatttacctttggctaccgccatgacttcttccaaaatcaacttgcgatcttcaacgctttggtagatacattcaccagaagaaccattgacataaagaccttgaacacctttatcaatgaagtattgaacctaggcacgcgtacgctctggacttacttctccttgctcatcataacatgcgtagaaggctggaatgacaccttcgtattttttcaaatctga

SEQ ID NO: 1823 - DNA, 822 bp, Streptococcus pneumoniae
gttcaatacttcattgataaaggtgttcaaggtctttatgtcaatggttcttctggtgaatgtatctaccaaagcgttgaagatcgcaagttgattttggaagaagtcatggcggtagccaaaggtaaattgaccattattgcccatgttgcttgcaataatactaaagatagtatggaacttgctcgccatgctgaaagcttgggagtagatgctattgcaacgattccaccaatttacttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgttaagaactcttctatgccagttcaagatatccaaacctttgtcagccttggtggggaagaccatatcgtctttaatggtcctgatgagcagtttctaggaggacgcctcatgggtgctagggctggtatcggtggtacttatggtgctatgccagaactcttcttgaaactcaatcagttgattgcggataaggacctagaaacagcgcgtgaattgcagtatgctatcaacgcaatcattggtaaactcacttctgttcatggaaatatgtacggtgtcatcaaagaagttttgaaaatcaatgaaggcttgactattggatctgttcgttcaccattgacaccagtgactgaagaagatcgtccagttgtagaagaagctgctgccttgattcgtgaaaccaaggagcgcttcctctaa

SEQ ID NO: 1824 - DNA, 204 bp, Streptococcus pneumoniae
atgacgcactacgttgccaatccagaggtggtcattctcgagggtggcatcatgggacaagaagctatcctcaaaccaaagattcgtgcagccttgaaagaagtcttggttccaagtttggctgagaacacaagattagaatttgctcatcatcaaaacactgctggtatgcttggagcctactatcattttaaaataaaataa

SEQ ID NO: 1825 - DNA, 519 bp, Streptococcus pneumoniae
atgcatattcactataacacaaatcaaacaactttaccactagaaatcaattctttcttgccgcaagaccatctcgtctttactattgaaaaagtggtgaataccgatgaaaaggaggtaaaccatctgattaaatatgccatgtttgataaggaacaaaagagaggctataaacagtcagctagaaacttagcgaattggcactataatgacaaggaggatagctatacacatcctgatggctggtattatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgaggggcaagtga

SEQ ID NO: 1826 - DNA, 642 bp, Streptococcus pneumoniae
ttgactattgagccaggacagagaattgcactagtcggtcaatcggggtcaggaaaaagtacgttatcaaaaataccatcaggattatataagattgatacaggaaaagttttatttgatggtgtaaatattaatcaaatagataaaaaaatattaagtcaaaatttaggagtagttccacaggattcgtttttattgaacagaagtattcttgataatataactttaaagcacgaagttacttcacaaaagatagaggaagtttgtaaagcagttcaaatctatgatgaaatcatggctatgccgatgaaatttaatactatcatctcagagatggggtcaaatatttcaggtgggcaaaggcaacggatagcactggcacgtgcattaataaataatcctagtattgtaattttagatgaagcaactagtgcattagacactattaatgagaaaagaataacaaagtatatacaaagtcagggttgtactcaaataattatagctcatagattgtcaacgattaaggatgcggatattatttttgtaatgaaaggtggtaagattgttgagtcaggaaatcataagtacttaatgactcttggtggagagtactacagcttatatacaaaaaggaaatga

SEQ ID NO: 1827 - DNA, 189 bp, Streptococcus pneumoniae
acaatcagcgaacccaatactattccattcaacaagcctaaagaaataccatattcaactggaaaatctaaaaaaattgcaaacactattccaatcatcacccctagtgaggctattgttaaaattacatattcattttctttcttcattttctttacacctcatttcctttttgtatataagctgtag

SEQ ID NO: 1828 - DNA, 1347 bp, Streptococcus pneumoniae
atgacatctgctaaagaatatatccaaagcgtgtttgaaactgtgaaagctcgtaacgggcacgaggctgaattcctccaagctgttgaagaatttttcaacactttagaacctgtatttgaaaaacaccctgagtatatcgaagaaaatatcttggcacgtattactgagcctgagcgcgtggtttctttccgtgttccttgggttgaccgtgatggaaaaattcaagtaaaccgtggttaccgtgttcaattcaactcagctgttggaccatacaaaggtggacttcgtttccacccaactgtaaaccaagggatcttgaaattcctcggatttgaacaaatctttaaaaatgtcttgactggacttcctatcggtggaggtaaaggtggatcagacttcgatcctaaaggtaaaacagatgctgaagtgatgcgcttctgccaaagcttcatgactgaattgcaaaaacacatcggaccatcacttgacgtacctgctggtgatatcggtgttggtggacgtgaaattggttacctttacggtcaatacaaacgtcttaaccaatttgatgctggtgtcttgactggtaaacctcttggatttggtgggagcttgattcgtccagaagcaactggttacggtttggtttactatactgaagaaatgctcaaagctaacggtaacagctttgctggtaagaaagtcgttatttcaggttctggtaacgttgctcaatatgctcttcaaaaagcaactgaactcggtgcaactgttatttctgtttctgactcaaatggttatgtcatcgatgaaaatggtatcgacttcgatcttttggttgatgttaaagaaaaacgtcgtgctcgtttgactgagtatgcagctgaaaaagcaactgcaacctaccacgaaggtactgtatggacttacgctggaaactatgacattgctcttccatgtgccactcaaaacgaaatcaacggtgaagcagctaaacgtttggttgctcaaggcgttatctgtgtatctgaaggtgccaacatgccgagcgaccttgatgccatcaaagtttacaaagaaaatggtatcttatacggacctgcaaaagctgccaacgctggtggtgtagccgtttcagctcttgaaatgagccaaaacagtcttcgcctctcatggactcgtgaagaagttgatgaccgtctcaaagacatcatgacaaacatcttcaacacagctaaaacaacttcagaaacatacggtcttgataaagactaccttgcaggagctaacattgctgcctttgaaaatgtagcaaacgctatgattgcccaaggtattgtttaa

SEQ ID NO: 1829 - DNA, 414 bp, Streptococcus pneumoniae; identical to SEQ ID NO: 749

SEQ ID NO: 1830 - DNA, 171 bp, Streptococcus pneumoniae
atggacaatgctatatggcataaatcaagtaccttaaatattccgactaatattgattttacctttattcctccatacacaccagagatgaacccattgaacaagtgtggaaagagattcgtaaacgtggatttaagaataaagcctttcgaactttggaagatatcatga

SEQ ID NO: 1831 - DNA, 654 bp, Streptococcus pneumoniae; identical to SEQ ID NO: 150

SEQ ID NO: 1832 - DNA, 219 bp, Streptococcus pneumoniae
atgagtataagtcctcgttttgaaaccttagagcaggccattgcctccaaagatttggaaaaagtccgagaagcttttaagaaaatgaattccacttggaccatcaatgaaagtgtggttcgtgacaatagtacagctcattatggacgtgttgaaacagctatttccttcctgcctagtagcatggaaaccgaacctacagatgagtctggaacatga

SEQ ID NO: 1833 - DNA, 285 bp, Streptococcus pneumoniae
atggctcgcaaagagaccatggcagaaaggaaatattgcaaaatgaaaaaagatatccatccagaatatcgcccagttgtcttcatggacacaactactggttaccaattccttagcggttcaacaaaacgctctaacgaaacagttgagttcgaaggcgaaacttacccattgatccgtgtggaaatttcatcagactcacacccattctacactggacgtcaaaagttcactcaagcagatggacgcgtggatcgtttcaacaaaaaatacggtctcaaataa

SEQ ID NO: 1834 - DNA, 936 bp, Streptococcus pneumoniae
atggagatttgccaacaaattttagaaaaaattaaagaatacgacaccattatcattcatcgtcatatgaaaccagaccctgatgccttggtaagtcaggtgggattgaaagccttgctggaacatcatttcccagaaaaaaccatcaaagccgtcggttttgatgaaccaactcttacttggatggctgagatggatcttgttgaagatagggcctaccaaggcgcacttgtcatcgtctgtgatacagctaatactgctcgtatcgatgataaacgctatagtcaaggtgattttctcattaagattgaccaccatccaaatgatgatgtatacggtgacctgtcttgggtcgatactagttcaagtagcgctagcgagatgattaccctatttgcccaaacaacccaactagccttggcagatcgcgatgctgagttgctctttgcaggaattgtcggtgatacaggtcgcttcctctacccttctaccactgcacggactcttcgcctggctgcttatttgagagaacataactttgactttgcagctctcactcgcaaaatggacactatgagctacaaaattgctaaactgcaaggctacatctacaaccatctggaagtggatgaaaatggtgctgctcgcgttatcctgagtcagaaaatcttgaaacaatacaatgtaaccgatgctgaaactgcgaccattgtaggtgcacctggacgcattgacagagtgagtctctggggaatttttgtccacagggctgatggccactaccgagttcgcttacgcagtaaagtccatcctatcaatgaaattgccaaggagcatgatggtggaggccaccctctagcaagtggtgctaattcctatagcctaaaagaaaacgaaatcatctaccaaaagttaaaaaacttgcttaaaaactga

SEQ ID NO: 1835 - DNA, 432 bp, Streptococcus pneumoniae
atggcattagcaaaaattgtatttgccagtatgaccggtaataccgaagaaattgcagatattgtagcagacaaattacgtgacttgggcttggatgttgatgttgatgaatgtacaactgttgacgcttcagacttcttggaagcagacatcgctatcgttgcgacctatacttatggtgatggtgaattgccagatgagatgatggacttctacgaagacctagcagatctcaacttgaatggcaaaatctacggagtggtcggctcaggagataccttctacgatgaattctgtaaggctgttgatgactttgaccgtgtctttgtgtcaacaggagcagaaaaaggttcagagtgtgttaaagttgatctttctgccgaggaagaagatattgaacgcttggaacaattcgcagaagaattggttgct

SEQ ID NO: 1836 - DNA, 267 bp, Streptococcus pneumoniae
gtggatttagatattattcgtcaagaaatcgatcaaatcgacgaccaaattgtcaaactgttagaagaacgaatgcacttagttgaaggagttgtcgcttataagaaggcttcagggaaaccgattttagatactaagagagaagcagttatttttgaaaaggttagaagtcgtgtagaggacaagcgctatcaggagactattgtcgcgactttttcggacatactcaaacgttcgcgtgattatcaggatcaaaatatcaaatga

SEQ ID NO: 1837 - DNA, 375 bp, Streptococcus pneumoniae
atgaaaaaagaacaattttatccgctagggatttttctagctgctatgttgggcggacttgtccgctacctagtttccacttggttaccagccagtccagatttcccttggggcactctctttgtcaactatctgggaattttctgcttgatttatcttgtcaagggctatctggtctataaggggactagtaagggcttgattttagcactggggacgggtttttgcggaggtttaacaactttttccagcctaatgcttgatactgtgaagctgcttgatacagggcgttatcttagtttgatactgtatttgcttttgagtatcggtggaggcctgcttttagcttactatttggggaggaagaaatggtaa

SEQ ID NO: 1838 - DNA, 330 bp, Streptococcus pneumoniae
atggtaatcgtctatcttgcaatcgcctgtggcttgggagcactcgtacggtatttcttttctcgctataatcaagcttctaaattgccactcggaacgctcatagctaatcttttaggttgttttttaattggagtattctacaatcatgtagagtctaaggaagtatatgctattctagcaacaggattttgtggcggtttaacaactttttcgaccttgaatgacgaacttcaaagactgctaagtgataagaaggtcttttattcttacctgactttgacttacataggtggtttggttgcgatttttttaggaattttgctataa

SEQ ID NO: 1839 - DNA, 348 bp, Streptococcus pneumoniae
atgaatccattaatccaaagcttgactgaaggtcaacttcgtacagatatcccatcattccgtcctggtgacactgttcgtgtacatgcgaaagttgtcgaaggtaaccgtgaacgtatccagatttttgaaggtgttgttatcgcacgtaaaggtgctggaatctcagaaaactacacagttcgtaaaatctctaacggtgtaggtgttgagcgtatcttcccaatccacactccacgtgttgaaaaaatcgaagttgttcgttacggtaaagtacgtcgtgcgaaattgtactacttgcgtgctcttcaaggtaaagcagctcgtatcaaagaaatccgtcgttaa

SEQ ID NO: 1840 - DNA, 807 bp, Streptococcus pneumoniae
atgagtattaaactaatcgctgtcgatattgacggaaccctagtcaacagtcaaaaggagattactcctgaagtcttttctgccatccaagatgccaaagaagctggtgtcaaagtcgtgattgcaactggccgccccatcgcaggtgttgccaaacttctggacgacttgcagttgagagaccaaggtgactatgtggtgaccttcaatggtgcccttgtccaagaaactgctactggccatgagattatcagcgaatccttgacctatgaggattatctggatatggaattcctcagtcgcaagctcggtgtccacatgcatgccattaccaaggacggtatctatactgcaaatcgcaatatcggaacatacactgtacacgaatcaaccctcgtcagcatgcctatcttctaccgtacccctgaagaaatggctggcaaagaaattgttaaatgtatgtttatcgatgaaccagaaattctcgatgctgcgattgaaaaaattccagcagaattttacgagcgctactccatcaacaaatctgctcctttctacctcgaactccttacaaagaatgtagacaagggttcagccattactcacttggctgaaaaactcggattgaccaaagatgaaaccatggcaatcggtgacgaagaaaatgaccgtgccatgctggaagtcgttggaaaccccgttgtcatggaaaatggaaatccagaaatcaaaaaaatcgccaaatacatcactaaaacaaatgacgaatccggcgttgcccacgccatccgaacatgggtactgtaa

SEQ ID NO: 1841 - DNA, 1341 bp, Streptococcus pneumoniae
ttaccaaaaagagcaggattttgctataatggtcatatgaacgaaaaagtattccgtgacccagttcacaactacatccatgtcaataatcaaatcatctatgacttgattaatacaaaagaatttcagcgtttgcgccggatcaaacaactgggaacttccagttataccttccacggtggagaacacagtcgcttctctcactgtctaggagtctatgaaattgcacgacgcatcacagagattttcgaagaaaaatatcctgaggaatggaatcctgccgagtctctcttgaccatgaccgctgctctcctacatgaccttgggcatggcgcctactcccatacttttgaacatctctttgatacagaccatgaagccattactcaggagattattcaaaatcctgagacagagattcaccaagtcttgctacaagtagcgcccgattttccagaaaaagttgccagtgtcatagaccatacctatcctaataagcaggtcgtgcagctcatttctagtcagattgacgcagatcgcatggactatctcttgcgcgactcctattttacaggagcatcctatggggaatttgacctgactcgcatcctccgagtcattcgtcctgtcgaaaatggtatcgcctttcagcgcaatggcatgcacgccatcgaagactacgtcctcagtcgctaccagatgtacatgcaggtttatttccacccagcaacacgcgccatggaagttctcctacagaatcttctcaagcgcgccaaggaactctaccctgaggacaagaatttctttgcacgaacttccccacatctcctgcctttcttcgaaaaaaatgtgaccttgactgactatctggctctggatgatggcgtgatgaatacctacttccagctttggatgactagtcctgacaaaattcttgcagatttatctcaacgctttgtcaaccgcaaggtctttaaatccattaccttttcacaagaggaccaagatcaacttactagcatgagaaaattggttgaggacatcggctttgatcccgactactatactgccattcataagaactttgacctcccttatgatatctatcgtcccgaatctcaaaatccacggacacagattgagattttacaaaaaaatggagaactggccgaactctctagcctgtctcctatcgtccaatcccttgctggcagtcgccacggagataatcgcttttattttccaaaagaaatgttggaccaaaacagcatctttgcaagcattacccagcaatttttacacttgattgagaacgatcattttaccccaaataaaaactag

SEQ ID NO: 1842 - DNA, 378 bp, Streptococcus pneumoniae
gtgaagattcggatgcgaaatacgattcagtttgatgagcagttggaagtgattgaccagctttatgatgtggaagtgcatgaaaagggagattatagctatttactcttttataatgaggaaaaggaaaaagtagttattaaatttcatggtcaagaactggtgatgagccgattttctaatcccaagaccattatgcgctttttaaaggatagtgatagtttggcctatattcctacccctatgggcatgcaggaatttatcattcaaacgagccgttatcaagttgataggcaaaagattgagctagcttatcaactacaaaatcaagaggggcatccctttgccagctatcaattggaaattacttggggctag

SEQ ID NO: 1843 - DNA, 333 bp, Streptococcus pneumoniae
atggaaatcgaaaaaaccaatcgtatgaatgcgctctttgaattttatgcggcgcttttgacagataagcaaatgaattatatagagctttactacgctgatgattacagtcttgctgagatagctgaggagtttggtgttagtcgtcaggctgtctatgacaatatcaagcgaacagaaaagattctggaagattatgagatgaaattgcacatgtactcggactacattgtccgtagtcagatttttgaccaaatcttggagcgctatcccaaggatgattttctgcaggagcagatagaaattttaacaagcattgataatagagaataa

SEQ ID NO: 1844 - DNA, 555 bp, Streptococcus pneumoniae
ttgagtttgttggccaatttaccagcaaaggttgttttaccagccccttgtaaaccaaccatcatgatgatggttggaatcttaggtgacttgataatttctgccgtatcagaacctaaaacggctgtcagttcctcatcaacgattttaataatctgttgcgcaggattaagtgtatcaatgacctcatgcccgactgcacgctcacgaactttcttgataaagtcctttacaacaggcaaggcaacgtcggcctcgagcaaggccaagcgaatttctttggttgcctcttggacatcagattcagagatttttccttttttacgtagatttttaaagacgttctgcaaacgttctgttaaactttcaaatgccatttttcttcctcttattctctattatcaatgcttgttaaaatttctatctgctcctgcagaaaatcatccttgggatagcgctccaagatttggtcaaaaatctgactacggacaatgtagtccgagtacatgtgcaatttcatctcataatcttccagaatcttttctgttcgcttga

SEQ ID NO: 1845 - DNA, 1572 bp, Streptococcus pneumoniae
atggcatttgaaagtttaacagaacgtttgcagaacgtctttaaaaatctacgtaaaaaaggaaaaatctctgaatctgatgtccaagaggcaaccaaagaaattcgcttggccttgctcgaggccgacgttgccttgcctgttgtaaaggactttatcaagaaagttcgtgagcgtgcagtcgggcatgaggtcattgatacacttaatcctgcgcaacagattattaaaatcgttgatgaggaactgacagccgttttaggttctgatacggcagaaattatcaagtcacctaagattccaaccatcatcatgatggttggtttacaaggggctggtaaaacaacctttgctggtaaattggccaacaaactcaagaaagaagaaaatgctcgtcctttgatgattgcggcggatatttatcgtccagctgccattgaccagcttaagaccttgggacaacagattgatgtgcctgtctttgcacttggaacagaagtaccagctgttgagattgtacgtcaaggtttggagcaagcccaaactaatcataacgactatgtcttgattgatactgcgggtcgtttgcagattgatgagctcctcatgaatgagcttcgtgatgtgaaaacattggctcaaccaaatgaaatcttgcttgtcgttgatgctatgattggtcaggaagcagccaatgttgcgcgtgagtttaatgctcagttggaagtgactggggtcatccttaccaagattgatggcgatactcgtggtggtgctgctctgtctgttcgtcacattactggaaaaccaatcaagttcactggtacaggtgaaaagattacggacattgaaaccttccacccagaccgcatgtctagccgtatccttggtatgggggatatgctcactttgattgagaaagcttctcaggaatacgatgaacaaaaagcccttgaaatggctgagaagatgcgcgaaaacacctttgattttaatgatttcatcgatcaattagatcaggtgcaaaatatggggccgatggaagacttgctcaagatgattccaggtatggcaaacaatccagcccttcaaaacatgaaggtggatgaacgccagattgctcgtaaacgtgccattgtgtcttcgatgacacctgaagagcgtgaaaacccagatttgttaaatccaagccgtcgccgtcgtattgctgctggttctggaaatacattcgtcgaagtcaataaattcatcaaggactttaaccaggctaaacagctcatgcagggtgttatgtctggggatatgaataaaatgatgaagcaaatggggattaatccaaataaccttcctaaaaatatgccaaatatgggaggaatggatatgtctgcccttgaaggaatgatgggacaaggcggtatgcctgacttatcagctctcggaggagcaggaatgccagatatgagccagatgtttggtggcggtttgaaaggtaaaattggtgaatttgctatgaaacagtccatgaaacgtatggctaacaaaatgaagaaagcgaagaagaaacgcaagtaa

SEQ ID NO: 1846 - DNA, 489 bp, Streptococcus pneumoniae
ttgtcttacttgcgtttcttcttcgctttcttcattttgttagccatacgtttcatggactgtttcatagcaaattcaccaattttacctttcaaaccgccaccaaacatctggctcatatctggcattcctgctcctccgagagctgataagtcaggcataccgccttgtcccatcattccttcaagggcagacatatccattcctcccatatttggcatatttttaggaaggttatttggattaatccccatttgcttcatcattttattcatatccccagacataacaccctgcatgagctgtttagcctggttaaagtccttgatgaatttattgacttcgacgaatgtatttccagaaccagcagcaatacgacggcgacggcttggatttaacaaatctgggttttcacgctcttcaggtgtcatcgaagacacaatggcacgtttacgagcaatctggcgttcatccaccttcatgttttga

SEQ ID NO: 1847 - DNA, 771 bp, Streptococcus pneumoniae
ttgctgcctttatcaatacaaaagggaaaaggcttcctacgaatcattccattcctctttgccattatcggtggttaccttttcgcactaactcttggcttggttgactttacaccagttcttaaagccaactggttcgaaagtcctggtttctacttgccatttagcacaggtggtgcctttaaagagtacaatctttactttggtccagaagccatcgctatcttgccaatcgctatcgtaacaatttctgaacatatcggagaccatactgttttgggtcaaatctgtggccgtcaattcttaaaagaaccaggtcttcaccgtactcttattggtgacggtatcgcaacttctgtttctgccttccttggtggaccagccaatacaacttacggagaaaatacaggggttatcggtatgactcgtatcgcttctgtctcagttatccgtaacgctgccttcatcgcgattgccctcagcttccttggtaaattcactgccttgatttcaactattccaaacgctgtacttggtggtatgtcaatccttctctatggggttatcgccagcaatggtttgaaagtcttgattaaagaacgtgttgatttcgctcaaatgcgaaacctcatcatcgcaagtgctatgttggttcttggacttggaggagctatccttaaacttggtccagttacactttcaggtactgccctttcagccatgacaggaatcatcttgaacttgatcttgccatacgaaaataaagactaa

SEQ ID NO: 1848 - DNA, 441 bp, Streptococcus pneumoniae
  unsure (417): n at each above location is unknown.
atgacacaagaatcaactgttgatttgttactagacgttaaccaaggtccttcggatggcaaaggaattctccttagtttcctacatgttttcgccatgtttggtgcgaccatcttggtaccattgattttgggaatgcctgtatctgttgccctttttgcttcaggtgttggaacactcatctacatgattgctactggttttaaagttccagtttatctaggttcttcatttgcctttatcacagctatgtcactggctatgaaagaaatggggggggatgtatctgctgcccaaacaggggttatcttgactggtttggtctatgtccttgttgctaccagcatccgatttgtaggaccaaaatgccttgataaactcttgcccccaatcattatcggtcctatgatcatcgtnatcggtcttggacttgcacgttga

SEQ ID NO: 1849 - DNA, 714 bp, Streptococcus pneumoniae
atgaaaccagaaacattttacaacttgcttgccgagcagaatcttccactttcgaaccagcaaaaagaacaatttgaacgttattttgagctcttggtcgagtggaatgagaagattaatttgacggcgattacggacaaggaagaagtttatctcaaacatttttacgattcgattgcacccattcttcaaggtttgattcccaatgaaactatcaaacttcttgatatcggggctggggcaggatttcctagtctaccaatgaaaattctctatccggagttagatgtgaccattattgattcactcaataagcgcatcaacttcctacaactcttggctcaagaactggatttgaacggagttcatttctaccacggacgtgccgaagattttgcccaagacaagaacttccgtgctcaatatgattttgtaacagctcgtgcggttgcccgtatgcaggtcctatctgaattgactattccctaccttaaggttggtggcaaactattggcactcaaggccagcaatgcgcctgaggaattattagaagctaagaatgccctcaatctcctttttagtaaggtcgaagacaatctcagctacgccctaccgaatagagatccgcgctatatcacagtggtagaaaagaaaaaagaaacaccaaataaatatccacgtaaggctggtatgccaaataaacgcccactttaa

SEQ ID NO: 1850 - DNA, 561 bp, Streptococcus pneumoniae
atgacttggattattcttggagttatcgctcttattgttatttttgtgattgttagctataacggtttggttaaaaatcgtatgcaaaccaaggaggcttggagtcagattgatgttcagttgaaacgtcgaaatgacctcttgccgaacttgattgagactgtaaaaggttatgccaaatatgaaggttctacccttgaaaaggtggcagaactacgtaaccaagtggcggcagcgacttcaccagcagaagctatgaaagccagtgatgccctcactcgtcaggtttcaggtatttttgcagttgcagaaagctatccagatttgaaagctagtgctaactttgttaaattgcaagaggagttgacaaacacagaaaataaaatttcttactctcgtcaactctataacagtgttgtcagcaactacaatgtaaaattagaaactttcccgagcaatattatcgctggaatgtttggatttaaagcggcagatttccttcaaacacctgaagaggaaaagtcggttcctaaagttgattttagcggtttaggtgactaa

SEQ ID NO: 1851 - DNA, 909 bp, Streptococcus pneumoniae
gtgactaagatgttgtttgatcaaattgcaagcaataaacgaaaaacctggattttgttgctggtatttttcctactcttagctcttgttggttatgcggttggttatctctttataagatctggacttggtggtttggttatcgcactgattatcggctttatctacgctttgtctatgatttttcaatcgacagagattgtcatgtccatgaatggagcgcgtgaggtggatgagcaaacggcaccagacctctaccatgtagtggaagatatggctctggtcgctcagattcctatgccccgtgttttcatcattgatgatccagccttaaatgcctttgcgacaggttctaatcctcaaaatgcggctgttgctgcgacttcaggtctactagctatcatgaatcgtgaagaactagaagctgttatgggacatgaagtcagtcatattcgtaattatgatatccgtatttcgactattgcagttgcccttgctagtgctatcaccatgctttctggtatggcaggtcgtatgatgtggtggggtggagcaggtcgcagacgaagtgatgatgaccgagatggaaatggtcttgaaatcattatgctagtggtttccctactagctattgtactggcacctctcgctgcaaccttggttcagctcgctatttctcgtcagagggaatttctggcagatgcatctagtgttgagctgactcgcaatccccagggaatgattaatgccctagataagttggacaatagcaaaccgatgagtcgccacgtcgatgatgctagcagtgctctttatatcaatgatcccaagaaaggtggggggttccaaaaactcttttatacccacccacctatctcagaacggattgaacgtttaaaacagatgtaa

SEQ ID NO: 1852 - DNA, 1560 bp, Streptococcus pneumoniae
atgcactatgaacattctagaaagggaaatcatatgataaaaatcaatcatctaaccatcacacaaaacaaagatttacgagatcttgtatctgacctaaccatgaccatccaagacggggaaaaggttgctattattggtgaagaaggaaatggcaaatcaaccttacttaaaattttaatgggggaagctttgtctgatttcactatcaagggaaacatccaatctgactatcagtcactggcctacattcctcaaaaacttcccgaggagctgaaaaagaaaactttacacgactacttctttttagattctattgatttagactacagtatcctctatcgtttggcggaggaattgcattttgatagcaatcgtttcgcaagtgaccaagagattggcagtctatcagggggcgaagctttgaaaattcagcttatccatgagttagccaaaccctttgagattctatttttagatgaaccttcaaatgacctagaccttgagacagttgattggttaaaaggccaaattcaaaagaccaggcaaaccgttattttcatttcccatgatgaagactttctttctgaaacggcagacactattgttcacttgcgactggtcaaacaccgtaaagaagcggaaacgctagtagagcatttagactatgatagctatagtgagcagagaaaggctaattttgccaaacaaagtcagcaagctgctaacaaccaaagagcctacgataaaaccatggaaaaacatcggagagttaagcaaaatgtagaaactgcgcttcgagctaccaaagatagtactgccggtcgcctattggctaaaaagatgaaaactgtcctctcacaagaaaaacgctacgaaaagacagctcagtccatgactcaaaagccacttgaagaggaacaaatccaacttttcttttcagacatccaaccattaccagcttctaaagtcttagtccaactggaaaaagaaaatttgtccattgacgaccgagttttggttcaaaaactacaactaactgtccgtgggcaagaaaaaatcggtattatcgggccaaatggtgttgggaaatcaactctgttagccaaattaaagcaacttctgaatgataaaagagagatttcccttggttttatgccacaagattaccacaaaaaactgcaattggatttatcaccaatagcttatatcagcaaaactggggaaaaagaggaacttcagaaaatccactctcacctagccagtctcaatttcagttatccagaaatgcagcatcaaattcgctccttatctggcggacaacagggaaaactcctgcttttggatctagtcctgcgcaaaccaaactttctcctgctggatgaacccacacgaaacttttctcccacttctcaaccccaaatcaaaaaactctttgcaacctatccaggcggtctcatcactgtttcgcatgaccgtcgtttcttaaaagaagtctgctcgatcatctatcgcatgacagaacacggtttggagttagttaatttagaagatttataa

SEQ ID NO: 1853 - DNA, 276 bp, Streptococcus pneumoniae
tgcataacaaaaagctctactttacctagtagagcccaaagtctatgtcaaaaaaactctattaacatgccagaaaaagagcataaaagagcacacaaaaagagacaaaaacaagatctactaaataaaggttctttatttgatagacttagttgttcatgtctcccttacctccgagtattagtatctttatactatacctttaaggaaattttgtcaacagaaaactggaaattctatgctctaaaatccaaaaacaggtccatagagacttag

SEQ ID NO: 1854 - DNA, 366 bp, Streptococcus pneumoniae
gtgctatactatagggaaagagtacatcagatcaaggaggatgctcacatggaagacaagaaactcattcaactcctatccaagttaaataaaagctaccaaaactgtaaacagggtacggcagatgatattcgactacaagagctgctaaacactactatgcaagagctcaaaaaaacggaacagttgaacaacagtatcttaattgatcttgagaaattttaccaacccaccagtcctctgattggactgggtagcctaaaactaaacaatcaagcacgcactgcttggcgaaactatgataaaatccattacgagcatgtcaaacacgtactaagtctctatggacctgtttttggattttag

SEQ ID NO: 1855 - DNA, 543 bp, Streptococcus pneumoniae
atgaaattaaatattcaagaaattcgtaagcagtctgaaggtttgaactttgaacaaacgttagatttagttgatgacctgcgtgcacgtaatcaagaaattttagatgtaaaagatatccttgcagttgggaaagtacaatatgaagaccgtatgtatttcttagattatcaactatcttataccattgttcttgcttcgagtcgcagtatggagccagttgagttagttgaatcttatccagtcacggaagttttcatggaaggcgcaactaaccatctaaatcaagaaattttagatgatgacttggtcttgcccatcgaaaatggggcgcttgaccttgctgagagtgtatcagacaatatcctgctaaacattcctatcaaggtcttgacggctgaagaagaagctggtcaaggatttgtctcaggaaatgactggcaaatcatgacagaggaagaataccaagctcaacaagcagtaaagaaagaagaaaacagtccttttgctggcttacaaggactatttgacggagatgaataa

SEQ ID NO: 1856 - DNA, 186 bp, Streptococcus pneumoniae
ttggtaaaatcaagactaggcttggcatctgggaagagggcaatgatttcttctagcacctttcgtgctcgtttttttgacaagaccattattcatctccgtcaaatagtccttgtaagccagcaaaaggactgttttcttctttctttactgcttgttgagcttggtattcttcctctgtcatga

SEQ ID NO: 1857 - DNA, 630 bp, Streptococcus pneumoniae
atggtcttgtcaaaaaaacgagcacgaaaggtgctagaagaaatcattgccctcttcccagatgccaagcctagtcttgattttaccaatcattttgaactcctggttgcggtcatgttatcagcccagacgacagatgcagcggtaaataaggccacaccaggtctctttgttgcctttccaacaccccaagctatgtctgtagcgacagagagtgagattgcttcacatatttctcgcttgggattgtatcggaataaagctaaattccttaaaaaatgtgcccaacagttactagacgattttgatggtcaagtccctcagacacgtgaagaattggagagtttggcaggtgttggtcgcaagacagccaatgttgtcatgagtgtaggatttgggattccagcctttgcagtggatactcatgtggagcgtatttgcaaacaccacgatattgtcaaaaaatcagcgacgccacttgaggtggaaaagcgggtcatggatatcttgccgcctgagcagtggttagatgcccatcaggccatgatttattttggaagagccatttgccatccaaaaaatccagagtgtgaccagtacccacaattatatgattttagcaatttgtaa

SEQ ID NO: 1858 - DNA, 522 bp, Streptococcus pneumoniae
atgaaaacaaaagaagttgtagacgaattgaccgtcaaacgagcgattacgcgtattacttatgagattatcgaacgcaacaaagatttgaataagattgtcttggctggtattaaaactcgtggtgtctttattgcccaccgaatccaagaacgtttgaagcagttagaaaatctttcagttcctgttgtggaattggatactaaacctttccgtgatgatgttaaaagtggagaagatacttctttggtttctgtcgatgtgacagaccgcgaagttatcttggtggatgatgtgctctatacaggtcgtaccatccgtgctgctattgataatattgtcggtcatggtcgtcctgcgcgtgtgagtttagcagttctagtcgatcgtggacatagagaattgccaatccgtccagattacgttggaaaaaatatcccaaccagtcgttctgaagaaatcatcgtagagatgacagaacttgatgaccaagacagagttctgattactgaagaagcttag

SEQ ID NO: 1859 - DNA, 924 bp, Streptococcus pneumoniae
atgtcagaaaatcaacaagcattgaaccatgtggtgtccatggaagacctcactgtcgatcaagtaatgaaattgatcaagcgaggaattgagtttaaaaatggagcccagcttccctatgaagaccatccgattgtttccaatctcttctttgaggattctacacggacacataagtcctttgaagtcgcagagattaaacttggattggaacgacttgactttgatgtgaagactagttcggttaataagggtgagacactttatgacaccattttgactctgtctgctttaggagtggatgtctgtgtgactcgccatccagaggtcgactattatagagaattgattgatagtccaacgattacgacttccatcatcaatggtggagatggttcgggtcaacaccctagccagagcttgcttgatttgatgaccatttatgaggaatttggccactttgagggtcttaaagttgctattgcaggtgacttggaccactcacgcgttgccaaatccaatatgcagattttgaaacgcttgggagctgaactctttttcgctggacctgaggaatggagaagtcaagagtttgcagactatggaaagtttgtaaccattgatgaaatcattgatcaggttgatgtcatgatgtttctccgtgtgcaacacgaacgccatgatagtggagctgtattttcaaaagaagactaccatgcccaacatggcttgactcaagaacgttacgatcgtttgaaagaaacagcaatcctcatgcacccagctccaatcaatcgtgatgtagaaatagcagaccacttggttgaagcaccaaaatcacggattgtccaacaaatgaccaatggtgtctttgttcgaatggcaatcttagaatccgtactagcgagtagaaacgccaactaa

SEQ ID NO: 1860 - DNA, 1080 bp, Streptococcus pneumoniae
atgacaaaaagaattctagtattagaagatggcacagtttttgaaggcaaggccttcggagcagatattgatgtaacaggcgaaatcgtctttaatacagggatgaccggctaccaagaatccattacagaccagtcttataatggacaaatcttgacctttacttatcctttggtaggaaattatggtattaatcgtgatgattatgaatccattattccaacttgtaagggagtcgttgtttttgaagaagcgcgtagagctagcaactggcgcaaccaaatgaccttggatgaatttttgaaagccaagaaaattccagggatttcaggaattgatacgcgtgctcttaccaagattatccgtaagcatggtactatgcgtgcaaccttgacccatgttggggacagtatggaccatgtgacggaccagctccaagcaacagttttaccgacagacaatatcaaacaggtttctactaaaacgtcttatccagctccaggagttggtttgagcgtggtgctagtggactttggtctcaagcactcaatcctacgtgaactttctaaacgcaactgtaacgtgacagttgttccttattcgacaacggctgaagaaattctccatctcaatcctgatggagttatgttgtcaaatggtccaggtaacccagaagacgttccacaagcactcgacatgattcgcggtgtacaaggaaaaattccaatctttggtatttgtatgggacaccaactctttgcaatggcaaacggggctaagacctataagatgaagtttggccaccgtggattcaaccatgcggtacgtgaaatcgcaacaggacgagtagacttcaccagccagaaccatggttatgcagtcagccgcgaggatttgccagagcacttgattattacccacgaagaaatcaatgacaagtcagtggaaggtgtgcgccacagataccaacctgctttctctgttcaataccacccagatgcagctcctggaccacacgacgctagctacctatttgacgagtttatcgagatgatggaaatttttaaacaatcaaactaa

SEQ ID NO: 1861 - DNA, 3177 bp, Streptococcus pneumoniae
atgcctaaacgtactgatattcaaaaaattatggtgattggttctggtccgattattattggtcaggctgctgagtttgattacgctgggacccaggcttgcttgtcgttgaaagaggaaggttatgaggttgttttggttaactcaaatcctgcaaccatcatgacggacaaggaaattgctgacaaggtttacattgaaccgattacacttgagtttgtgacacgtattcttcgtaaggaacgtccagatgccttgctaccaacactcggtggtcagacaggtctcaacatggccatggaattgtctaaaaatggtatcttagatgagcttggcgttgaacttctgggtactaaattgtctgccattgaccaagcggaggaccgtgacctctttaaacaattgatggaagagcttgagcaacccattccagaatctgaaattgttaacacagtagaagaagcaattgcctttgcagcgacaattggctacccagtcatcgttcgtccagcctttacccttggtggtactggtggtggtatgtgtgccaacgagaaagaattgcgtgaaatcactgaaaatggtttgaaattgtcacctgttacccaatgtttgattgagcgttcgattgccggtttcaaggaaattgaatacgaagtgatgcgtgactcagctgacaatgccttggttgtttgtaacatggaaaactttgacccagttgggattcacacaggggattccattgtatttgcccctgcgcaaaccatgtcagactatgaaaaccaaatgcttcgtgatgcgagcttgagcattattcgtgccctcaagattgaaggtggatgtaatgttcagctagctcttgatcctaacagcttcaagtattatgttatcgaagtaaaccctcgtgtatcacgttcgtcagcccttgcttctaaagcgacaggatatccgattgctaagttggctgccaagattgcagtaggtttgaccttggatgaggttataaacccagttacaggttcaacctatgccatgtttgaaccagcccttgactacgtagttgctaagattccacgtttcccatttgacaagtttgaaaagggtgaacgccgtctcggtacacaaatgaaggcgactggagaagtcatggcaatcggtcgtaacatcgaggaatctcttctcaaggcctgccgctcccttgaaattggggtgcaccacaatgaaatacctgaacttgcagcagtttctgatgatgccttgattgaaaaggttgtcaaagcccaagatgaccgtctcttctatgtgtcagaagccattcgccgtggttacacacctgaagaaattgcagagcttacaaaaattgatatcttctatcttgataaactcttgcatatctttgaaattgagcaagaattgggtgctcatccacaagatctagaagttttgaaaacagccaaacttaatggtttttcagaccgtaagattgctgaactctggggaacgactgatgatcaagttcgccaacttcgtttggaaaacaagattatcccagtttataagatggtagacacttgtgcggcagagttcgactctgaaacgccatatttctattcaacctatggttgggaaaatgaatctatcagatctgataaagaatctgtacttgtcctaggttcaggtccaatccgtatcggtcaaggggttgagtttgactacgcaaccgttcactctgttaaggctatccaggcagctggttatgaagctattatcatgaactcaaacccagagaccgtttcaacagacttctctgtatcagataagctttactttgagccattgacattcgaagatgttatgaacgtcattgacttggaacaaccaaagggagttatcgttcagttcggtggtcaaacagccatcaaccttgcggagccattggcaaaagcaggtgtgaccatccttggtacacaggttgctgacctagaccgtgccgaagaccgtgacctcttcgagcaagctctcaaagaattggatattccacagccaccaggacaaacggctaccaatgaagaagaagcagctcttgcagctcgtaagattggcttcccagttcttgtccgcccatcttatgtacttggtggacgtgccatggaaatcgttgaaaacgaagaagaccttcgttcttacatgcgaactgctgttaaggctagtccagaccacccagttcttgtcgactcttacatcgttgggcaagagtgcgaagttgatgccatttcagatggtaaaaatgtactcattcctggtattatggagcatatcgaacgtgctggtgtccactcaggtgactcaatggctgtttacccaccacaaaccttgtcgcaaaaggttcaggagaccatcgcagactacaccaaacgcttagcaatcggtcttcactgccttggaatgatgaacatccagtttgttatcaaggatgaaaaagtctacgttattgaggtcaatccacgtgccagccgtacagttccattcctatctaaggtaaccaatatttctatggctcaagtagcgaccaagctcattcttggtcaaagtttatcagaacttggctaccaaaatggactttaccctgaaagcacccgtgttcatatcaaggcacctgtcttctcctttaccaaactagctaaggtagacagcttgctcggtcctgaaatgaagtcaacaggtgaagttatgggttctgatgctactttggaaaaagctctctataaagcctttgaagcttcttatctacacttgccaacttttggtaatgtcgtctttaccatcgctgatgatgccaaagaagaagccttgaacttggctcgtcgtttccaaaacattggttatggaatccttgcgacagaagggacagcagccttctttgctagtcatggcttgcaagcccaacctgttggtaagattggtgatgatgataaggatatcccaagttttgtacgcaaaggaagaattcaagctatcattaacacagtaggaacaaaacgaactgctgacgaagatggtgagcaaattcgtcgttcagccattgaacacggggtgcccctcttcacagcgctagatacagctaatgccatgcttaaggtacttgaaagtcgtagctttgttacagaagcgatttaa

SEQ ID NO: 1862 - DNA, 210 bp, Streptococcus pneumoniae
aaaaaagtctttaaaattataaaacgcatcatatcaagttttttcaaaaaccttgatatgatgcgttttattgtgggaatatttatttcattttctactaaaattatgtttttgaataacctctatcttagtagtttgtataatccccctcaatcagcttttacgataagctttaatactatgactataccattcttgcatttcttttga

SEQ ID NO: 1863 - DNA, 843 bp, Streptococcus pneumoniae
atgaatttcacgcttataaattggaggattaggatgcaatatttagaaaaaaaagaaattaaagaaattcaactagccctgctggactatattgatgagacttgtaagaaatatgatattccttattttctcagttatggaaccatgcttggagccatccgccacaaaggtatgattccttgggatgatgatattgatatttccctttatcgtgaggattatgagcgtttactgaagattattgaagaagaaaatcaccctcgctacaaggttctttcctacgatacatcttcttggtacttccataatttcgcatcgattttggacacttctactgttatagaagaccatgttaagtacaagcgtcatgataccagccttttcatcgatgtcttcccaattgatcgatttacagacttgagcattgtcgacaagagctataagtatgtggcccttcgtcaactagcttacatcaaaaaatcacgagcagttcacggtgatagcaaactaaaagattttcttagattatgtagctggtacgctctccgatttgtcaatcctcgctacttttacaagaaaattgatcaactagtcaaaaatgctgtaaccaacactcctcaatatgaaggaggagttgggatcggtaaggaagggatgaaagaaatcttcccagttgatacctttaaagaactcatcttaactgagtttgagggccgtatgttgcctgttcccaaaaaatatgaccaatttttaacccagatgtatggcgattatatgacaccaccatcaaaagaaatgcaagaatggtatagtcatagtattaaagcttatcgtaaaagctga

SEQ ID NO: 1864 - DNA, 804 bp, Streptococcus pneumoniae
atgaaacaactaaccgttgaagatgccaaacaaattgaattagaaattttggattatattgatactctctgtaaaaagcacaatatcaactatattattaactacggtactctgattggggcggttcgacatgagggctttatcccttgggacgacgatattgatttatccatgcctagagaagactaccaacgatttattaacatttttcaaaaggaaaaaagcaagtataagctcctatccttagaaactgataagaactactttaacaactttatcaagataaccgacagtacgactaaaattattgatactcgaaatacaaaaacctatgagtctggtatctttatcgatattttccctatagatcgctttgatgatcctaaggtcattgatacttgttataaactggaaagcttcaaactgctgtctttcagtaaacataaaaatattgtctataaggatagccttttaaaagattggatacgaacagccttttggttgctccttcgaccggtttctcctcgttattttgcaaataaaatcgagaaagaaattcaaaaatatagtcgtgaaaatgggcagtatatggcttttattccttcaaaatttaaggaaaaggaagtcttcccaagtggtacctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattag

SEQ ID NO: 1865 - DNA, 1488 bp, Streptococcus pneumoniae
atgaaaagtataaaattaaatgctctatcttacatgggaattcgtgtcttgaatattatttttcccatcctaactggaacctatgtcgcgcgtgtcttggaccgaactgactatggttacttcaactcagtcgacactattttgtcatttttcttgccctttgcaacttatggtgtctatagctacggtttaagggctatcagtaatgtcaaggataacaaaaaagatcttaacagaaccttttctagtcttttttatttgtgcatcgcttgtacgattttgaccactgctgtctatatcctagcctatcctctcttctttactgataatccaatcgtcaaaaaggtctaccttgttatggggattcaactcattgcccagattttttcaatcgaatgggtcaatgaagctctggaaaattacagttttctcttttacaaaactgccttcatccgtatcctgatgctggtctctattttcttatttgttaaaaatgaacacgatattgttgtctatacacttgtgatgagtttatcgacgctgattaactacctgattagttatttttggattaaaagagacatcaaacttgttaaaattcacctaagtgattttaaaccactctttctccctctgacagccatgttagtctttgccaatgccaatatgctcttcacttttttagatcgcctcttcctcgttaaaacagggattgatgtcaacgttagttactataccatagctcagcgaattgtgaccgttatagctggggttgtaacaggtgcaattggagtgagtgtgcctcgtctcagttactatctggggaaaggagacaaagaagcctatgtttctctggttaatagaggtagtcgaatctttaacttctttatcattccactgagttttggactcatggttttaggaccaaatgccatcctactttacggtagtgaaaaatatatcggaggcggcatcttgacctctctcttcgcttttcgtacgattatcctggccttagataccattcttggttcccaaattctctttaccaatggctatgaaaaacgtatcacagtctatacagtctttgctgggctactcaatttgggcttgaatagtctcctttttttcaaccatatcgtggctcctgaatactacttactgacaactatgctatcagagacttctctacttgttttctatatcattttcatccatagaaaacaactcatccacttgggacatatctttagctatactgttcgatactctctcttttcactttcctttgtagcaatttatttcctgattaatttcgtgtatcctgtagatatggtcattaatttgccatttttgattaatactggtttgattgtcttgctatcagctatctcttatattagtctacttgtcttcacaaaagatagcattttctatgaatttttaaaccatgtcctagccttaaaaaataaatttaaaaaatcatag

SEQ ID NO: 1866 - DNA, 708 bp, Streptococcus pneumoniae
atgatttatgcaggaattcttgccggtggaactggcacacgcatgggaatcagtaacttgccaaaacaatttttagagctaggtgatcgacctattttgattcatacaattgaaaaatttgtcttggaaccaagtattgaaaaaattgtagttggggttcatggagactgggttttacatgcagaagatcttgtagataaatatcttcctcttcataaggaacgtattatcattacaaagggtggtgctgaccgcaatacaagtattgagaacatcattgaagccattgatgcttatcgcccgcttactccagaggatatcgttgttacccacgattctgttcgtccatttattacgcttcgcatgattcaagacagtatcaaacttgctcaaaatcatgacgcagtggatacagtagtagaagcagtggatactatcgttgaaagtaccaatggtcaattcattacaggtattccaaatcgtgctcacctctatcagggacaaacacctcaaacattccgttgcaaggacttcatggacctttatggatctctttctgatgaagagaaggaaatcttgacagatgcatgtaaaatctttgtgatcaaaggaaaagatgtagccttggccaaaggcgaatactcaaatctgaagattacaaccgtaacagatttgaagattgcaaaaagtatgattgagaaagactag

SEQ ID NO: 1867 - DNA, 1041 bp, Streptococcus pneumoniae
ttgagaaagactagtaaaatgattaatcaaatttatcaactaactaaacctaagtttatcaatgtcaaatatcaggaagaggctattgaccaagagaatcatatccttatccgtcccaactacatggctgtctgtcatgcggatcagcgttactaccagggaaaacgtgatcccaagattttgaataaaaagcttccaatggcaatgattcacgagtcatgtggaatcgtcatttctgacccgagcggaacctacgaggttggtcaaaaagttgtcatgattcccaatcagtctcctatgcagagtgatgaagaattctatgaaaactacatgacagggacccatttcttgtctagtggatttgatggctttatgagagagtttgtttctctccctaaagatcgtgtggtggcttatgatgctattgaagatacggttgcagccattacagagtttgtcagtgtgggcatgcacgctatgaatcgtctattgactcttgctcatagcaagcgggagcggatcgccgttattggagatggaagtttagcttttgtggttgccaatattatcaactatactttgccagaagcagagattgtggttattggtcgtcattgggaaaagttggaactcttctcatttgccaaagaatgctatattacggataatattcctgaagagttggcctttgaccatgcttttgaatgttgtggtggtgatggtactggaccagctattaatgacttgattcgctacattcgtcctcagggaacaattctcatgatgggagttagcgaatataaagtcaatctcaatactcgcgatgccttagaaaagggcttgctcttggttgggtcatctcgttctggtcgcattgattttgaaaatgctatccaaatgatgaaagtcaagaaatttgccaatcgtcttaaaaatatcctttatctagaagaacctgtaagagaaattaaagatattcaccgtgtctttgcaaccgatttaaacacagcctttaaaacagtgtttaagtgggaagtataa

SEQ ID NO: 1868 - DNA, 870 bp, Streptococcus pneumoniae
gtggagaaaatcattaaagaaaaaatttcttccttacttagtcaagaagaagaagtcctcagtgttgaacaactgggtggaatgaccaatcaaaactatttggccaaaacaacaaataagcaatacattgttaaattctttggtaaagggacagaaaagcttatcaatcgacaagatgaaaagtacaatcttgaactactaaaggatttaggcttagatgtaaaaaattatctttttgatattgaagctggcatcaaagtaaatgagtatatcgaatctgcgattacgcttgattcaacgtcaatcaagaccaagttcgacaaaattgctccaatattacaaactattcatacatctgctaaggaattaagaggagaatttgctccttttgaagaaatcaaaaaatacgaatccttgattgaagaacaaattccttatgccaactatgaatctgttagaaatgcagtcttctccttagagaaaagactggctgacttaggtgttgacagaaaatcttgtcatatcgatttggtgcctgaaaactttatcgaatcacctcaaggacgactttatttgattgactgggaatattcatcaatgaatgatccaatgtgggatttggctgccctctttttagagtctgaattcacttcccaagaggaagaaactttcttatctcactatgagagtgaccaaacaccggtttctcatgaaaagattgctatttataaaattttacaagatactatttggagtctatggactgtctataaggaagagcaaggtgcagattttggttactatggtgtgaatcgttaccaaagagctgttaaaggtttggcttcttatggaggatcagatgaaaagtaa

SEQ ID NO: 1869 - DNA, 879 bp, Streptococcus pneumoniae
atgaaaagtaaaaacggagttccttttggccttctctcaggtattttctggggcttgggtctaacggttagtgcttatatcttttcgatttttacagatttgtcaccctttgtggtggctgcagctcatgattttttgagcatctttatcttactagcttttctcttggtaaaagaagggaaagttcgcctctcaattttcttaaatattcgcaatgtcagtgttatcatcggagccttgctagcaggccctatcggtatgcaggccaatctttatgcagttaagtatatcggaagttctttagcttcatctgtatcggctatttaccctgcgatttcagttctattggctttcttctttttgaagcacaagatttcgaaaaatactgtatttgggattgtcttgattattggagggattattgcccagacctataaggttgaacaggttaattccttctacattgggattctctgtgctttggtttgtgctattgcatggggaagtgagagtgttcttagctcctttgctatggaaagtgaactgagtgaaatcgaagccctcttaatccgtcaagtgacttcgttcttgtcctatcttgtgattgtgctcttctctcatcagtcatttactgcagtagtcaatggacaattgctaggtctcatgattgtttttgcagcctttgatatgatttcctacttggcttattatatcgctatcaatcgcttgcaaccagccaaggctacaggcttgaacgtgagctatgtagtatggacggtcttgtttgcagttgtttttttgggtgcaccgctagatatgctgaccattatgacgtcacttgtcgtcattgctggagtttatattattattaaagaataa

SEQ ID NO: 1870 - DNA, 690 bp, Streptococcus pneumoniae
gtgaaagccattatcttagcagcgggattgggaactcgcttgcgtcctatgactgaaaatacccctaaagccttggttcaggttaatcaaaaacctttgattgaataccaaattgagtttctcaaagaaaaaggaatcaatgacatcatcatcattgttggttatcttaaagaacaattcgattacttaaaagaaaaatacggtgttcgcctcgttttcaatgataaatacgctgactacaataacttttactctctctatcttgtaaaagaagaattggccaacagctatgttattgatgcagataactatctctttaaaaatatgttccgcaatgatttgactcgttcgacttattttagtgtttatcgtgaagattgtaccaacgaatggttcttggtctatggagatgactacaaggttcaagacattattgttgatagcaaggcaggtcgcatccttagtggtgtatccttctgggatgctccaactgcagaaaagattgtcagctttatcgacaaggcttatgcaagtggcgaatttgttgatctctactgggacaatatggttaaggataatatcaaagagctagatgtctatgttgaagaattagaaggcaatagcatttatgagatcgatagtgtccaagactatcgtaaattagaagaaattcttaaaaacgaaaattaa

SEQ ID NO: 1871 - DNA, 849 bp, Streptococcus pneumoniae
atgaaaatcacaaactatgaaatctataagttaaaaaaatcaggtttgaccaatcaacagattttgaaagtgctagaatacggtgaaaatgttgatcaggagcttttgttgggtgatattgcagatatatcaggttgtcgtaatccagccgtttttatggaacgttattttcagatagacgatgcgcatttgtcgaaagagtttcaaaaatttccatctttctctattttagatgactgttatccttgggatttgagtgaaatatatgatgcgcctgtacttttattttacaagggaaatcttgacctcctgaaattcccgaaggtagcggtcgtgggcagtcgtgcttgtagcaaacagggagctaaatcagttgaaaaagtcattcaaggcttggaaaatgaactggttattgtcagtggtctggccaagggcattgacacagcagctcatatggcagctcttcagaatggcggaaaaaccattgcagtgattggaacaggactggatgtgttttatcctaaagccaataaacgcttgcaagactacatcggcaatgaccatctggttttaagtgaatatggacctggcgaacaacctctgaaatttcattttcctgcccgtaatcgcatcattgctggactttgtcgtggtgtgattgtagcagaggctaagatgcgttcaggtagtctcattacgtgtgagcgagcaatggaagaaggacgcgatgtctttgctattcctggtagcattttagatggactatcagacggttgccatcatttgattcaagaaggagcaaaattggtcaccagtgggcaagatgttcttgcggaatttgaattttaa

SEQ ID NO: 1872 - DNA, 513 bp, Streptococcus pneumoniae
ttgataatatgcgttttttctaagtggattagtagagtagaggatttttctcatataatactcttcgaaaatctctgcaaactacgtcagcttccatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctgcaacctcaaaacagtattttgagctgacttcgtcagtcttatctacaacctcaaagcagtgctttgagcaacctgtggctagcttcctagtttgcgctttgattttcattgagtataagggaaagtatagtgaattgaaataa

SEQ ID NO: 1873 - DNA, 456 bp, Streptococcus pneumoniae
ttgactttcctgatagagttgttcacatcttatttcaattcactatactttcccttatactcaatgaaaatcaaagcgcaaactaggaagctagccacaggttgctcaaagcactgctttgaggttgtagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagataagactgacgaagtcagctcaaaatactgttttgaggttgcagatggaagctga

SEQ ID NO: 1874 - DNA, 207 bp, Streptococcus pneumoniae
aatggttattataaaaaatggtctgaaatagatgatgatacttttcgaaaatctttttacgtcagctcagctttgccttgctgtgttttgagcaagctacggttagcttccgagtttgattttcatttactagaaatgaaactgatgagagatatcagtagacatttgagtcaggatattatggaaaatgataaaaagagctcgtga

SEQ ID NO: 1875 - DNA, 1044 bp, Streptococcus pneumoniae
gtgacaaataataaactgtattcgttgatagaatttagaaataaaatatatgaagaattagaactttccagaagtgatttagcgattttactatgtgccatgcttatcgcctctatcggattaaatatggattcgactcccgtgattattggagccatgttaatctctcctttgatgacacctattctgggagtggggctctctctagctatatttgattttaaattgttaagaaaatcttttaaaatattagctattcaaattcttgccagtctaatagcttcaacactttatttttatctttctcccatttcgtatgctagttcggagattgttgctagaacctctccgactatttgggatgttctcattgcttttgtaggagggatagcaggtattattggtgctaggaaaaaagagaccaataatattgttcctggtgttgctattgcaaccgccttgatgcctcctctttgtacagtaggttatgctattgcttctgctaatctaaaatttatcataggctcctcttacctatttctcatcaattgtagctttattgtcattgcgacttatataggtgttaggttgatgatggttaagaaacattattttaaagataatgaagaagactctaaaatgcgtaggattttgcttctagttgctgttttgctgatgattccgagtttcatctctgcaacgactttagtgagagaaacgttgaaaaaagagtcccttaagaaatttatatcagagcagtttcaggggcataatattttgaaaaaaacctattctaaaaagactcataccctaaagctaaccatttcaggaaattatttgacagaagaagaactcgatatgatttcaagtaagagaggtgactatggtttaagtgatgtttctgttcaagtttcacaattgtctgattcagaacaacttagtaaggaagaactggtggagtatttcttccagtatatcaaggataaggaagcaaaagaaaaggaaaaagctaataagttttatacagagtctgaggagcaataa

SEQ ID NO: 1876 - DNA, 2106 bp, Streptococcus pneumoniae
ttgaaaaggtgtgatactgtggctacggtaacaaaaaagaaaaaatcaacagttaaaaaaaatctagtcatcgtggagtcgcctgctaaggccaagacgattgaaaaatatctaggcagaaactacaaggttttagccagtgtcgggcatatccgtgatttgaagaaatccagtatgtccgtcgatattgaaaataattatgaaccgcaatatatcaatatccgaggaaaaggccctcttatcaatgacttgaaaaaagaagctaaaaaagctaataaagtttttctcgcgagtgacccggaccgtgaaggagaagcgatttcttggcatttggcccatattctcaacttggatgaaaatgatgccaaccgtgtggtcttcaatgaaatcaccaaggatgcagtcaaaaatgcttttaaagaacctcgtaagatcgatatggacttggtcgatgcccaacaagctcgtcggatcttggatcgcttggtagggtattcgatttcgcctattttgtggaagaaggtcaagaagggcttgtcagcaggtcgcgttcagtccattgcccttaaactcatcattgaccgtgaaaatgaaatcaatgccttccagccagaagaatactggacagttgatgctgtctttaaaaagggaaccaaacaatttcatgcttccttctatggagtagatggtaaaaagatgaaactgaccagcaatgacgaagtcaaggaagtcttgtctcgtctgactagtaaagacttttcagtagatcaggtggataagaaagagcgcaagcgcaatgctcctttaccctataccacttcatctatgcagatggatgctgccaataaaatcaatttccgtactcgaaaaaccatgatggttgcccaacagctctatgaaggaattaatatcggttctggtgttcaaggtttgattacctatatgcgtaccgattcgactcgtatcagtcctgtagcgcaaaatgaggcggcaagcttcattacggatcgttttggtagtaagtattctaagcacggtagcaaggtcaaaaacgcatcaggtgctcaggatgcccatgaggctattcgtccgtcaagtgtctttaatacaccagaaagcatcgctaagtatctggacaaggatcagctcaagctatatacccttatctggaatcgttttgtggctagccagatgacagcggccgtttttgataccatggctgttaaattgtctcaaaaaggggttcaatttgctgccaatggtagtcaggttaagtttgatggttatcttgccatttataatgattctgacaagaataagatgttaccggacatggttgttggagatgtggtcaaacaggtcaatagcaaaccagagcaacatttcacccaaccgcctgcccgttattctgaagcaacactgattaaaaccttagaggaaaatggggttggacgtccatcaacctacgcgccaaccattgaaaccattcagaaacgttattatgttcgcctggcagccaaacgttttgaaccgacagagttgggagaaattgtcaataagctcatcgttgaatatttcccagatatcgtaaacgtgaccttcacagctgaaatggaaggtaaactggatgatgtcgaagttggaaaagagcagtggcgacgggtcattgatgccttttacaaaccattctctaaagaagttgctaaggctgaagaagaaatggaaaaaatccagattaaggatgaaccagctggatttgactgtgaagtgtgtggcagtccaatggtcattaaacttggtcgttttggtaaattctacgcttgtagcaatttcccagattgccgtcatacccaagcaatcgtgaaagagattggtgttgagtgtccaagctgtcatcagggacaaattattgagcgaaaaaccaagcgtaatcgcctattctatggttgcaatcgctatccagaatgtgaatttacctcttgggacaagcctgttggtcgtgactgtccaaaatgtggcaacttcctcatggagaaaaaagtccgtggtggtggcaagcaggttgtttgtagcaaaggcgactacgaggaagaaaagattaaataa

SEQ ID NO: 1877 - DNA, 360 bp, Streptococcus pneumoniae
atgcgtcttatctatctgataattggttttttatcactggccttggctattgttggggttgttttacccttgttgccgacaacgcctttccttttgttgtctattgcttgtttctccagaagttccaagcgtttcgaagactggctttatcataccaagctctatcaaacatatgtagctgattttcgcgagaccaagtctattacgcgtgaacgaaagaaaaaaatcatcgtctctatctacgtcttgatgggaatttctatttattttgcacctcttttaccagtcaaaatcggtttgggtgctttgaccatctttatcacttattatctcttcaaggtcattccagacaaagaatag

SEQ ID NO: 1878 - DNA, 633 bp, Streptococcus pneumoniae
atgatttacgaattttgtgctgaaaatgtgactttacttgaaaaagcgatgcaggctggagctcgtcggattgaactctgtgataatctagcagttggtgggacaacacctagctatggagtgactaaggcagcggttgaactggcagctaactacgatacaaccatcatgaccatgattcggccacgtggtggtgactttgtctataatgacctagaaattgctatcatgctagaagacatttgtttgactgctcaggctggaagtcaaggggttgtatttggagctttaactgctgataaaaagttggataagcctaatctggaaaagttaattgctgcatcaaaaggaatggaaattgtctttcacatggcctttgatgaactaagtgatgaagatcaaccggaagctattgactggctcagtcaagccggtgtcactcgtatcctaactcgtgctggtgtgtctggcgactccttagaaaaacgttttgttcactatcacagaattttggagtacgctaaaggtaaaattgaaattctaccaggtggggggattgaccttgacaaccgtcaaacctttattgaccaggtgggggtaacacaattgcatggtactaaggttgttttttaa

SEQ ID NO: 1879 - DNA, 657 bp, Streptococcus pneumoniae
atgtttgaaatttttaaatcctatcaatttaatcaagaaaaggctcatgattatggttttatagaaaatagcgaagtctggacatatagttgccagattttgcaaggtgactttgtcatgactgtgtccatcactgctgataatgtgaactttcaagtctttgaccaagagactggtgacctctatcctcacgttcatatggaaagcatgaggggaagttttgtcggaaatgtccgtgaggcttgtctggagattctttaccagattcggaaggcttgttttgatgtgcaagattttatctgtcatcagactaagcgtatcatgactcaagttcaggaaaagtatggaaaccagttggagtatctgtgggaaaaatcgcctgatacagctgtattgcgccatgaaggcaatcaaaagtggtatgccgtcttgatgaaaatctcttggaataagctggaaaagggcagagaaggacaagtggaagcagtcaacctcaagcatgaccaagtagctaatttgctttcacaaaaggggatttatccagccttccatatgagcaagcgctactggattagtgtgtcccttgatgatactttatcagatgaagaagtactggaattgatagaaaaaagttggaacttaacctctaaaaaatga

SEQ ID NO: 1880 - DNA, 633 bp, Streptococcus pneumoniae
atgaactttcaattagctaaatattctttactgaagaaatttttagaaaatataggatttaccacactagaggaatatggtgccatcttcaaatacctgattgagaatgtcaagacggatcgtcagatcatctgttcgcctcactgtcatgatgacctcggaatggcagtggcaaatagccttgctgctgtcaagaatggtgcaggacgtgttgaagggactatcaatggtattagggagcgagctgaaaatgctgctttggaagaaattgcagtggctctcaatattcgccaagattactaccaagtagaaaccagtattgtcctaaatgagaccatcaatacgtcagaaatggtttctcgcttctctggtattccagttcctaaaaacaaagccgtcgttggtggcaataccttctcccacgaatctggtattcaccaagatggagtccttaaaaatcctctcacttatgagatcatcacacctgaattggttggtgttaagattccgcttggagaattatctggtcgccatgcttttgttgagaaactgagagaattggccctagattttacagaagaggatatcaaaccactctttgctaagttcaaggcactggccgataagaagtaa

SEQ ID NO: 1881 - DNA, 210 bp, Streptococcus pneumoniae
atggttccagctaccaaagctcgagtatctgcatctgtgatttcttacttcttatcggccagtgccttgaacttagcaaagagtggtttgatatcctcttctgtaaaatctagggccaattctctcagtttctcaacaaaagcatggcgaccagataattctccaagcggaatcttaacaccaaccaattcaggtgtgatgatctcataa

SEQ ID NO: 1882 - DNA, 435 bp, Streptococcus pneumoniae
ttggtagctggaaccatggttgaaaatccagaaggcttccactttgatgatttacaacttcaaactcatgcagataatgacattgaagcgctcgttagcctagccaatatggatggtgagaaagtcgaatttaatgcgacagggcaaggttccgttcaagcaatctttaacgctatcgataagttctttaaccaatctgttcgtttggtgtcctacactatcaatgcggtaacagatggaatcgatgcccaggatcgggttttggtcactgttgaaaacagagatacagaaaccatctttaatgcagcagggcttgattttgatgtgttgaaggcttctgctattgcctatataaacgctaatacctttgttcaaaaagagaatgcaggtgagatgggacgcagtgtttcttaccacgatatgcctagtgtgtaa

SEQ ID NO: 1883 - DNA, 1038 bp, Streptococcus pneumoniae
atggcaaagaaaatagtagctctagtaggagacggaattggcccagaaatcatggaggctggtttagaagttctggaggctctagctgaaaaaacaggttttgactatgagattgacagacgaccgttcggaggtgcagatattgatgcagcaggacctcccttacctgatgaaacccttaaggcaagtagggaagcagatgctatcctactagcagctatcggtagtcctcagtatgatggagcagcggttcgccctgaacaaggcctgatggctctccgtaaggaactcaatctttacgctaatattcgtcctgtaaaaatctttgacagtctcaagtatttgtcaccactcaaaccggaacgaatttctggtgtagactttgtcgtggtgcgtgaattgacaggcgagatttactttggagatcatattcttgaagagcgcaaagcgcgtgatatcaacgactatagctatgaggaagtggagcggattattcgcaaagcctttgaaattgcaagaaatcgcagaaaaatcgttactagtatcgataagcaaaatgttctagcgacctcaaaactctggcggaaagtagctgaggaagtcgcacaggatttcccagatgtaaccttggaacaccagctggtagactcagctgctatgcttatgattaccaatcctgctaagtttgatgttattgtaacggagaatctttttggagatattttatctgatgaatcaagcgtcttatctggtacacttgaggttatgccatcagccagtcattctgaaaatggaccaagtctctatgaacctattcacggttcagcacctgatattgcaggtcaaggaattgccaatcctatttccatgattttattagttgtcatgatgttgagagatagtttcggacgttatgaggatacagagcgtatcaaacgtgctgttgagacaagtctggcggcaggaattttaacgagagatataggaggtcaggcttcaacaaaggaaatgatggaagctattattgcaaggttatga

SEQ ID NO: 1884 - DNA, 270 bp, Streptococcus pneumoniae
atgaagttagacgaaaaaattactctagtccttttgatttggaatgtcatcattttcttgatttatggcattgacaaattcaaggcaagaagaagagcttggcgcatcccagagaaaatcttactcattttagcccttacttgtggtggttttggggcctggttagctggaatcacttttcaccacaagactcgaaaatggtactttaaaacagtttggtttcttgggatggtgaccacactagtagccttatattttatttggaggtaa

SEQ ID NO: 1885 - DNA, 360 bp, Streptococcus pneumoniae
atggtagggtcttcgagggaacacgctgcttgggctctagcggactatggttttaaggtcgtgattgcaggatctttcggtgacattcattacaataatgaactcaataatggcatgttgccaatcgttcagcctagagaggttagagagaaactagcccagctaaaaccaaccgaccaggtaactgtggacttggaacaacaaaaaatcatctcaccagttgaagaattcaccttcgagatagatagcaagtggaaacataaactcctaaatagtttggatgatatcggtattaccttgcagtatgaagagttgattgctgcttatgaaaaacaacgaccagcctactggcaggattag

SEQ ID NO: 1886 - DNA, 237 bp, Streptococcus pneumoniae
aattatgacaaaacacattcacaagaaggctacgacattttaaaaggtgagggcggatgtatcgtttgccctactaaagttggttacattatcatgaccagcaacaaggcaggacttgagcgtaagttcgcagccaaagaacgtaagcgtaacaaaccaggtgttgttctctgcggtagcatggatgaacttcgcgctttagcgcaactcaacccagaaattgaagcattctactaa

SEQ ID NO: 1887 - DNA, 267 bp, Streptococcus pneumoniae
ttggatgaagatattcttcttggttgtatccttccttggaaaccagaagcctttgaaaaactcaaagcatacggggatggccgtgaagaacttatgactgatgtacgtggtactagctgttttgttatcaagtttggaaaagcaggtgaacaattggctgccaagctttgggaagaaggtaaaatggtctacgcctcatatgcttcaatgacaaaacgattgaaactcgctatgagagcaaggtgtaatggtgtctatggtcgataa

SEQ ID NO: 1888 - DNA, 1935 bp, Streptococcus pneumoniae
ttgatgaataaaagaaaagttagtttagaagatttttataaatggtatagtctaaataaagaagagttattaaataaggcaactgttggtgaaaagtttaatgataaattaaaagaagagtttctccaggaatggcctttggataggattttaacaatgtcaatcgatgaatatgtaataggaaagggacagcaaaataagtctttatgctacgctcttgagaagggaaaatacaaaaatctatttcttggaatttctggtggctcagcttcaaaatttggtatttattggaataaaaaaacaaacaaatataaagatcaagctaataatgagatttcagagttggatcagcgattttcaaaattaaaatcagatttgtatgaaattatcaaagaaggtattcgttttaactttgaaaatcctatttttgatatgaaaagatcaacaaatgaatttattggtcgttctgctatggtgacaaaattactttgtatctatactgagggagatcctttctttggtgtaaatattaatagtcagaaagaattttggaaccactttgtttctcagacaaatcaaggtggaccttatctgcaaaatcataaaataattgaactggtgtccaaaacttatcctgagttggagccatcgaaattaggaactatgctttttgagtattctaagctttttatggaaaataaggaagacaatagtacaatggattcatcaaacaattttagtcatcaattaactcaatctctattaaagtctccaaaccttatccttcgtggtgctcctggcacaggaaagacttatcttgctaaagaaattgccaaagaattaacggatggcaacgaagatcaaatcggatttgtacaatttcacccatcatatgattatacggattttgtagaaggtttaagaccagtatcaaatggggatggagctattgagtttaggctacaggacggtatttttaaagatttttgtcagaaagcaaaagaaacccaattgattggaggacaagataattttgatgaggcttgggattcttacttagaatatataaatgttgctgaagaaaaagaatatataacaaaaacatcttacttatctgttaatagtagacaaaatttgtcagtaaattatgatagtggtgttccaggatggtcactacctagcaaatatgtttacgagttgtataaagataaaaattataataagcaagaatactacaaaagtggtggaaaaactgtcctagaaacattgagaaagagatttggtttgaaagactatgtttccccaacagaaattgatactgataagaaattcgttttcatcatcgatgaaatcaatcgtggggagatttctaagatttttggcgaactctttttctctatcgaccctggctatcgtggtgaaaaaggaagtgtttctacccaatatgcaaatctacacgaaactgatgaaaagttctatatccccgaaaatgtttacatcatcggaactatgaatgatattgatcgttcagtggatacctttgattttgctatgcgtcgtcgttttcgttttgttgaagttactgccgagggtcaagttggcatgttggataaagagctgaatatccatgcagaagaagcaaaaattcgtctaagaaacttgaacgctgctatcgaaaatgttcaggaattaaacagtcattatcatattggaccaagttattttcttaagttgaaggatgtagattttgactatgaattactctggtccgattatattaagcctctcctagaagactacttgcgaggttcttatgatgaggttgaaactttggaaactttgaaaaaagcatttgaactgacaaataatgagcaaaaagatcaggcagtagctgatgacaatgaaagcgatgaaaacgatgatgcggattactga

SEQ ID NO: 1889 - DNA, 1344 bp, Streptococcus pneumoniae
atgacaatgaaagcgatgaaaacgatgatgcggattactgataatcaacacaagattattaaagaaaaatttgttgaagaatatcctaaactaagcaatcttcttttagacagaaccttggaaagtctatcccaagatgaacgtattttcatttttccaaatgatttgactcatactccagatttggataaaaaacaaaagattttggaaacgatcaatcaggaaatcaagacaggaaatgtgattggttttcttggatatggtcaggaaagattaacgatttcctcacgattttctgatgagagtaatgaccattttttgcattatctcttaaacaaggttcttcatatcaatctcactagtttagatgttgctttgtctcgtgaagagaggctttatcaacttttgatgtatctcttccccaagtatctacaagctgctattcgaaaaggtctttataaggaatatcatcgattttctcataacgacagtcatgttaagggagtgattgatgtaagaaaccatctcaagaaaaatcttcctttcacgggaaatattgcctacacaacgagagagttcacctatgataatcccctcatgcagttggtccgtcacactattgaatacattaagaatcagaaaagcattggtcaaggggtactagataatctctcaactagtcgtgaaaacgtatctgaaatcgtgcgtgtaacgccctcttataaactagctgatcgtgctaagattattcggggaaatcaatctaaacctatacgtcatgcatactttcacgagtacagaaatttacaagaactttgtctgatgatcctaaaccaagaaaagcacggtttagggtatcaagatcaaaaaatctatggtattctctttgatgttgcctggctttgggaagagtatgtttacaccttgttgccaaaaggttttgtacatcccagaaataaggataagacggatggaatttcagtattttctgttgggaaacgaaaagtatatccagatttttatgacagagaacgaaagattgttctagatgcaaaatataaaaaactggaattgactgaaaaaggaatcaaccgtgaggacttattccagctgatttcctattcttatattttaaaagctgagaaggctggactgatttttcctagtatggagcagtcagtaaatagtgaaataggaaaagtagctggctatggagctcaattgaagaagtggtctattcgaatccctcagaatgcctcatcctatagtgcattttgtaaaatgatggaaaattcagaagaaaattttaaagcgattattgatgaagaagtggggagaaaataa

SEQ ID NO: 1890 - DNA, 987 bp, Streptococcus pneumoniae
atgttaaatgaatttccaatttttgattacgaagatattcaattgattccaaataaatgtgtcattaaaagccgtgcagaagcggatacaagtgtcactttaggaaatcacacctttaaactacctgttgtgccagcgaatatgcagacgattttggatgaaaatgtagcagagcaactggctaaaggtggttacttctacattatgcaccgttttgatgaggcaggacgcattccttttattaaacgcatgcacgatcaagggctcattgcttctatctctgtcggtgttaaggactatgagtatgatttcgttagccagctcaagactgatgctcctgagtatatcactattgatattgctcatggtcatgcggatagcgtgatttctatgattcaacacatcaagaaagaattgccagatacctttgtcattgctggaaatgtgggaacaccagaagctgtgcgtgaattggaaaatgctggtgcggatgctactaaggtcggaatcggtcctggtaaggtttgtatcaccaaggttaagactggttttggtacaggtggttggcagttggctgctctacgctggtgtgccaaggctgcgcgtaaaccgattatcgctgatggaggaattcgtactcacggtgatattgccaagtctatccgcttcggtgctagcatgatcatgattggttccctctttgcaggacacattgaaagtccagggaaaacgattgaagtcgatggtgaacagttcaaagaatattatggttcagcctcacaatatcaaaaaggtgcttacaaaaatgtggaaggcaaacgtatcttgcttcctgctaaaggtcatctgcaagacactttaactgagatggaacaagaccttcaaagtgctatttcttatgcaggtggacgtcaggttgctgaccttaaacacgttgattatgtgatcgtgaaaaactccatctggaatggggatgcttcccactaa

SEQ ID NO: 1891 - DNA, 234 bp, Streptococcus pneumoniae
cctccatcagcgataatcggtttacgcgcagccttggcacaccagcgtagagcagccaactgccaaccacctgtaccaaaaccagtcttaaccttggtgatacaaaccttaccaggaccgattccgaccttagtagcatccgcaccagcattttccaattcacgcacagcttctggtgttcccacatttccagcaatgacaaaggtatctggcaattctttcttgatgtgttga

SEQ ID NO: 1892 - DNA, 201 bp, Streptococcus pneumoniae
ttctttcataccaacctctttctaactgataatagtcctttttattatatcaaaaaaagccccctgagtcactctaaaacgggactggaaagcatttgggaattctttagacagagattctcagttttagcggcaaatttgggtcaggataaagaaaaaagccctattaaaggctttttaggatgtttacatccaccctga

SEQ ID NO: 1893 - DNA, 699 bp, Streptococcus pneumoniae
atgaaagaattacaaactgtactaaagaaccattttgcaatcgaatttacagacaaaaagttactggaaactgcctttactcatacgagttatgccaatgagcaccgcctcttaaaaatttcacacaatgaacgcttggaatttttaggagacgctgttctacagttattgatttcagaatatctgtataaaaaatatcctaaaaagcctgaaggtgacctatcaaaactccgtgctatgattgtccgtgaggagagtttagctggttttgcgcgtgattgccagtttgaccagtttatcaagttgggtaaaggggaagaaaaatctggtggtcgcaatcgtgacaccattcttggtgatgcctttgaagcctttcttggtgcccttcttttggataaggatgtggccaaggtcaaggaatttatctatcaagtcatgattcctaaggttgaagcaggcgagtttgagatgattacagactataaaacccatctccaagagttgcttcaggtcaatggtgatgtggctattcgttatcaggtgatttctgaaacagggcctgctcacgataaggtctttgatgtagaagttcttgttgaaggtaagagcatcggtcaaggccaaggtcgttctaagaaattagcagagcaggaagctgccaaaaatgccgttgagaaagggctggattcatgtatttaa

SEQ ID NO: 1894 - DNA, 2211 bp, Streptococcus pneumoniae
atgtatttaaaggaaatcgaaattcaggggttcaagtcttttgctgataagaccaaggtcgtttttgaccaaggtgtgacggcagttgttggacccaatggatctggaaagtccaatattacagaaagtctgcgttgggctttgggggagtctagtgtcaagagtctccgtgggggcaagatgccggatgtcatctttgctggaacagaaagtcgcaaaccgctcaattatgcttctgtagttgtgactctggataatcatgacggatttatcaaggatgcaggtcaagaaatcagggtggaacgccatatctatcgtagtggagatagcgaatacaagattgacggcaagaaagtccgtctgcgtgatattcatgacctcttcttggatactggattgggacgagattccttctctattatttcccaagggaaggttgaggagatttttaattccaagcctgaggaacgacgagctatttttgaagaagctgctggagttttaaaatacaagactcgcagaaaagaaaccgagagtaaactgcagcaaactcaggataatctggaccgcttagaggacattatctacgagttggataatcaaatcaagcctcttgagaagcaagctgagaatgcccgtaagtttttagacttggaaggacaacgtaaggctatttatttagacgttctggttgctcaaatcaaggaaaataaggcagaactagagtcgacagaagaagagttggctcaggttcaagaactcttgatgagttattaccaaaagcgtgaaaaattagaagaagaaaatcaaactcttaaaaagcaacgccaagatttacaggctgaaatggccaaagaccaaggcagtttgatggacttgactagtctgattagtgatttagaaagaaaattagccctatcgaaactggagtccgagcaagtggccctgaatcaacaggaggcacaagctcgtttggctgctttggaggataagagaaattcactcagcaaagaaaagtatgataaagaaagctctttagctctgttagagggaaatctagtccaaaataatcaaaaactcaatcgtttagaagctgaattgctggctttctcagacgatcctgatcagatgattgagctcttacgtgaacgctttgtagctcttttacaagaagaagcggatgtctcaaaccagttgacccgtattgagaatgagttggaaaatagtcgtcagctttctcaaaaacaagcagatcaactagaaaagctgaaagagcaattagctacagctaaagagaaggctagtcagcaaaaagacgagcttgaaactgccaaggtgcaggttcagaaattattggctgactatcaagctattgccaaggagcaagaggagcagaaaacttcctatcaagctcaacaaagtcaactctttgaccgtctggatagtctcaaaaacaagcaggccagagctcaaagtttggaaaatatcctgagaaatcatagtaacttttatgcaggtgttaagagtgttctccaagaaaaagatcgcctaggtgggattattggtgcagtcagtgagcatctgacctttgatgtttattatcaaactgccctagagattgccttaggggcaagtagccagcatatcatcgtagaagatgaagagtcggcaaccaaagctattgatttcctcaaacgaaacagagtcggtcgtgcaacctttcttcctttgaccactattaaggcgcgtacgatttctagtcagaaccaagatgctatcgctgtaagcccaggtttccttgggatggcagatgagttggtgacttttgatactagactggaagccattttcaagaacttgctagctacgacggctatctttgataccgtagaacatgcgcgtgaagctgctcgacaagttcgttatcaggttcgtatggtgacattggatgggacagaattacgcacgggtggttcctatgcgggtggtgccaatcgccaaaataacagtattttcatcaagccagaactggagcaattacaaaaagaaattgctgcagatgaagcaagcttgggttcagaagaagcggctttgaagaccttgcaagaccagatggctgcattgacagaaagattagaagccatcaaactctcaaggagagcaggcacgtattcaggagcaaggcttgtccctcgcttatcagcaaactag

SEQ ID NO: 1895 - DNA, 651 bp, Streptococcus pneumoniae
ttgtccctcgcttatcagcaaactagtcagcaagttgaagaactggaaactctttggaaactccaagaagaggaaatagatcgtctttctgagggagattggcaagcggataaggaaaaatgtcaagagagccttgctactatcgccagtgacaagcaaaatctggaagctgagattgaagaaattaagtctaataaaaacgccatccaagaacgctatcaaaatttgcaggaagaggtggcgcaagctcgcttgcttaagacaaaactgcaagggcaaaaacgttatgaagtagctgatattgagcgtttaggcaaggaattggacaatcttaatatcgaacaagaagaaattcagcgcatgctccaagaaaaagttgacaatcttgagaaggttgatacagaattgctcagtcaacaggcggaagaatccaaaactcagaaaacaaatctccaacaaggtttgattcgcaagcagtttgagttggatgatatagaaggtcaactggatgatattgccagtcacttggatcaagctcgccagcagaatgaggagtggattcgcaagcaaacacgtgctgaagccaagaaagaaaaggtcagcgagcgtgcgccatctacaaaatcaattaacagaccagtaccagattag

SEQ ID NO: 1896 - DNA, 306 bp, Streptococcus pneumoniae
atgatattgccagtcacttggatcaagctcgccagcagaatgaggagtggattcgcaagcaaacacgtgctgaagccaagaaagaaaaggtcagcgagcgtgcgccatctacaaaatcaattaacagaccagtaccagattagctatactgaagcactagaaaaggcacatgaattggaaaacctcaatctggcagagcaagaggtgcaggatttagagaaggctattcgctcattgggacctgtcaacttggaagctattgaccagtacgaagaagttcacaaccggtctggactttctaaatag

SEQ ID NO: 1897 - DNA, 588 bp, Streptococcus pneumoniae
ttgaccagtacgaagaagttcacaaccggtctggactttctaaatagtcagcgagatgatattttgtcagcgaaaaatctgctccttgaaaccattacagagatgaatgatgaggtcaaggaacgctttaaatcaacctttgaagctattcgtgagtcctttaaagtgaccttcaagcagatgtttggcggaggtcaggcagacttgatattgactgagggcgaccttttaacagctggtgtggagatttctgttcaacctccaggtaagaaaatccagtcgcttaacctcatgagtggtggtgaaaaagctctatcggctcttgccttgcttttctccattattcgtgtcaagaccattccttttgtcatcttggatgaggtggaagctgcgctggatgaagccaatgttaaacgttttggggattacctcaaccgctttgacaaggacagccagtttatcgtcgtaacccaccgtaagggaaccatggcagcggctgattccatctatggagtgaccatgcaagaatcaggtgtctcaaaaattgtttcggttaagttaaaagatttagaaagtattgaaggatga

SEQ ID NO: 1898 - DNA, 795 bp, Streptococcus pneumoniae
atgacaattaaactagtagcaacggatatggacggaaccttcctagatgggaatggacgctttgatatggatcgtctcaagtctctattggcttcctacaaggaaaaagggatttactttgcggtggcttcgggtcggggatttctgtctctggaaaaattatttgctggtgttcgtgatgacattattttcatcgcggaaaatggcagtttggtagagtatcaaggtcaggacttgtatgaagcgactatgtctcgtgacttttatctggcaacttttgaaaagctgaaaacgtcaccttatgtagatatcaataaactgctcttgacgggtaagaagggttcatatgttctagatacggttgatgagacctatttgaaagtgagtcagcattataatgaaaatatccaaaaagtagcgagtttggaagatatcacagatgacattttcaaatttacaaccaacttcacagaagaaacgctggaagctggggaagcttgggtcaatgataatgtccctggtgttaaggccatgacaactggctttgaatctattgatattgttctggactatgtcgataagggagtggccattgttgaattagttaaaaaacttggtatcacaatggatcaggtcatggcttttggagacaatcttaatgacttacatatgatgcaggttgtgggacatcctgtagctcctgaaaatgcacgacctgaaattttagaattagcaaagactgtgattggtcaccataaggaccagtcggttatagcttgtatggagggcttataa

SEQ ID NO: 1899 - DNA, 819 bp, Streptococcus pneumoniae
atggcagatataaaattgattgcattggacttggacgggaccttgctgactactgataaaaggctgacggatcgtaccaaggaaaccttgaaagctgcgcgtgatcgtggtatcaaggtcgtattgacaactggtcgtcccttaaaagctatggatttctttctccatgagctagggactgacggtcaggaagaagagtataccattacttttaatggtggtttggttcagaaaaatacaggtgaaatccttgataagacagtcttttcatatgatgatgtggcacgcttgtatgaagaaacagagaaattatcactgcctcttgacgctatctcagaaggaactgtttatcaaattcaatcggaccaagaaagtctttatgccaaattcaatccagctttgacttttgttccagttgattttgaagacctgtctaatcaaatgacctacaacaaatgcgtgaccgcctttgctcaagaacccttggatgcagccattcagaagatttctccagaattgtttgaccaatatgaaatctttaaatcacgtgaaatgttgctagaatggtcaccaaagaatgttcataaagcaacaggtttggcaaaactaattagccatcttggaattgatcaaagtcaagtgatggcctgtggtgacgaggccaatgacctctctatgattgaatgggcagggctcggtgttgccatgcaaaacgctgttcctgaagtcaaggcagtcgcaaatgtggtaactcctatgaccaatgatgaagaagctgtcgcctgggctatcgaagaatatgtgctaaaggagaactaa

SEQ ID NO: 1900 - DNA, 1290 bp, Streptococcus pneumoniae
atgggattatttgaccgtctattcggaaaaaaagaagaacctaaaatcgaagaagttgtaaaagaagctctggaaaatcttgatttgtctgaagatattgagcctgccttcacagaagctgaggaagtttctcaagaagaagcagaggttgaaagttctgaagaatctgtgttccaagaagaggatagtcaagacacagtcgaagaaaatctggatttagagccagttgtagaggtttctcaagaagaagtagaagaatttccaaactcacaagaagtcacagaggaagagaagcttgagcacgaaggaactgtagaagaaaataattttgaagtgcttgaaccagaagctcctcaaacagaagaaactgttcaggaaaaatatgaccgcagtcttaagaaaactcgcacaggtttcggtgcccgcttgaatgccttctttgctaacttccgctctgttgacgaagaatttttcgaggaactggaagaactgttgattatgagtgatgttggtgtccaagtcgcttctaacttaacggaggaactacgttacgaagccaagcttgaaaatgccaagaaacctgatgcacttcgtcgtgtcatcattgagaaattggttgagctttatgaaaaggatggtagctacgatgaaagcatccacttccaagataacttgacagttatgctctttgttggtgtgaatggtgttgggaaaacaacttctatcggaaaactagcccaccgctacaaacgagctggtaagaaggtcatgctggttgcagcagataccttccgtgcgggtgcagtagctcagctagctgaatggggccgacgagtagatgttccagtagtaactggacctgaaaaagctgatccagccagcgtggtctttgatggtatggaacgtgccgtggctgaaggtatcgatattctcatgattgatactgctggtcgtctgcaaaataaggataaccttatggctgagttggaaaagattggtcgtattatcaaacgtgttgtgccagaagcaccacatgaaaccttcttggcacttgatgcatcaacaggtcaaaatgccctagtacaggccaaagaattttcgaaaatcacacctttaacgggaattgttttgactaagattgatggaactgctcgaggaggtgtggttctagccattcgtgaagaactcaatattcctgtaaaattgattggttttggtgaaaaaatcgatgatattggagagtttaactcagaaaacttcatgaaaggtctcttggaaggtttaatctaa

SEQ ID NO: 1901 - DNA, 1257 bp, Streptococcus pneumoniae; identical to SEQ ID NO: 293

SEQ ID NO: 1902 - DNA, 255 bp, Streptococcus pneumoniae
gctcaggctgaaacagtctcccagactgtttcactcccgaatgctaaaatcgttcttgatcgctttcacattgtacaacatcttagccgtgctatgagtcgtgtgcgtgtccaaatcatgaatcagtttcatcgaaaatcccatgaatacaaggctatcaagcgctactggaaactcattcaacaggatagccgtaaactgagtgataaacgtttttatcgtcctacttttcgtatgcacttaaccaataaatag

SEQ ID NO: 1903 - DNA, 327 bp, Streptococcus pneumoniae
aacagtccggggagtgactgtttcaatcgggagatggagatgagcttcattgcgcaagattttaacaatctcaatatcatcactgttcttgagggaagaacacaagctatcattcgaaatcactttcttcgctacgatagagctgtccgatgtcgcgtcaaaattattactatggatatgtttagcccttactatgacttggctaaacagcttcgctttcaaatttctaggctcaggctgaaacagtctcccagactgtttcactcccgaatgctaaaatcgttcttgatcgctttcacattgtacaacatcttagccgtgctatga

SEQ ID NO: 1904 - DNA, 519 bp, Streptococcus pneumoniae
atggaacaattacattttatcacaaaattactagacattaaagaccctaatatccagattttagacatcatcaataaggatacacacaaggaaatcatcgccaaactggactatgaagctccatcttgtcctgagtgcggaagtcaaatgaagaaatatgactttcaaaaaccttctaaaattccttatcttgaaacgattggtatgccttctagaattctccttagaaaacgccgtttcaagtgctatcactgttcaaaaatgatggttgctgagactcccctggtaaagaaaaatcaccaaatccctcgtatcatcaaccaaaaaattgctcaaaagttaattgaaaagatttctatgactgatattgcccatcagctttccatctcaacttcaactgtcattcgcaagctcaatgattctcactttgagcatgatttttcgcgtcttcctgagattatgtcctgggacgttgaaacagtccggggagtgactgtttcaatcgggagatggagatga

SEQ ID NO: 1905 - DNA, 1488 bp, Streptococcus pneumoniae
atgtcatctaaggttattgttacaattttcggtgcgagtggagacctggctaaacgcaagctctacccttccctttttagactatatcaatccggcaatctttccaagcactttgccgttattggaactgcccgtagaccttggagtaaggaatattttgaatctgtagttgtcgagtccatccttgatttggcagatagtaccgagcaagcccaagaatttgctagccacttctactatcaaagccatgatgtcaatgattcggaacattatattgctttgcgtcaattacaagctgagcttaatgaaaaataccaagctgaacacaataagctcttcttcttgtctatggcacctcagttctttggaaccattgccaaacacctcaaatctgaaaacattgtcgatggcaaaggttttgagcgcttgatcgttgaaaaaccatttggtacagattacgcaactgcaaacaagttgaatgacgaactcctagcaacatttgacgaagaacaaattttccgtatcgaccattatcttggtaaggaaatgatccaaagcatctttgcagttcgctttgcaaacttgatttttgaaaacgtttggaacaaggattttatcgacaatgttcaaattacctttgcggagcgcttgggtgtagaagaacgtggtggctactatgaccaatccggtgccctccgtgacatggtccaaaaccacactctacaacttctttcgctcctcgccatggacaaaccagcaagcttcacaaaagacgagattcgtgctgaaaagattaaggtctttaaaaacctctatcatccaactgatgaagaactcaaagaacactttatccgtgggcaataccgctctggtaagattgatggcatgaaatacatctcttatcgtagcgagccaaatgtgaatccagaatcaacaactgaaacctttacatctggtgccttctttgtagacagcgatcgattccgtggtgttcctttctttttccgtacaggtaaacgactgactgaaaaaggaactcatgtcaacatcgtttttaaacaaatggattctatctttggagaaccacttgctccaaatattttgaccatctatattcaaccaacagaaggcttctctcttagcctaaatgggaagcaagtaggagaagaatttaacttggctcctaactcacttgattaccgtacagatgcgactgcaactggtgcttctccagaaccatacgagaaattgatttatgatgtcctaaataacaactcaactaactttagccactgggatgaagttggtgcatcatggaagttgattgaccgtattgaagagctctgggctgaaaatggtgccccacttcatgactataaagctggaagcatgggacctcaagccagctttgacctacttgaaaaattcggtgccaaatggacttggcaaccagatatcgcctatcgtcaagatggtcgtttcgaataa

SEQ ID NO: 1906 - DNA, 741 bp, Streptococcus pneumoniae
atggcaaaattaaaaattgatgtaaatgatttacacaagcactatggaaaaaatgaagtcctaaaaggaattacgactaagttctatgaaggagatgttgtttgtatcatcggtccttcaggttctggtaagtcaactttcctccgtagcctcaatcttttagaagaagtcactagcggtcacatcactgtgaacggctatgatttaactgaaaaaacaaccaatgttgaccacgtccgtgaaaatatcggcatggtattccaacacttcaacctcttccctcatatgtctgtattggacaacatcacctttgctcctattgagcacaagttgatgactaaggaagaagctgagaaattgggaatggagttgcttgaaaaggttggactagcagataaagctaatgccaatccagatagcctatcaggtggtcaaaaacaacgtgtggccatagctcgtggcctagcaatgaatccagacatcatgctcttcgatgaaccaacttctgcccttgaccctgagatggttggagacgtacttaacgttatgaaggaattggctgagcaaggcatgaccatgattatcgtaacccatgagatgggatttgctcgtcaggttgccaaccgcgttatctttactgcagatggcgagttccttgaagacggaacacctgaccaaatctttgataacccacaacaccctcgtctgaaagagttcttagataaggtcttaaacgtctaa

SEQ ID NO: 1907 - DNA, 1479 bp, Streptococcus pneumoniae
atgaaaaaagatggtagtcttgataaaattatcaagaaatggactgcttcatcatcttcagcagtgccaactacaactactctcgcaggattaaaagctattcctgttaaggctaaatatatcattgccagcgattcttcttttgcaccttttgttttccaaaattcaagcaaccaatacactggtattgatatggaattgattaaggcaatcgctaaagaccaaggttttgaaattgaaatcaccaaccctggttttgatgctgctatcagtgctgtccaagctggtcaagccgatggtatcatcgctggtatgtctgtcacagatgctcgtaaggcaacttttgacttctcagaatcatactacactgctaataccattcttggtgtcaaagaatcaagcaatattgcttcttatgaagatctaaaaggaaagacagtcggtgttaaaaacggaactgcttctcaaaccttcctaacagaaaatcaaagcaaatacggctacaaaatcaaaacctttgctgatggttcttcaatgtatgacagtttaaacactggtgccattgatgccgttatggatgatgaacctgttctcaaatattctatcagccaaggtcaaaaattgaaaactccaatctctggaactccaatcggtgaaacagcctttgccgttaaaaaaggagcaaatccagaactgattgaaatgttcaacaacggacttgcaaaccttaaagcaaacggtgaattccaaaagattcttgacaaatacctagctagcgaatcttcaactgcttcaacaagtactgttgacgaaacaacgctctggggcttgcttcaaaacaactacaaacaactccttagcggtcttggtatcactcttgctctagctcttatctcatttgctattgccattgtcatcggaattatcttcggtatgtttagcgttagcccatacaaatctcttcgcgtcatctctgagattttcgttgacgttattcgtggtattccattgatgattcttgcagccttcatcttctggggaattccaaacttcatcgagtctatcacaggccaacaaagcccaattaacgactttgtagctggaaccattgccctctcactcaatgcggctgcttatatcgctgaaatcgttcgtggtggtattcaggccgttccagttggccaaatggaagccagccgaagcttgggtatctcttatggaaaaaccatgcgtaagattatcttgccacaagcaactaaattgatgttgccaaactttgtcaaccaattcgttatcgctcttaaagatacaactatcgtatctgctatcggtttggttgaactcttccaaactggtaagattatcattgctcgtaactaccaaagtttcaagatgtatgcaatccttgctatcttctatcttgtaattatcacacttttgactagactagcgaaacgcttagaaaagaggattcgttaa

SEQ ID NO: 1908 - DNA, 711 bp, Streptococcus pneumoniae
atgaagaataaaagaatatttaaagacttccaagcttcaaaaatgaatttaaacatttacacaagccccttgttagcctttgtttttgtcttcataggagagtttgtggcttatactttatatggtattagtttgttagctctcatcggacttgctagaaattttggagaggctggtcaaaatcttgcaagctacttgcagaccttgcatcagagcttgacggataaaacaagtgactttcgtttaattttaggattactggcctttggttttattcttaacactgtgttcagatggacaagaaaagttgagaaaagacctattcgaaccttgggattttatatagagaatttcctcagcaatcttctgaaaggatttagtctaggcctggcactttttcttctgaccttgttaggtttagtggtcttaggtcaatatcgtttggaatccattcacttgaatccttattctcttgcctttgtcgtctttactatcccattttggattttacaggggacagcagaagaagtggtggcccgtgcttggctacttcctcaattggcctcaagaaccaatctaaaactagctattcttatatctagcctgttctttaccctgcttcatatgggcaattctggcctcacccctctatctctagtaaatctctttttattcggagtctgccatggctctttaccttctcaaaactga

SEQ ID NO: 1909 - DNA, 270 bp, Streptococcus pneumoniae
atggctctttaccttctcaaaactgatacagtttggggtgttgcaggtattcatggtgcttggaattttgctcagggtaatctctttgggattttagttagtggtcaaccgtcaggaacgtctctgatgacctttttaccacaaggcaatcaagattggctatcaggtggttcttttggcatagaaggttccattatgacaagtctggtattactactgctgattgtctatcttgctaataaattaaagaaagaaaatgaaaggatgtga

SEQ ID NO: 1910 - DNA, 1989 bp, Streptococcus pneumoniae
atgatcaatcacattacagataatcaatttaaactagtatcaaaatatcaaccatcaggagatcaaccccaagctatcgagcagttggtggataacattgaggggggagaaaaagctcagattctgatgggggcgactggaacagggaagacctatactatgagtcaggtcatttctaaagtcaataaaccaactctggttattgcccacaataaaactctggctggtcagctctatggggagtttaaggaatttttccctgaaaatgcagttgagtatttcgtatcctactatgattattaccagccagaggcctatgtcccttctagcgatacctatattgagaaggatagttctgtcaatgacgagattgacaagcttcgccactcagctacctcagcccttttggagcgtaatgatgttattgtcgtggcctcagtctcttgtatctatggtttgggttcgcccaaggaatacgctgatagtgtcgttagtctccgtcctggtctagagatttctcgtgataaactcttgaatgacttggtcgatattcagtttgaacgcaatgatattgatttccaacgcggaagatttcgcgttcgtggggatgtggtagagattttcccagcttcccgagatgaacatgcctttcgagtagaattttttggagacgaaattgaccgtattcgtgaagttgaggctctgacaggtcaggtgttgggagaagtggatcatttagcgattttcccagcgacacactttgtgaccaatgacgaccacatggaagttgccattgcaaagattcaggccgagttggaagaacaattagctgtctttgaaaaggaaggtaaactgcttgaagcccagcgtttgaaacagcggacagagtatgatatcgaaatgttgcgtgagatgggctataccaatggggttgaaaattattctcgccacatggatggacggagcgaaggagagcctccttatacgcttctcgacttcttcccagatgatttcttgattatgattgacgagagtcatatgaccatagggcaaatcaagggcatgtacaatggagaccgttcgcgtaaagaaatgctggttaattatggtttccgtttgccgtctgctttggacaatcgtcctctacgtcgggaggagtttgagagtcacgttcatcagattgtttacgtttcagcgacacctggtgactatgaaaatgaacagaccgagacagtgattgagcaaatcattcgtccaacgggactcttggatccagaggtggaagtccgtccgactatgggacagattgatgacctcttgggtgaaatcaatgcccgcgttgaaaaaaatgagcgtacctttatcacaactttgaccaagaaaatggcagaggacttgaccgactacttcaaggaaatgggtatcaaggtcaagtacatgcactcggatatcaagaccttggaacggacggagattatccgtgacctgcgcttgggtgtctttgatgtcttggtcggaattaacctgctccgtgaaggaattgacgttcctgaagtgagcctcgtagctattctcgatgctgacaaggaaggtttccttcgcaacgaacgtggactcatccagactattggacgtgctgctcgtaacagtgaaggccatgtcatcatgtatgcagacacggttacccagtctatgcaacgtgctatcgatgaaactgcccgccgtcggaaaattcagatggcctataatgaagagcatggtatcgtaccacagacaatcaagaaagaaatccgtgacctgattgccgtgaccaaggcagttgctaaggaagaggacaaggaagtcgacatcaatagcctcaacaaacaagagcgcaaagaactcgtcaagaaactagaaaaacaaatgcaagaagccgtcgaagtgcttgactttgaactggcggctcagatccgtgatatgatgttggaagtcaaggccttggattag

SEQ ID NO: 1911 - DNA, 564 bp, Streptococcus pneumoniae
atgatttatttaagaaagttaaagagagaagatttgatgtctttatgggaaatggcttattcacaacttaatccagtttggaaacagtatgatgctccctattatgatgattatcagtatttttcaaattttaaagaattcgaactacaaaaatcagaatccattttaagcaactcaaatcgccttggtatttttgttgatgataaactagttgggactgtttcgcgttattgggtatgtaaacaaacaagatggatggaattgggaattggtatttatgataaaaaattctggaacactggtattgggaaagttgctatgttgcagtggatagataggacgtttcaggattacttggagttggagcatctgggtttgacaacttggtcaggaaatcttggtatgatgaaacttgctgaaaaattaagaatgaaaaaagaagctcatattccaaaagttcgttattatcaaggtaaatattttgatagtattaaatatggtattttgagagaagactgggagaaaatgaatgacggttattatcaaatcaatggaaactcctga

SEQ ID NO: 1912 - DNA, 390 bp, Streptococcus pneumoniae
atgacattagaaagatgtcgattctttagtcaaaagtatccagaaaatacattgattgcgataggtgatctgaaggtagttggttttatcagttatggtaactttcgtgatgagactattcaagctggtgaaattattgctttatatgttttaaaagactattacggaaaaggcatagcacaaaagttaatgaaagcagctttgactgctctgaatcatttttctgaaattttcttatgggtattgaaagataacaagcgagccattgctttctatcaaaaaatgggttttacttttgatggacaagaaaagatacttgaacttggaaagcctataaaggaaaaacgaatggtattctattctaaaataattttaaaaagtagaagctaa

SEQ ID NO: 1913 - DNA, 468 bp, Streptococcus pneumoniae
atgtcccgttcccaattaacgattttaacaaatatttgtctgattgaagaccttgaaactcagtgcgtggttatgcagtaccgtgctcctgaaaccaatcgctggtctggttatgcctttcctggaggtcatgtagaaaatggtgaggcttttgcggagtctgtcattcgtgaaatttacgaagaaacaggattgactatccaaaatccgcaactggtaggtgttaaaaattggcctttggatacaggggggcgctacattgtcttttgttacaaggcgaccgagtttactggaactcttcaatcttcagacgagggagaagtttcttgggtgcaaaaagaccagattccaaacttgaatctggcctatgatatgctaccattgatggaaatgatggaagctcccgacaagtcagagtttttctaccctcgccgtacagaagacgattgggaaaagaaaatcttctag

SEQ ID NO: 1914 - DNA, 516 bp, Streptococcus pneumoniae
atgacaaaagatcgcaaacaagccctgctccaactcttgaaagaagctcctaaagcccttaatggccaaagtttggcggaacattttcatgtcacacgtcaggtcattgtgcaggacattgcaattttgagagccgatggcgctcctatcctatccaccaatcgtggctacatctataagcaaattgataccaatccttatgttcacaaacttttcaaagtgaaacatgaagttgaagaaatcggtcaggaactccttgctattgtcgataatggtgggcatgtccagaataccttgattgaccatcccgtttatggagaaattgaaaccttgcttaaactgtcttgtcgcagagatgtgcaacattttctagaacaagtcgagcattctgactttagacctctatctgaattgacagatggcatccattaccacctagtcgaagccgaaacacaacaagacctccactatatcgaggaagccttggatcagctaggttatttagtaaaagactag

SEQ ID NO: 1915 - DNA, 582 bp, Streptococcus pneumoniae
ttgtctggtttattgtaccatactagtgtatatgcagttaaaaaggagattcttgtgaatacacggaaaaagacacaatttatgacaatgacagcccttttaacggctattgcgattttgattccaattgttatgcctttcaagattgtcattccacctgcttcctatactttggggagccacatcgctatttttatagccatgttcttgtcgcccttgatggcagtttttgtcatcctagcctctagttttggatttttgatggctggctatcccatggttatcgtttttcgggctttttcccatatatcttttggtgctttaggagctctttacctacaaaaattccccgataccctagataaaccaaaatcttcctgggttttcaattttgttttggctgttgttcatgcccttgctgaagtattagcctgtgtccttttttacgcaacttcgggtaccaatgtagaaaatatgttctatgttctatttgtactagttggatttggcacaattatccatagtatggtagactatacattagcactagctgtctataaagtgcttcgaaaacgccgttaa

SEQ ID NO: 1916 - DNA, 501 bp, Streptococcus pneumoniae
atgaaaaaacgctctaatattgcacccattgctatcttttttgctaccatgctcgtgatacactttctgagctcagttatctttaacctttttccatttccaatcaaaccgaccattgttcatattcctgtcattattgccagcattatttatggtccacgagttggggttacacttggatttttgatggggctacttagcttgacggttaacacgattacgattctaccgacaagctacctcttctctcccttcgtaccaaacggaaacatctactcagctatcattgccatcgtcccacgtattttgattggtttaactccttacttagtctataaactgatgaaaaacaagactggtctgattttagctggagcccttggttccttgacaaatactatctttgtccttggaggaatcttcttcctatttggaaatgtttataatggaaatatccaacttcttctggctaaccgttatctcaacaaattcaattgctga

SEQ ID NO: 1917 - DNA, 552 bp, Streptococcus pneumoniae
atggcaaacattctcttggctgtaacgggttcaatcgcctcttataagtcggcagatttagtcagttctctaaaaaaacaaggccatcaagtcactgtcttaatgactcaggctgctacagagtttatccaacctttgacactacaggtactctcacagaatcctgtccacttggatgtcatgaaagaaccctatcctgatcaggtcaatcatatcgaacttggaaaaaaagcagatttatttatcgtggtacctgcaactgctaacactattgcaaaactagctcacggatttgcggacaacatggtaaccagtacagctctagccctaccaagtcatattcccaaactaatagctcctgctatgaatacaaaaatgtatgaccatccagtaactcagaataatctgaaaacattagaaacctacggctatcagctgattgctcctaaggaatccctactagcttgtggagaccacggacgaggagctttagctgacctcacaattattttagaaagaataaaggaaactctcgatgaaaaaacgctctaa

SEQ ID NO: 1918 - DNA, 759 bp, Streptococcus pneumoniae
atcttcgtttttaccaaaaatttatcactttcattttacttaccgcttatttttgtgtacaatagtgctatgaaaattttagttacatcgggcggtaccagtgaagctatcgatagcgtccgctctatcactaaccattctacaggtcacttggggaaaattatcacagagactttgctttctgcagggcatgaagtttgtttaattacgacaaaacgagctctgaagccagagcctcatcctaacctaagtattcgagaaattaccaataccaaggaccttctaatagaaatgcaagaacgtgttcaggattatcaggtcttgatccactcaatggctgtttctgactacactcctgtttatatgacagggcttgaggaagttcaggctagctccaatctaaaagaatttttaagcaagcagaatcatcaggccaagatttcttcaactgatgaggttcaggttttgttccttaaaaagacacccaaaatcatatccctagtcaaggaatggaatcctactattcatctgattggtttcaaactgctggttgatgttaccgaagatcatctggttgacattgcacgaaaaagtcttatcaagaatcaagcagatttaatcatcgcgaatgacctgactcaaatttcagcaaatcagcaccgagctatatttgttgagaaaaatcagcttcaaacagtccagactaaagaagaaattgcagaactcctccttgaaaaaattcaagcctatcattcttag

SEQ ID NO: 1919 - DNA, 543 bp, Streptococcus pneumoniae
atggcggagcgcacggtcgttcaagtccacaacgcgtttccagaggatacgacgttgatcaattcccagctcattcccttggtgcaagtggttgtcaatcaaggcagaaagggcattgttggcagttgtaatagcatgcatatctccagtaaagtggaggttgatgtcttccattggcagaacttgtgcatacccaccaccagcagcaccacccttgatccccatgactggaccaagagacggttcgcggatagcaatcatggttttcttgccaatcttgttcaaggcatccgcaagaccaatggtaagcgtcgactttccttcacctgcaggtgttgggttgatggcagtaaccaagatcaatttaccgactggattgctctcaactgcccgaattttatcaaagctgagtttagccttgtactttccgtacaactccaaatcgtcgtaagaaataccaagtttctctacaacatcaacaattggcttcaactcaatactctgtgcgatttcaatatctgttttcattcaaaattcctctaa

SEQ ID NO: 1920 - DNA, 1671 bp, Streptococcus pneumoniae
atgaaaacagatattgaaatcgcacagagtattgagttgaagccaattgttgatgttgtagagaaacttggtatttcttacgacgatttggagttgtacggaaagtacaaggctaaactcagctttgataaaattcgggcagttgagagcaatccagtcggtaaattgatcttggttactgccatcaacccaacacctgcaggtgaaggaaagtcgacgcttaccattggtcttgcggatgccttgaacaagattggcaagaaaaccatgattgctatccgcgaaccgtctcttggtccagtcatggggatcaagggtggtgctgctggtggtgggtatgcacaagttctgccaatggaagacatcaacctccactttactggagatatgcatgctattacaactgccaacaatgccctttctgccttgattgacaaccacttgcaccaagggaatgagctgggaattgatcaacgtcgtatcctctggaaacgcgttgtggacttgaacgaccgtgcgctccgccatgtgactgttggtcttggtggtcctctaaacggtattccacgtgaggatggttttgatattacagttgcttcagaaatcatggcaattctttgcttggcaacggacatcgaggacttgaaacgtcgtttggcgaatatcgttattggttatcgctatgaccgtacgcctgtttctgtaggtgatttgcaggttgagggtgccttggctttgattttgaaggatgctattaagccaaacttggttcagacaatttacggtacacctgcctttgtacacggtggtccatttgccaatatcgctcatggctgtaactctgttttggcgacgacaacagcccttcacttggctgattacactgttactgaagctggttttggtgcggaccttggtgctgagaaattccttgatatcaagacaccaaacttgccaacatctccagatgcagttgttattgtcgcaacccttcgtgcccttaagatgaatggtggtgtggctaaagacgctctgactgaagaaaatgtagaggcagttcgtgcaggttttgctaacttgaaacgccacgttgaaaatatccgtaagttcggtattccagcagttgtagctattaacgaatttgtatctgatacagaagctgaaattgcagtcttaaaagaactctgtgcctcaatcgatgtaccagttgaattggctagtgtctgggctgatggagcagaaggtggagtagcacttgccgaaacagttgttaagacaattgctgaaaatccagctaactataaacgtttgtacgataatgacctttctgtccaagaaaagattgaaaaaattgtcactgaaatctatcgtggtagcaaagtgaactttgagaagaaatctcaaacacaaattgctcaaatcgttcaaaacggttgggacaaattgccaatctgtatggctaaaactcaatacagtttctcagacaatccaaatgcgcttggagcaccagaaaactttgaaattaccattcgtgaattggtaccaaaattaggtgcaggcttcatcgttgccttaactggtgatgttatgaccatgccaggtcttccaaaacgtccagcagctctcaacatggatgttgaaagcgatggaactgtactaggcttgttctag

SEQ ID NO: 1921 - DNA, 240 bp, Streptococcus pneumoniae
ttgaaattgactttaagtgagtttggaaataatatccaagctcattttttctcagactgcaagcagttcatcaataagatttatactcttcgaaaatctcttcaaactacgtcagcttcaccttgccgtaggtatatgatactgactctgtcagttctatccacaacctcaaaacagtgttttgagcaacctgcggctagcttcctagtttgctctttgattttcattgagtataagtag

SEQ ID NO: 1922 - DNA, 1176 bp, Streptococcus pneumoniae
atgttagatttgaaagaatacggtatcgtcatgtggccggaggagaaagtcatttctttccgtgagaaacttctcgcttggtatgatgaaaacaaaagagatttgccttggaggagaagtaaaaatccttatcacatctgggtatctgaaatcatgcttcagcagaccagggtggatacagttatcccttactacgaaagattcctggactggtttccaactgtcgaaagtctggcaactgcgcctgaggagagtttactgaaagcttgggagggcttgggctattattctcgagttcgcaatatgcaggctgcagcccagcagattatgactgactttggtggccaatttccaaatacctatgaaggaatttccagcttgaaagggattggaccttacacagcaggagccatttccagtattgcttttaacttgcctgagccagctgtagatggtaatgtcatgcgggtcttggcgcgtctgtttgaagtcaaccacgatattgggattccaagtaatcgaaaaatttttcaggcaatgatggagatcttgattaatccggatcgtccgggtgattttaatcaagccttgatggacttagggtctgatattgagtctcctgtaaatcccagacctgaagaaagcccagtcaaggactttagtgcggcatatcagaatggaaccatggaccgttatccaattaaatctcctaagaaaaagccggttcctatttatcttaaagccttagttgtgaaaaattctcaaggacaatttttacttgaaaaaaatgaaagcgaaaagctcttggcaggtttttggcatttcccctttatagaagttgataacttttcgcaagaagagcagtttgacctctttcatcaggttgcggaagaaagtgtgaactttggccccagtccagaagagagtttccagcaggactatgacctagatgttgattggcttgatgtttgttttgatacagtccagcatgtttttagtcatcgaaaatggcatgtacagattgtagcaggtcaggtgagtgacttccatgatttttcagatagggaagttcgttggctttcaccagaagaattcaagaattacccacttgccaaaccccaacaaaaaatctggcaggcttatgcacaagccaacttagacagtagccaagactag

SEQ ID NO: 1923 - DNA, 705 bp, Streptococcus pneumoniae
atgaaaaaaatactaattgtagatgatgagaaaccaatctcggatattatcaagtttaatatgaccaaggaaggttatgaagttgtaactgcttttaatggtcgtgaagcgctagagcaatttgaagcagagcaaccagatattattattctggatttgatgcttccagaaattgatggtttagaagttgctaagaccattcgtaagacaagcagtgtgcccattcttatgctttcagccaaagatagtgaatttgataaggttatcggtttggaacttggggcagatgactatgtaacgaaacccttctccaatcgtgagttgcaggcgcgtgttaaagctcttctgcgtcgttctcaacctatgccagtagatggtcaggaagcagatagtaaacctcaacctatccaaattggggatttagaaattgttccagacgcctacgtggctaaaaaatatggcgaagaactagacttaacccatcgtgaatttgagcttttgtatcatttagcatcgcatacaggtcaagtcatcacgcgcgaacacttgcttgagactgtctggggttatgactattttggtgatgtccgcacagttgatgtgactgtacgacgtctgcgtgagaagattgaagatacgcccagccgaccagagtatatcttgacgcgccgtggtgtagggtattacatgagaaataatgcttga

SEQ ID NO: 1924 - DNA, 1356 bp, Streptococcus pneumoniae
gaaataatgcttgatttactgaaacaaaccatttttaccagagattttatctttatcctgattttgttaggtttcatccttgttgtgaccctcttattactggaaaatagacgtgataatattcagttgaagcaaatcaatcaaaaggttaaagatttgattgcaggagattattccaaggttcttgatatgcaaggtgggtctgaaatcaccaatattaccaataatttgaatgacttgtcggaggttattcgtctcactcaggaaaatctagaacaagagagtaagaggctaaatagtattctgttttatatgacagatggggttcttgcgaccaaccgtcggggtcagattatcatgattaacgatacagccaagaagcaactggggttggttaaggaagatgttctgaatagacgcattttggaattgctcaagatagaagaaaactatgaattgcgtgatttgattacccaaagtccagaattgttgctagattcccaagatatcaatggtgaatatttgaaccttcgagttcgctttgccttgatacgtcgagagtctggctttatttcaggtttggtggctgttttgcatgatacgacggagcaggagaaggaagaacgcgaacgaagactctttgtttccaatgttagccatgagttacggactcctctgactagcgtaaaatcctatcttgaagccttggatgagggggctttgtgtgaaactgtagcaccagactttatcaaggtttctcttgatgagaccaaccgtatgatgcgcatggtgacggatctcctccatctttcacgtattgataatgctaccagtcacctagatgtggaactgattaacttcactgcttttattacctttatcctcaatcgttttgacaagatgaaaggacaggaaaaggagaaaaaatatgagttggtgagagattatcccatcaattctatctggatggaaattgatacagataagatgacgcaggttgtcgacaatattttaaataatgctattaagtattcgccagatgggggtaaaatcactgtcagaatgaagacaactgaagaccagatgattttatccatttctgaccacggtttggggattcctaagcaggatttaccacgtatctttgaccgtttctatcgtgtggatcgtgctagaagtcgtgcacaaggtggtacaggtctaggactgtctatcgctaaagaaattatcaaacaacataagggctttatttgggccaagagtgaatacggcaagggttcaacctttaccattgtgctcccttatgataaggatgcagtgaaagaagaagtatgggaggatgaagtagaagactag

SEQ ID NO: 1925 - DNA, 810 bp, Streptococcus pneumoniae
atgagtgaaataggctttaaatacagtattttagcgtcgggttccagtggaaattctttttatctggaaacctcaaaaaagaagcttttagtagatgcaggcttgtctggcaagaaaattaccagtctgctagctgaaattaaccgtaagccagaagacctggatgccatcttgattacccatgagcattcagatcatatccatggagtaggcgttttggctcgcaagtatggtatggatctttatgccaatgaaaagacctggcaagctatggaaaatagtaaatatcttggcaaggtggattcttcgcaaaagcatatttttgaaatgggtaaaaccaaaacctttggagatatcgacatcgagagttttggtgtaagccatgatgcagtcgcaccgcagttctatcgctttatgaaggatgataagagttttgtccttttgacagatacaggttatgtcagtgaccgtatggcgggcattgtcgaaaatgcggatggctatcttatcgaggccaaccatgatgtagagattttgcgatcaggttcttacgcttggcgactcaaacaacgaatcctatctgaccttggtcacctttctaacgaggacggtgctgaagctatgattcggacgctaggaaatcgtactaagaagatttaccttgggcatttatctaaggaaaacaatatcaaggaactggctcatatgaccatggtcaatcagctggctcaagctgatctgggagtcggagtagactttaaggtttatgatacctcaccagataccgcaacaccattgacagagatatag

SEQ ID NO: 1926 - DNA, 243 bp, Streptococcus pneumoniae
atgactactattacattaaaagtttctgaagctgataaaacatttatgaaagcaatggctaagtttgaaggagtttccctttcggaacttattcgcaccaaaactcttgaagccctagaagatgaatacgatgctcgtgtggcagatttagcctatcaagagtatttagaagacttggaaaaaggagttgaacccattacttgggaagaaatgatgcatgatttaggcttgaaggatgaataa

SEQ ID NO: 1927 - DNA, 264 bp, Streptococcus pneumoniae
atgaataatttgtataaattagttccaacaagacgttttatcaagcaattgaaaaaattggaccgttatacgcagaagctaattacaaactatttacaaaccaatgttttggaagacccaagacgacacggaaaggctttggttggtaatcgcgttggtcaatggcgctatagaattggtaattatcgagttatcgtacaaattgtagatgatgaattagtcgttgctactctagaagttggtcatcggagagatatttattaa

SEQ ID NO: 1928 - DNA, 774 bp, Streptococcus pneumoniae
ttgaagaaaaaatggttttttgcagattattatgacacaacaattattttacttgctttaatctctgttattctggtattacttggatttgctgaaatgattgatttggacaatccgccttatagtattattgatttagtaatctggggtgtttttgtaattgactatagttggcgcttttttacgactaaaagaaaatggcgctttattcttgaaaatatttttgatttattggctattctccctttaaatgctatttttacagtgtttcgattagggcgtatctttcgtttagctaaactaacaaaattactgaaactgactcgtttacttagaataattggacttacaggtaaattagaaagaaaaattagtagattcttacggacaaatggcctgatttatatcttgtatgttaatatctttattgttctagtagggagttcgattttatccgttgttgaagaaaaatccttctcagatagtctttggtgggctcttgtgacagtaactactgttggatatggggatattgttcctgcttccatttttgggaaatggctagcagttttactgatgcttgtcggtattggaacaatagggatgttaacaagtgccttgacgaacttttttgtaaaggataatccagatgaacagataaaacttgataaactcaaagatgaattatcgagccaaagaatattactagagaaacaatctacaaagatagaagaactacataaaatgatacaagatttgattgaaaaaacataa

SEQ ID NO: 1929 - DNA, 510 bp, Streptococcus pneumoniae
ttgatttgttcagattttattttatttctctataaaacgcatagtatcaagtttttatacctgataatatgcgttctattgtgtcaaaacttacttgatttctcctcagctcaaactttgtctcatctttatttttattatgttttttcaatcaaatcttgtatcattttatgtagttcttctatctttgtagattgtttctctagtaatattctttggctcgataattcatctttgagtttatcaagttttatctgttcatctggattatcctttacaaaaaagttcgtcaaggcacttgttaacatccctattgttccaataccgacaagcatcagtaaaactgctagccatttcccaaaaatggaagcaggaacaatatccccatatccaacagtagttactgtcacaagagcccaccaaagactatctgagaaggatttttcttcaacaacggataaaatcgaactccctactagaacaataaagatattaacatacaagatataa

SEQ ID NO: 1930 - DNA, 999 bp, Streptococcus pneumoniae
atgtttaaaacaatgacttcaactaaacaacacaaaaaagttatccttgtcggtgatggtgctgtaggttcatcttacgcttttgcacttgttaaccaaggaattgcacaagagcttggaattatcgaaattccacaattgcatgaaaaagctgttggtgatgcgcttgaccttagtcacgcccttgccttcacttcacctaaaaaaatctatgcagctcaatactctgactgtgcagacgctgaccttgttgtgatcactgcaggtgcacctcaaaaaccaggtgaaactcgtcttgaccttgtaggtaaaaaccttgctatcaacaaatcaatcgtaactcaagttgttgaatctggtttcaaaggtatcttccttgttgctgctaacccagttgacgttttgacttactcaacttggaaattctctggtttccctaaagaacgcgttatcggttcaggtacttcacttgactcagctcgtttccgtcaagcacttgctgaaaaattggatgtggatgctcgttcagtgcacgcctacatcatgggtgaacacggtgactctgagttcgctgtttggtcacacgctaacatcgctggtgtaaaccttgaagaattccttaaagacactcaaaatgttcaagaagctgaattgattgaattgttcgaaggtgttcgtgatgcagcctacacaatcatcaacaaaaaaggtgcaacatactacggtatcgcagtagcccttgctcgtatcactaaagcaatccttgacgatgaaaacgcagtacttccactttcagtattccaagaaggtcaatacggagttgagaatgtctttatcggtcaaccagctgttgttggtgcacatggtatcgttcgtccagtaaacattccattgaacgatgcagaaactcaaaaaatgcaagcatctgctaaagaattgcaagctattattgacgaagcatggaaaaatccagaattccaagaagcttctaaaaactaa

SEQ ID NO: 1931 - DNA, 948 bp, Streptococcus pneumoniae
atgcaggataaaaatttagtgaatgtcaatctgacaaaggagatgaaggcaagttttatcgactacgccatgagtgttatcgtagcgcgagctcttcctgatgttcgagatggcttaaaacctgttcaccgtcgcattctctacggaatgaatgaattgggtgtgaccccagacaaaccccataaaaaatctgctcgtattacaggggatgtcatgggtaaatatcacccacacggggattcctctatttatgaagccatggtccgtatggctcaatggtggagctaccgttacatgcttgtagatggtcatgggaattttggttccatggatggagatagtgctgccgctcaacgttataccgaggcacgtatgagcaagattgctctggaaatgcttcgtgatatcaacaaaaatacagttgatttcgttgataactatgatgccaatgaacgggaacccttggtcttgccagcgcgttttccaaaccttttggttaatggagcaactggtatcgcggttgggatggcaaccaatattccacctcataatctgggtgaaaccattgatgcagtgaagttggtcatggataatcctgaagtgactaccaaggacttgatggaagtcttgcctggaccagattttccaactggtgctcttgtcatggggaaatcaggtatccataaggcttatgaaacaggtaaaggttcgattgtcctacgttctcgtacagagattgaaacgactaagactggtcgtgagcgcatcgttgtaacagaatttccttacatggtcaataaaaccaaggtgcatgagcatattgttcgcttggttcaggaaaaacgcattgagggtatcacagcagtacgtgatgagtcaaaccgtgaaggtgttcgatttgttattgaagtcaagcgcgacgcctcagccaatgttattctcatataa

SEQ ID NO: 1932 - DNA, 357 bp, Streptococcus pneumoniae
cagaatttccttacatggtcaataaaaccaaggtgcatgagcatattgttcgcttggttcaggaaaaacgcattgagggtatcacagcagtacgtgatgagtcaaaccgtgaaggtgttcgatttgttattgaagtcaagcgcgacgcctcagccaatgttattctcatataacctcttcaaaatgacccaaatgcaaaccaattttggtttcaatatgctcgctatccaaaatggtataccgaaaattttgtctcttcgtcagattttggatgcttatatcgagcaccaaaaagagtggttgttcgtcgtacacgttttgataaggaaaaagcggaagcgcgcgctcatatcttag

SEQ ID NO: 1933 - DNA, 1521 bp, Streptococcus pneumoniae
cctcttcaaaatgacccaaatgcaaaccaattttggtttcaatatgctcgctatccaaaatggtataccgaaaattttgtctcttcgtcagattttggatgcttatatcgagcaccaaaaagagtggttgttcgtcgtacacgttttgataaggaaaaagcggaagcgcgcgctcatatcttagaaggtctcttgattgcgctagaccatatcgacgaagtgattcgtatcatccgtgctagtgaaacggatgcggaagctcaagctgagttgatgagcaagtttaagctttctgaacgtcaaagtcaagctatccttgatatgcgtcttcgtcgtttgacaggtttggaacgcgataagattcaatctgagtatgatgacctcttggctctgattgcggatttagcagatattcttgctaagcctgaacgtgtttctcaaattatcaaagacgaattggatgaagttaaacgtaaattttctgataaacgccgtacagagttgatggttggacagatcttgagtctcgaggatgaggacttgattgaagaatcggatgtcttgattaccctttctaacagaggctacattaagcgtttggatcaggacgagttcactgctcaaaaacgtgggggtcgtggtgtccaaggaacgggagtgaaagatgatgactttgttcgtgagttagtgtcaactagcacacatgatcatctgctcttcttcacaaacaagggacgtgtctatcgtcttaaaggttatgaaattcctgagtatggtcggactgccaaagggctaccagtagtcaatctcttgaaattggatgaagacgaaagtattcagacggttatcaatgttgagtctgatcgcagtgatgatgcttatctcttctttacaacccgtcacggtattgtgaagagaactagtgttaaggagtttgccaatattcgtcaaaatggtctcaaagcgctgaatttaaaggatgaagatgagttaatcaatgtcttgttggcagaaggagatatggatattatcattggtaccaagtttggttatgcagttcgctttaatcaatcagccgttcgtggtatgagccgtatcgccactggtgtgaaaggtgttaaccttcgtgaaggagacacagttgttggtgccagcttgattactgatcaagatgaggttcttattatcacagaaaaaggatatggtaagcgtacagtcgctactgaatacccaacaaaaggtcgtggtggtaagggaatgcagacagctaaaattaccgaaaaaaatggcttgctggccggtcttatgactgttcaaggggatgaggatttgatgattatcactgatacaggtgtcatgattcgaaccaatcttgccaatatttcacaaacaggacgtgcaactatgggagttaaagtaatgcgcctggatcaagatgctcagatagtgactttcacaacggttgcggtggcagaaaaagaagaagttgggacagaaaacgaaacagaaggtgaagcataa

SEQ ID NO: 1934 - DNA, 744 bp, Streptococcus pneumoniae
atgtctcaaaaaaataataaaaagaaaaacaagcgaaaaaatctgctgacaaatatcctagcaggatttctgatattactgtcactggctttgatttttaatactcaaattcgaaatattttcatagtctggaataccaataagtatcaagttagccaggtatcaaaagaaaaattagaagaaaatcaggatacagaaggcaattttgactttgattctgtcaaagctatctcttcggaagctgttctaacttctcaatggaatgctcaaaaattaccagttattgggggaattgcaattcctgaattggaaatgaatttgccgatttttaaaggacttgataatgttaatctcttctacggagctggtacaatgaaacgcgagcaagtaatgggagaaggaaattatagtctagctagtcaccatatctttggtgttgataatgctaataaaatgttattttctcctttagataatgctaaaaatggcatgaagatttatctaaccgataaaaataaagtttatacttatgaaatacgtgaagtcaaacgtgtgacaccggatcgtgttgatgaagttgatgatagagatggggtcaatgaaatcacattagtaacctgtgaagaccttgctgctacagaacgtattattgtcaaaggtgatttgaaagaaacaaaagattattcacaaacatctgatgaaatcctaacagctttcaatcaaccatataaacaattttattaa

SEQ ID NO: 1935 - DNA, 798 bp, Streptococcus pneumoniae
atggtttcttcagaatttatctcaaagattgaatttgcttgcaataagaaagaaagtctttatagtcaaagcaaatttaagtatgcgattcgttcgatgttcgcaggtgcatttttaaccttcagtactgctgcaggtgcagttggggctgacttgattaataaaattgcaccaggtagtggacgcttcctctttccattcgtttttgcttggggcttggcctacattgtttttttgaatgccgagttggtcacttcaaacatgatgttcttgactgctggtagtttcttaaaaaaaatctcttggagaaaaacagctgagattttactatactgtaccttgttcaaccttatcggagccttgatagcagggtggggctttgctcattcggcagcctatgcgaatctgacacacgatagtttcatctcaggtgttgttgagatgaagttaggccgctcaaatgaattggtcttgcttgaggcgattttggcaaatattttcgtaaatattgcgattctgtcatttattttggtcaaagatggtggtgccaaactttggcttgtgttgtcagctatttacatgtttgtattcttaacaaacgagcacattgcggcgaactttgcttctttcgcgattgtgaaattcagtgttgctgcggattcaattgccaacttcggtgttggaaatatgcttcgccactggggtgtgactttcatcggaaactttatcggaggaggcctcttgatgggtcttccatatgccttcctcaataaaaacgaagatacttatgtagattaa

SEQ ID NO: 1936 - DNA, 1116 bp, Streptococcus pneumoniae
ttgaggaaaccagggaacatttatactcgtatcaccaatcctacaacagctgcccttgaaggtggtgttgaagcgctagcaacagcatcaggtatgactgcagtgacttatacgattttggcgcttgcccatgctggtgagcatgtagtggctgcttcgactatttacggtggaaccttcaatcttttgaaagaaccccttcctcgttatggtatcacaacaacctttgtcgatgttgataatttggaggaagtagaagcagctatcaaagacaataccaagcttgtcttgattgaaaccttgggtaaccccttgattaatattccagacctggaaaaactggcagagattgctcataaacatcaaatcccacttgtgtcagacaatacttttgcaacaccttatttgattaacgtcttctctcatggcgttgacattgccattcactctgcgactaagtttatcggtgggcatggtacaactattggaggaataattgtcgatagtggtcgttttgactggacggcttcagggaaattccctcaatttgttgacgagagtccaagctgccacaatttgagctatactcatgatgtgggtgcagcagcctttattatagctgttcgagttcaattgcgtcgtgatacaggtgcagccttgtcaccattcaatgctttcctcttgctacaaagacttgaaaccctttcacttcgtgtggaacgccatgtacaaaatgctgagacaattgttgattttcttgtcaaccatcctaaggtagaaaaggtaaattatccaaaacttgcagatagtccttattatgccttggctgagaaatacttgccaaaaggtgtcggttcaatctttaccttccacgtcaaaggtgacgaggaggaagcacgcaaggtcattgataatttagaaatcttttctgaccttgcaaacgcggcagatgctaaatcgcttgttgtccatccagcaacaatcactcacggtcaattgtcagaaaaagacctagaagcagcaggtgtcacaccaaatcaaatccacttgtctatcggtcttgaaaatgtagaagatttgattgaagacttacgcttggccttggaaaaaatttaa

SEQ ID NO: 1937 - DNA, 1275 bp, Streptococcus pneumoniae
atgaacgaaatcaaatgtcccaactgtggggaagtctttacagtaaatgaaagccagtatgctgaacttttgtcccaagtgagaacggcagagtttgataaggaactacacgataggatgaggcaggaactggccttggctgagcaaaaggctatgaatgagcaacagactaaactggctcagaaggatcaagaaattgcgcaattgcagagtcaaatccaaaactttgatacagaaaaagaattggccaagaaagaagttgaacagacaagccatcaggccttattggctaaggacaaggaagtacaggccttggaaaaccagttggcgaccttgcgtttggagcatgaaaatcaattgcaaaagaccctttctgacctagaaaaagaacgcaatcaggtcaaaaatcagctcctactgcaagaaaaggaaaatgagttgtctttggcttctgttaagcaaaactacgaagcccagctcaaagcagccagtgaacaagtcgagttttataagaattttaaggctcaacaatctacaaaagcgattggggaaagcctagaacagtatgcagagagtgagtttaacaaggttcgtagtttcgcctttccaaatgcttactttgagaaggataacaaggtctcttcgcgtgggtctaaaggggactttatcttccgtgagtgtgatgaaaatggagttgaaatcatttctatcatgtttgagatgaaaaacgaagcggacggaacagagaagaagcacaagaatgcagatttttacaaggaattggacaaggaccgtcgggagaagaactgtgagtatgccgttttggtgaccatgcttgaggctgataatgactactttaacacagggattgttgacgtcagtcacgagtatgaaaaaatgtatgttgttcgtcctcaattctttatccaattgattggtctcttacgtaatgcggcgctaaattccctaaaatacaagcaggagttggccttggttcgcgagcaaaatattgacattacgcattttgaggaagacttggatgcctttaagctagcttttgctaagaactataattcagcttcgactaactttggaaaagctattgatgaaatcgacaaggccatcaaacgcatggaagaggttaagaaattcctgactacatctgaaaaccaactccgtctagctaacaacaaattggaagatgtctctgttaaaaaattgacccggaaaaatccaacaatgaaagcgaagttcgaagcactgaagggggagtag

SEQ ID NO: 1938 - DNA, 879 bp, Streptococcus pneumoniae
atgaacggtattatcaacttaaaaaaagaagcaggaatgacctcgcatgatgcggtttttaaactgcgtaagattttgggaaccaagaaaattggtcatggcggaaccttggatccggatgtggtgggtgttttgccgattgcggttggcaaggcgacacgcatggtcgagtttatgcaggacgagggtaagatctatgagggggaaatcactctgggttattccacgacgactgaggatgctagtggggaagtggtcgcagaaacccctgttttgtctcccttggatgaaaagcttgttgatgaagcgattgctagcttgactgggcctattacccagattccccctatgtattcggcagttaaggttaatggtcgcaagctctatgagtatgcgcgtgctggtcaggaagtggagcgtccagaacgtcaggtgaccatttatcaatttgagcgaacaagtccgatttcttatgatggccaacttgcccgattcacttttcgtgtaaaatgcagtaaagggacttacatccgtactttgtcagttgatttgggtgaaaagcttggttatgcggctcatatgtcccatttgactcgtactagtgctgctggcttacaattagaagacgctctttccttggaggaaattgctgaaaaagtagaggctgggcaattagattttctccatcctttagagattgggacaggtgaccttgtcaaagttttcctaactccagaagaggctacagaagttcgctttggtcgttttattgagctagaccaaacggacaaagaactggctgcctttgaagatgataaattgttagccattctagaaaaacggggcaatctctataagccaaggaaggtttttagctag

SEQ ID NO: 1939 - DNA, 303 bp, Streptococcus pneumoniae
atgatgcgaaatgagtttcgagaaagggtggagcaacttcttcaacaaaaagaaataaatgaaaatagtgagttgagtcacctgtttcgtcttgctatacaaaatttagacagaaatgaaaaataccaatcggtcatggccaatttgagtcaagggttgtcactttacctcatgacgcatcattaccaggcacctaagtctgtcattgattttggtttatggattgccaaagctcctagccaggaaagagggagactggctttcttgcagatgcttgctcaaaccctacagggctttcgttaa

SEQ ID NO: 1940 - DNA, 717 bp, Streptococcus pneumoniae
  unsure (51): n at each above location is unknown.
gtgttttttgctgatgagactataaattttgtaaaaaatgtgataaaatanacgacggataaaataacggaagatagcatgcaaaataaaccaatcattattggagtgacaggtggttctggtggtggtaaaaccagtgtttcaacaaccattttatcgcattttcctgatgaaaagatttccatgattgagcatgattcatactacaaggatcagtctcatttgacctttgaagagcgtgtcaaaaccaactatgaccatccttttgcctttgatacagacttgatgatcgagcagattaaggaattgttggcagggcgtccggtggacatcccgacctacgactatacagagcatacacggagtagcaagacctatcgtcaggagcctcaagatgtctttatcgttgagggcattttggtcttggaggacaagcgtctgcgcgatttgatggatatcaagatttttgtggatacggatgacgatgtgcgcattattcgtcgtatcaagcgtgatatggaggagcgtggccgtagccttgatagcgttattaaccagtacttaggtgtggtcaaaccaatgtaccaccagtttatcgagtcaactaagcgttatgctgatatcgtcattcctgaaggggttagcaataccgtggctatcgacctgttgacgaccaagattgcaaagattttggaagaagctcgaaacagcaaataa

SEQ ID NO: 1941 - DNA, 1341 bp, Streptococcus pneumoniae
atggaaaagtatttatcggtaacaactttgaccaagtatctgaaaatgaaattcgataaagacccatacttggaacgggtctatttaactggtcaagtttccaactttcgtaaacgacctactcaccaatatttctccctaaaggatgaccatgcagttattcaagcgaccatctggtctgggatttatcagaaattagggtttgacctggaagaaggaatgaagatcaatgtgattgggcgtgtacaggtctatgaaccaagtggtagctactccatcatcattgaaaaagctgagcctgatggggttggggcgcttgcgattcagtttgaacaacttaagaaaaaattgacagaagaaggcctgtttcaagaacgcttcaagcaagctctaccccaattttctaagagaattggggtagtaaccagccgtagtggagccgttattcgagatattatcacgaccgtcagcaggcgattcccaggtgttgacatccttctttatccgaccaaggttcaaggtgaaggggctgcggaggaaattgctagaaatattgcgcgtgctaatcaatgggacgatttggatttgctcattattggtcgtggaggtggttctattgaggatctctgggcctttaacgaagaaattgtggtacgagctatttttgaatctcgtttgccagttatctctagtgtggggcatgagacggatgtgaccttggcagattttgtggcagatcgacgcgctgcaacgccaacagcggcggctgaactggcaacacctgtgaccaagttggatgtattagctcatttgcaaaatcaggaaaaacggatggtaacggcagtccgaaatgttctatctaagaaacaagaggctttgaaaaaatgcagtcagtctgttatctttagacaacctgagcgcttgtatgacggttatttgcaacgcttggaccaactgcaactgcgtttgaaacaaagtttgcgaactcggatttctgataacaaacaattagttcaagcaagaactcatcaattagtacaattatcacctgttaccaaaatccaacgctatcaagaccgtttaggacagttggacaagctcttaggtagcaaaatggcgttagtttatgacgccaaggttgctgaggtcaagcgactttcggaagctttgctcatgttggatactagccgaatcgtggcgcgtggttatgctattgtcaaaaaagaagagtccgttgtagattcggttgagagtttgaagagaaaagaccaagtaacgcttttgatgcgagatggtcaagtagaattagaggttaaagatgtcaaaacaaaagaaatttga

SEQ ID NO: 1942 - DNA, 213 bp, Streptococcus pneumoniae
atgtcaaaacaaaagaaatttgaggaaaatctagcagaactggaaaccattgtccaaagtttggaaaatggtgaaattgctctggaagatgcgattactgcctttcaaaagggcatggtcttgtcaaaagagctccaagctacgctggacaaggctgaaaagaccttggtcaaggtcatgcaagaagacggaacagaaagtgattttgaatga

SEQ ID NO: 1943 - DNA, 876 bp, Streptococcus pneumoniae
atgaaaaagcaagaaaaattagctcttgtcgagtcggctttggaagatttttatggagaccagcagtttgcctctagtttacgggagtctgttctctattctattcatgctggtggcaagcgtattcggccttttctcttgttagaagttctggaagccttgcaggttaccatcaaacctgctcacgcgcaggtagctactgccttggagatgattcatacagggagcttgattcacgatgaccttcctgctatggatgatgacgattatcgaagagggcggttaaccaatcacaagaaattcggtgaagctatggccattttggctggagatgccttattcttagactcatatgccttgattgcgcaggcagatttgccaagtcagattaaggtggacttgattgccaacttatcccttgcttcaggtagtctgggtatggtggcagggcaagttttggatatggagggcgaacaccagcacttgtctttggaagaacttcagactattcatgccaataagactgggaagttactagcctatcccttccaagcggcagctattatagctgaattgtcacctgaaatgcaggtgaagctgaaaactgtgggtgaattgattggacttgcttttcaagtcagagatgatgtactggatgtgacagctagttttgaggaaatcggcaagacacctcaaaaggatctgcaggcagaaaaatcaacctatcctgccctgttgggcttggaagagtccattgccttttgtaaccaaaccctggatcaagctaatgaaaaattagaagaaattgcccagcagattccctttgaaacagaatcgattgtaagtgtagtagaaagtttgagaatcaatggctaa

SEQ ID NO: 1944 - DNA, 738 bp, Streptococcus pneumoniae
atggctggcctagtcgtagcagtccttaatggagaacggtttgacaagccaggagagaaaattccagatgacaccgaattaaaactcaagggggagaaactcaagtatgtcagccgtggtggtttgaaactggaaaaggccttgcaggtctttgatttgtcggtggatggcgcgactacgattgatatcggggcctctactggaggttttaccgatgtcatgctacagaatagtgccaagttggtctttgcagtcgatgttggtaccaatcagttggcttggaaattacgccaagacccacgagttgtcagtatggagcagttcaatttccgctatgctgaaaagactgatttcgagcaggagccgagctttgccagtattgatgtgagtttcatttcccttagtctgattttgccagccttgcaccgtgtcttggctgatcaaggtcaggtggtagcacttgtcaaacctcagtttgaggcaggacgtgagcagattgggaaaaatggaattattcgagatgctaaggttcatcagaatgtccttgaatctgtaacagctatggcagtagaggtaggtttttcagtccttggcttggacttttctcccatccaaggtggacatggaaatattgaatttttagcgtatttgaaaaaagaaaagtcagcaagcaatcagattcttgctgagattaaagaagcagtagagagggcgcatagtcaatttaaaaatgaataa

SEQ ID NO: 1945 - DNA, 432 bp, Streptococcus pneumoniae
atgaataaaaaagagagacttgaaaaaattagaagattggtgacagattatcaaatcggcacgcaagaagaaattgtagaacatttgaaagaagcaggtatcactgccactcaggcgacggtatcccgagatatcaaagagttaggtattgtcaaaattcctttgagagacaacacctatgtctacgaattgccaaaatcaatcgtaaaaagtctgcaactggctgaagacaatatcgaatcggctgaattgatggataagatgatcaatctccaagttattccaggaaatacggcttttgtaaaagctcagttaatcgatacttttgcagacaagatttttagttgtttgactgatgatagctcgattttagtcattgccagaagtggaagtctagcagaggaaatctttgaacaagtaaaaaattggtag

SEQ ID NO: 1946 - DNA, 894 bp, Streptococcus pneumoniae
atgttacttgaaatttcgataaaaaactttgccattattgaggctatttccctcaattttgaaaaggggatgactgtcctgactggtgaaacgggtgcagggaagtcgattatcattgatgccatgaatatgatgttgggagctcgtgcgacgacagatgttattcgtcatggtgcaccaaaggcagagattgaggggcttttctcagttgagaatagtcgtcttttacaggaaatttttgatgagcaaggtttagagttaggtgatgaaattatcatccgtcgggaaatcttgcaaaatggtcgtagtatcagccgtgtaaatggtcagatggttaatctgtctgttttgcgagctattgggcaacatcttgtagatattcatggtcagcatgaccatgaggagttaatgcgtccccaactgcatatccagatgttggatgaatttggtgatgccgctttttgggacttgaaagaaacctatcaaacgagttttgatgcctatcggaaaatgcgcaagcaggttctggaagtcaagaaaaaccaacaggaacacaaggcacgtatcgaaatgttggaatttcaaatggcagagattgaggcagcaaacttgcaggctggagaagacttggatctcaatcaagagcgagataaactcctcaaccacaaaaatattgcggatacactgaccaatgcctacagtatgttggacaatgaagatttttcaagtctggccaatgttcgttcagccatgaatgacatggaaagtgtcgaagagtatgaccctgaataccgtgaaatttcaagctctctgtctgagacctactatgttttagaagacattagcaaacgtttggaagctatcattgaggaccttgattttgatggcaatcgc

SEQ ID NO: 1947 - DNA, 783 bp, Streptococcus pneumoniae
tggcaatcgctgatgcaggttgagaatcgtttggacctccttcatactattactcgtaagtatggtgggactgttgatgatgttttgctttattttgccaagattacggaagaatacaatctcttgacaggcaataatctttcgtctgaggacatggaagcagagcttaagaagttggaagtcaatcttgtcaatttggcaggtcaacttgcttctgctcgtcataatttggctcagcaactcgaagctgagattaaacaagaactgcaagatctttatatggaaaaagcccagtttcaggttcgttttagtaagggaaaattcagtcgtgagggaaatgaaatggttgagttttatatttcaaccaaccctggagaagactttaaacccttggttaaggttgcttctggaggggaattatctcgtctcatgttagccattaagtctgccttttcacgtaaagaaggcaagactagcattgtctttgatgaggtggatacgggagtttcaggtcgtgttgctcaagctattgctcagaaaattcataaaattggtcagtatggtcaggttttggctatctcccatttgccacaagtaattgcgattgcagattatcaattctttattgagaagattagtaatgaccattcaacggtttcgactgttcgtctcttgacagtcgaagagcgagtggaggaagttgccaagatgttggcaggtgatgatgtgacagaagcagccctgacgcaagccagagaattgttgagaaacagggagaaataa

SEQ ID NO: 1948 - DNA, 729 bp, Streptococcus pneumoniae
atgacagattattatgtaattggagatgttcacggaaaagctgggatgctggaagaccttcttaaaacctgggatggtcagacccagttgctctttctaggtgatttgattgacagaggtgaggatagtcaccgtgttcttgaaatggtcaaggacttggtggacaatcaaggggctatctgtttgtctggaaaccacgagtatatgtttttgacttggctagattacccagaagaaagttatgaccattatcgtcgcaatggtggagatacaaccattaactctatcctaggtcgtcccttggatgcaccagttgatggagtagaagatgccaagcgggttgccgctgaagcggcagacttggtcgaattcattcgtcaaatgccatttgtagtagagacagacaagtatatctttgttcacgcaggtattgatttgaccttggacgactggcatgaaacaacagattataaaaaagtatggcttagaaaaccattccacggagctgaaaatcatactggaaaaaccattgtcttcggtcatacaccggtctatggtttgttacagcaagaacgcggtacatctgagctttggactacagaagatggcaagattggaatggatggaggagctgtttatggtggtgtccttcacgggattgtctttacagaccaaggaatgacagaacaccactttatcgaaaatgacggctttgtcgctgaagattag

SEQ ID NO: 1949 - DNA, 1035 bp, Streptococcus pneumoniae
atggtcttgtcaaaatatcaaaaacaatttataataaatagataccctgaaaggaagagaatcatgaacttagaagaattgaaaaaacgacagaggaagatccgtaacttctctattatcgcccatattgaccacgggaaatcaactctagcagaccgcattttggaaaaaacagagacggtttcaagtcgtgaaatgcaggcccagcttttggatagcatggatctagagcgggaacgtggaattactattaagttgaatgccatcgagttgaattacactgcaaaagatggggaaacttatattttccacttgattgacacaccagggcacgttgactttacctatgaagtttcacgttcgctagctgcctgtgagggtgctattttggtggtcgatgcggctcaaggaattgaggctcaaactcttgccaacgtttatctggctttggataatgatttggaaatcatgcctatcattaataaaattgacctgccggctgcagatccggagcgcgtgcgtacagagattgaagatgtgattggtttggatgccagtgaagcagttttggcttctgccaaggctggtattgggattgaagaaatcctcgagcaaattgtagaaaaagtaccagcaccaacgggtgatgtgacggcgccacttaaggccttgattttcgactctgtttacgatgcttaccgtggggttatcctccaagtgcgtgtcatggacggagtggtcaaacctggtgataagattcagctcatgagcaatagtaagacctttgatgtggccgaagtcggtatttttacaccaaaagcggttggtcgtgatttccttgcgactggtgatgttggttacattgcggcgtctatcaagacggttcaggatactcgtgtgggtgataccgttaccttggcaaccaatcctgcggcagaaccattacatggttataagcagatgaatcctatggtctttgcgggtctctacccaatcgaatcaaacaaatacaatgacctgcgtgaagccgcttga

SEQ ID NO: 1950 - DNA, 912 bp, Streptococcus pneumoniae
ttgcgggtctctacccaatcgaatcaaacaaatacaatgacctgcgtgaagccgcttgaaaaattgcaactgaatgatgctagtcttcagtttgaaccagaaacatctcaggcacttggatttggtttccgttgtggatttcttggacttctccatatggatgttatccaggaacgtttagagcgtgagttcaatattgacctcatcatgacagctccgtctgttatttacaaagttaatttgaccgacggtgagtctatggatgtgtctaacccatctgagtttccagacccaactaagattgcgaccattgaagagccttatgtcaaggcgcaaatcatggtaccacaggagttcgtcggagcagtaatggagctagctcagcgtaagcgtggggactttgtgactatggactatattgatgataaccgtgtcaatgttatctatcaaattcctcttgctgaaattgtctttgacttctttgataaacttaagtcttcgacacgtggttatgcaagctttgactacgaattgtcagaatatcgcccatctaagctggtgaaaatggatatccttctcaatggagataaggtggatgccctcagctttatcgttcacaaggactttgcctacgaacgtgggaaactcatcgttgataaactcaagaaaatcatccctcgccaacaatttgaagttccaatccaagcggctattggacacaagattgtcgctcgtactgatatcaaggcccttcgtaagaacgtacttgctaaatgttatggtggtgacgtttctcgtaagcgtaaactccttgaaaaacaaaaagctggtaagaaacgcatgaaatccatcggatcagttgaagttccgcaagaagccttcctcagcgtcttgagtatggatgaagaataa

SEQ ID NO: 1951 - DNA, 333 bp, Streptococcus pneumoniae
atgaaaatcaaagagcaaactaggaagctagccgcaggttgttcaaaacacagttttgaggttgtagatgaaactgacgaagtcagctcaaaacatggttttgaggttgtagatgaaactgacgaagtcagctcaaaacatggttctgaggttgtagatgaaactgacgaagtcagctcaaaacatggttttgaggttgtagatgaaactgacgaagtcagctcaaaacatggttttgagattgtagatgaaactgacgaagtcagtaaccatacatacggtaaggcgacgctgacgtggtttgaagagattttcgaagagtataaaaactaa

SEQ ID NO: 1952 - DNA, 336 bp, Streptococcus pneumoniae
ttatactcttcgaaaatctcttcaaaccacgtcagcgtcgccttaccgtatgtatggttactgacttcgtcagtttcatctacaatctcaaaaccatgttttgagctgacttcgtcagtttcatctacaacctcaaaaccatgttttgagctgacttcgtcagtttcatctacaacctcagaaccatgttttgagctgacttcgtcagtttcatctacaacctcaaaaccatgttttgagctgacttcgtcagtttcatctacaacctcaaaactgtgttttgaacaacctgcggctagcttcctagtttgctctttgattttcattgagtattag

SEQ ID NO: 1953 - DNA, 288 bp, Streptococcus pneumoniae
ggtcttggggtaaaaaaacaaaaggcttgcttttcagccatagaggaggtcatcatgtataaacacttatttttcctagattccaaaactttagatcggttgacaccctatattctagtcttggcttctgacaccattgcttttaatgtttttgtgctaacctttgtatctgcggtggtttttaatttcctaaattccatgctagctttaatggctatattcataggggctggctatgtggtcggattttggttactaatactcaatgaaaatcaaagagcaaactag

SEQ ID NO: 1954 - DNA, 690 bp, Streptococcus pneumoniae
atgaaaaagtatcaacttctattcaaaataagtgcagtcttctcttacttatttttcgtatttggtctttctcagctgacgcttatcgtccaaaattattggcaattttcttcccagattggcaatttcgtctggattcaaaatatcttgagtttactatttagcggagtcatgatttggattctggttaagacaggccatggctatctctttcgcattccaagaaaaaaatggctttggtattctattttgacagtattagtggtagtgctccatatctcttttaacgttcagacagctaaacatgttcagtcaactgctgagggttggaacgtattgattggttatagtgggaccaactttgctgagctaggtatctatgtaaccctgtttttcctgactccactaatggaagagttgatttataggggattacttcaacacgccttctttaagcattcgcgatttgggcttgatttgcttcttccttccattttgtttgctcttcctcattttttgagtctgcctagtctgttagatatcttcgtctttgcaacatttggaatcatctttgccggtttgacccgctataccaagagtatttatccatcctatgcggtgcatgtgatcaataatattgtagcgaccttcccgtttttgctcacttttctacatagggtcttggggtaa

SEQ ID NO: 1955 - DNA, 180 bp, Streptococcus pneumoniae
atgagggaggatttctatgaaaaagtatcaacttctattcaaaataagtgcagtcttctcttacttatttttcgtatttggtctttctcagctgacgcttatcgtccaaaattattggcaattttcttcccagattggcaatttcgtctggattcaaaatatcttgagtttactatttag

SEQ ID NO: 1956 - DNA, 246 bp, Streptococcus pneumoniae
gtgatatactatatggatacaaaaatgatgtcacaattttctgttatggataatgaaatgcttgttcgtacagaggatggggatgtctctgatatttatagagggtacgctaatcagagaagtccattcgcttcttacccttctatattaaaaaattcaggtccttttccagtaagtgggtactgcctgcgtggttatcatgaccgtggttatataggagcaggttttcatttatgtggaatatag

SEQ ID NO: 1957 - DNA, 210 bp, Streptococcus pneumoniae
atgaaggctatattctttattattctcttcgcttttcaaacctatcttatttatctatccataagtatctccgataaaaaacaaaagactattgaattaacatcattgaattgttttgtcatattatttctaatctatgataaattaatttttctctttattgcttatgtttttttgataatttttatattaaacttgttccgtaactga

SEQ ID NO: 1958 - DNA, 204 bp, Streptococcus pneumoniae
atgaatacttattgtaatataaatgaaacaatgctgagtgaggtttatggaggtaattccggaggagcagctgtagttgctgctttaggttgtgcagcgggtggagtgaaatatgggagacttctaggaccatggggcgctgcaataggaggaattggaggagcagtggtttgtggatatttagcctataccgctacatcataa

SEQ ID NO: 1959 - DNA, 255 bp, Streptococcus pneumoniae
atggatacaaaaattatggaacaatttcatgaaatggatataactatgttatctagtattgaaggaggcaagaataattggcaaactaatgtcttagaaggtggtggtgctgcttttggtggctgggggttagggacagctatttgtgctgcgagtggtgttggagcgccatttatgggagcatgtggatacataggagctaaatttggtgtggctctttgggcaggagtaacaggggcaacgagtggattttaa

SEQ ID NO: 1960 - DNA, 168 bp, Streptococcus pneumoniae
atgtatccacatgctcccataaatggcgctccaacaccactcgcagcacaaatagctgtccctaacccccagccaccaaaagcagcaccaccaccttctaagacattagtttgccaattattcttgcctccttcaatactagataacatagttatatccatttcatga

SEQ ID NO: 1961 - DNA, 546 bp, Streptococcus pneumoniae
ttgatgcgacggaagtataaatcaatcgccctaaaaaaagaattagcgaattattctggtaaaaagaaatgccacgctatgaaggctcaagcgattgtcacaagtcaagggagaattgtttctttggatatcactgtgaactattgtcatgatatgaagttgttcaaaatgagtcgcagaaatatcggacaagctggtaaaatcttgactgacagtgattatcaagggcccatgaagatatatcctcaagcacaaactccacgtaaagccagcaaactcaaaccgctaacagctgaagataaagcctgtaaccatgcactatctaaggatagaagcaaggttgagaacatccttgccaaagtaaaaacgtttaaaatgttttcaacaacctatcgaaatcatcgtaaacgcttcggattacgaatgaatttgattgctggtattatcaatcatgaactaggattttggtttcgcaggaagtctaatgtaatttttgcaattcaagacgtttcgatgactattcaagatctggatgaaaaattttaa

SEQ ID NO: 1962 - DNA, 399 bp, Streptococcus pneumoniae
ttgatttatcctgttcttatttcattttactatagttctatgaattatgaaggaagtaaacaactaactgatgcacgatttaaatgtcttgttggtgttcaacgcacgacttttgaagagatgttagctgtattaaaaacagcttatcaacttaaacacgcaaaaggtggacgaaaacctaaattaagcctagaagaccttcttatggccactcttcactatgtgcgagaatatcgaacttatgaagaaattgcggctgattttggtatccacgaaagcaacttactccgtcggagccaatgggttgaagtaactcttgttcaaagtggtgttacgatttcaagaactcctctcagctctgaggacacggtaatgattattgatgcgacggaagtataa

SEQ ID NO: 1963 - DNA, 165 bp, Streptococcus pneumoniae
atgaagaaaaaaatacttatcattttcatcttgtatctaatcatgtccatctttctttatccgcttagggaaagtatttggtatcagctattttataccatagcctatgtgattgcagttatgatctattttgctttaactaaaaagaaaggagcaaagaaatga

SEQ ID NO: 1964 - DNA, 204 bp, Streptococcus pneumoniae
atggaaaaaattgattatattactttgaatgaagtagaattagagacgattagtggtggagatgactgttttattggagatatcggatgtatcggctgggggcttttgaagagtatcggagggatgataaaacctgctccatatgttcctccagtatgcattccaaaaagttcgtggaatcctgcacctccagttccatgttaa

SEQ ID NO: 1965 - DNA, 207 bp, Streptococcus pneumoniae
atgttgcaggtagcattgttgatacagcaattgatgattttacgaatcaatgccggaaaaatcctcatcagtggttctgtgttcgtgtatagatatagtagtgttgtattgtataagaatttatataacttaatgacctatgcagtgatagaaactattcttttgcaaacgagtcgcttattctgttataagtttacgtgctcctag

SEQ ID NO: 1966 - DNA, 204 bp, Streptococcus pneumoniae
atgaatacaaaaatgatggaacaattttctgttatggataatgaaatgcttgataggatagagggaggaatatttggagttgacgatgctttgttttgggcagggttaggctatgttgcaggtagcattgttgatacagcaattgatgattttacgaatcaatgccggaaaaatcctcatcagtggttctgtgttcgtgtatag

SEQ ID NO: 1967 - DNA, 219 bp, Streptococcus pneumoniae
ttgtcttgttgcaactttgacaagtttagtatatcattattttttaatttttttcatccaaatcttgaattggcatcgaaacgtcttgaattagcttttttatttcaagccacctctaaatgtttaaaaaaaataatttctaatcacttttttaccattcaggaagttttaatgactattcaagatttcataaaatatgaacttagttttatggcataa

SEQ ID NO: 1968 - DNA, 2154 bp, Streptococcus pneumoniae
atgacttcttataaacgtacatttgttcctcaaatagatgcgagagactgtggtgtcgctgccttagcctcgattgctaaattctatggttcagatttttctctagctcacttgagagaacttgcaaagaccaataaagaagggacgactgctcttggcattgtaaaagccgctgatgaaatgggctttgaaacaaggcctgttcaagcagataaaactctctttgacatgagtgatgtcccctatccatttatcgttcacgttaacaaagaaggaaaactccaacattactatgttgtctatcaaacaaagaaagactatctgattattggtgatcctgacccttctgtaaaaatcactaaaatgtcaaaagaacgctttttctctgaatggactggagtagctatttttctagctcccaaacccagctatcaaccccataaagataaaaagaatggtctactaagcttccttcctctgattttcaaacaaaaatctctcattgcttacattgttctctcaagcttattggtcactattatcaatatcggtggttcttattatctccaaggaatcttggatgaatacatcccaaatcagatgaaatcaactttaggaatcatctcagttggtctggttatcacctatatcctccaacaagtcatgagcttttccagagattatctcctaaccgttctgagccagagattaagcattgatgtgattttatcctatattcgccatatttttgaacttcccatgtctttctttgcgacacgtcgtacaggagaaatcatttcacggttcacagatgctaactctattatagatgccttggcttctaccattctttctctttttctggatgtttctattctgattcttgtagggggcgtcttactggcacaaaaccctaatctcttcctcctttctcttctttccattcctatatacatgttcatcatcttttcttttatgaaacctttcgaaaaaatgaaccatgatgtcatgcaaagtaattctatggttagctctgccattatcgaagatatcaacgggattgaaactataaagtcgctcacgagtgaagaaaatcgctatcaaaatatagacagcgaatttgtagattatttggaaaaatcctttaagctcagtaaatattctattttacaaacgagtttaaagcagggaacaaaattagttctgaatatccttatcctatggtttggcgctcaattagtcatgtcgagtaaaatttctatcggtcagctgattacctttaacacacttttttcttactttacaactcctatggaaaatattatcaacctccaaaccaaactccaatctgcgaaggtcgctaataaccgtttgaacgaagtctatctagtcgaatctgaatttcaagttcaagaaaaccctgttcattcacattttttgatgggcgatattgaatttgatgacctttcttataagtatggttttggacgagataccttaacagatattaatctcacgattaaacaaggagataaggttagcctagttggagttagtggttctggtaaaacaactttagccaaaatgattgtcaatttctttgaaccctacaaagggcatatttccatcaattatcaggatattaaaaacattgataaaaaagtcttgcgccgtcatattaattacctaccccaacaagcctatatctttaatggctctatcttggaaaatttaaccttgggcggtaatcatatgattagccaagaagatattctaagagcttgtgaattagctgaaatccgtcaagacattgaaagaatgcctatgggctatcaaactcagctctctgatggagctggtctatcaggaggacaaaagcaacgaatcgctctcgctcgtgctcttttaactaaagctcctgttttaatactagatgaagctactagcggtcttgatgtcttgactgagaaaaaggttatagataatcttatatccctaactgataaaaccattctctttgtagcccatcgtctcagtatagccgaacgaactaaccgtgtcattgttcttgaccaggggaaaatcattgaagttggtagtcaccaagagttaatgcaggcgcaaggcttctaccatcatctattcaataaataa

SEQ ID NO: 1969 - DNA, 249 bp, Streptococcus pneumoniae
atgattttcccctggtcaagaacaatgacacggttagttcgttcggctatactgagacgatgggctacaaagagaatggttttatcagttagggatataagattatctataacctttttctcagtcaagacatcaagaccgctagtagcttcatctagtattaaaacaggagctttagttaaaagagcacgagcgagagcgattcgttgcttttgtcctcctgatagaccagctccatcagagagctga

SEQ ID NO: 1970 - DNA, 1362 bp, Streptococcus pneumoniae
atgaatcctaatctttttagaagtgtcgagttttatcagagacgttaccataactatgcgacagtgttcattatacctctttcattactatttactttcatcttgattttctcccttgttgccacaaaagaaattactgttacttcccaaggagaaatcgcccctacaagtgtcattgcatctattcagtcgaccagtgataatcctatccttgctaatcatttagtggcaaatcaagtagttgagaaaggtgacttactcatcaaatactctgaaacaatggaagaaagtcagaaaactgccttagcaactcaattacaaagacttgagaagcaaaaagaaggacttggaatcttgaaacaaagcttagaaaaagcgactgatcttttttctagcgaggatgagtttggctaccataatacctttatgaattttactaaacaatcccatgatattgaactgggtatctcaaagactaacactgaagtttcaaatcaagctaatcttaccaatagcagttcatcagccatcgaacaagaaattacaaaagttcaacaacaaattggagaatatcaagagttgagagatgctatcataaataacagagcacgcttaccaactggcaatccgcaccagtcaattttaaatcgttatcttatagcctctcaaggacaaacacaaggaacggcagaggagccatttttatctcaaattaatcaaagtattgcaggtctggaatcatctatcgcaagcctcaaaattcagcaagctggtatcggaagtgtagcaacttatgataatagtttagcaaccaaaattgaagtactccgcactcagtttttacaaacagcctcacagcaacaactaaccgtggagaatcaattaacagaattaaaagtacaactagatcaagcgacacagcgcttagaaaataataccttaaccgctccaagtaaaggtatcgttcatctgaacagcgaatttgaaggtaaaaatagaattccaactggtacagaaattgctcaaatattccctgtcatcacagatacaagagaagtactaatcacttactacgtatcatctgactatctccccttactagataaaggacaaactgtaagattaaaactggagaagattggaaatcacggcaccaccatcatcggccaacttcagagtattgatcaaactcctaccagaacagagcaaggcaatctctttaaattaaccgctcttgcaaaactatctaacgaggatagtaaactcatccaatatggcttacaaggtcgcgtcactagtgtaactacaaagaaaacatattttgattatttcaaagataaaattttaacccattctgattaa

SEQ ID NO: 1971 - DNA, 201 bp, Streptococcus pneumoniae
cactctataactatttattatcttatcaaaaaggagaatcataacatggataagaaacaaaacctaacttcatttcaagaactaacaactaccgaactcaaccaaattataggtggaggatggtgggaagatttcttatatagatttaatataattgaacaaaaaaatacaaaaggattttatcagccaatacaactataa

SEQ ID NO: 1972 - DNA, 330 bp, Streptococcus pneumoniae
ttgaacaaaaaaatacaaaaggattttatcagccaatacaactataaaaaaacaagaccaagagaacgcactctcggtcttattttttcttcattctatatgtattacagtaagtacctgacgaaaaacgtgatcttggcaggtggtattgagactggtattgggatgactttccacaattttcataacggtatagagaccaactcctctctcctcccctttagaacttgctccaaaggagaagatttcagaaatatcgattccctcttctttgatggaattttcaatgataaaggtctcctgtgctccatttttaaaaaaggcaattga

SEQ ID NO: 1973 - DNA, 1341 bp, Streptococcus pneumoniae
atgaatgttgcttggatattgttgtatacacttgttactcacggattaaaaattgtcatattctttaaggtagatggaattagtctcacttttgagaggatttttaaggcctttctttttaagatactgttggccgttgtttttggaatgcttggctatatggtaggaaatgtttacctatcttattttatggaacccttgtacggcataggcttatctttcttattgttaagagaacttcctaaaaaactccttctcttttatggtctctttccaatgatattagtgaatctcttttatagaggtgtttcctattttgtgcttccatttttgggacaagggcaagtatatgatgactactcatttatttggttatgtataataattttcaatttcttcatttctctagcttttttgaaatggttggactatgatttcactagcttgagaaaggggattctcgataaagattttcaaaagtccctgactcagattaactggataatgggggcttactatttggtgatacaaaatctgtcttactttgaatatgaacaggggattcaatcaacgactgttcgccatctcatcctagtcttttacctgctcttttttatggggattatcaagaaattggatacctatttgaaggacaaactccatgagagactgaaccaagagcaggacttgcgctacagagagatggagcggtatagtcggcatatagaggagctttataaggaagtacggagttttcgccatgactacaccaacctcttgactagcttacgtctgggcattgaagaggaggatatggagcagataaaagagatctacgactcggtcttaaaggattctagtgaaaaattgcaggacaataaatatgaccttggccgattggtgaatgttcgggatcgtgccctcaaaagtctcctagctggaaaatttataaaagctagagataagaacattgtctttaatgtcgaagttccagaggagattcaggtagagggggtgagtctacttgattttctaaccgttgtgtctatcctttgtgacaacgctattgaagctagtgtagaagcctgtcaacctcatgtttcaattgccttttttaaaaatggagcacaggagacctttatcattgaaaattccatcaaagaagagggaatcgatatttctgaaatcttctcctttggagcaagttctaaaggggaggagagaggagttggtctctataccgttatgaaaattgtggaaagtcatcccaataccagtctcaataccacctgccaagatcacgtttttcgtcaggtacttactgtaatacatatagaatga

SEQ ID NO: 1974 - DNA, 645 bp, Streptococcus pneumoniae
gttcttttgaagtttttggtaagccagatcaattgctggcagaggtgcatgagaaggggggcccatcagctattctttttggatattgagattcgaaatgaggagatgaagggtctggaagtggctagaaagattcgggatcgggatccgtatgccctgattgtctttgtgacgactcactcggagtttatgcccctgtcctttcgctaccaagtgtctgctctggattatattgataaggccctttcggcagaggagtttgaatctcgtatcgagacagccctcctctatgccaatggtcaagacagtaaaagtctagcggaagattgcttttactttaaatcaaaatttgctcaattccagtatccttttaaagaggtttactatctcgaaacgtccacaagaccccatcgtgttattctctataccaagacagacaggctggaatttacagcgagtctagaggaggttctcaagcaggagcctcgtttcttgcagtgccatcgctcttttctcatcaatcctgccaatgtggtgcatttagataagaaagaaaaactgcttttctttcccaatggtggaagttgtctaatcgcgcgttataaggtcagggaagtgtctgaggctattaataacttacactga

SEQ ID NO: 1975 - DNA, 183 bp, Streptococcus pneumoniae
atgagaatatttgttttagaagatgatttttcccaacagactagaattgaaacgacgattgagaaactcttgaaggaacatcatatcactctgagttcttttgaagtttttggtaagccagatcaattgctggcagaggtgcatgagaaggggggcccatcagctattctttttggatattga

SEQ ID NO: 1976 - DNA, 339 bp, Streptococcus pneumoniae
atgaaacatatgattattcagacacagaaaacagtctataaagtaaacgtcgacgatgtctactatatccaaacacatccaactaaagcccatactgtaaagattgttacagaagaggctagttttaatatggttcaaaatttaagtaatcttgagaaccaatatggggaaaccttgatgagatgtcatcgaaattgtttggtcaatcttgataaagtaaaatcgattgattttcaagaaagaatcctttttcttggagaagaaggtcaatacgctgtcaagtatgccagacgtcgctatagagaaattcgtcaaaaatggttgaaagaaggagagtaa

SEQ ID NO: 1977 - DNA, 330 bp, Streptococcus pneumoniae
atgacagatacagaccctatcaaaagagctcagactttgattactgacttaaacaaagcctatcaagcatgcaaacaggcaaccgctgacgacgtccgctttcaggagcaattaaactctattcttggttttctagccaaggctgaaacagtggataatcgattcttgattgaattggaaaaattttaccagacttccagtcttctcatgggactcagcgctcttgatccagatgctccaactcgcgccgcttggcgggcctatgaccgcttccactttgaccaagtcaagaccaagttaatactcaatgagaatcaaagagcaaactag

SEQ ID NO: 1978 - DNA, 207 bp, Streptococcus pneumoniae
ccgcaagctgtacttgagtacggtgagacgacgctgacgtggtttgaagagattttcgaagagtataagtctctacggaccaaccattatcctgtagtaacaaaaaagaagttgagacagactgaactcaacttcttttttagtgtcgtatcagcaatgttagtcctgcatctgacgttttacctgataaggcgaatacaagactag

SEQ ID NO: 1979 - DNA, 972 bp, Streptococcus pneumoniae
ccactttgtcttgttcctgcttgtcctgttgggctttctagctaccagtacagtcaactcttacaacattttcctgaaaatcattggcctatccttttgtttgtaggaattacgtctgttttacttttactttggggaggaattgccacctatatggaggctccagacaagctctttctcttagttggagaagaggaaatcaagctccatctcaagcgtcaaactggcatttccctagtcttttggctctttgtacagacccttttcttgctgttatttgcgcccttgtttttagcaatgggttatggcttgccagtttttctgctctatgtgcttttattgggggtaggaaaatatttccactttcgtcaaaaggccagcaaatttttcactgaaactggactggactgggactatcttatttctcaagaaagcaagcgtaagcaagtcttgcttcgtttctttgccctctttacgcaggtcaagggaatttcaaacagtgtcaagcgtcgtgcctatctggactttatcttaaaggctgttcagaaggtgcctgggaagatttggcaaaatctctatctgcgttcttatctgcgaaatggcgacctctttgctctcagtcttcgtcttctcttactttccgtactggcgcaggtttttatcgagcaagcttggattgcgacagcagtggtagttctctttaactacctcttgctcttccagttgctggccctctatcatgcctttgactaccagtatttgacccaactctttccgctggacaaggggcaaaaggaaaaaggcttacaggaggtagttcgaggattgaccagttttgttttacttgtggaagtagttgttgggttgataacctcccaagaaaaactagcccttctagccttactaggagctggtttggttttactagtcttgtattcgccttatcaggtaaaacgtcagatgcaggactaa

SEQ ID NO: 1980 - DNA, 222 bp, Streptococcus pneumoniae
atgatatttactatggctcatgaccaaagaggaggatctatgaaagacttgtttttaaagagaaagcaggcctttcgtaaggagtgtcttggttatctgcgctatgtgctcaatgaccactttgtcttgttcctgcttgtcctgttgggctttctagctaccagtacagtcaactcttacaacattttcctgaaaatcattggcctatccttttgtttgtag

SEQ ID NO: 1981 - DNA, 345 bp, Streptococcus pneumoniae
gcaaaaagtggctttcgaacgagtagagcccttgttaaaaatgttccgtttggacagaaattagactggttccctgttcatttttcaaaagggatgaagcagaaggtcatgattatctgtgcttttgtggtggatccaagtcttttcatcgtggatgagcctttccttggtcttgatccgctggctatttctgatttgattcagcttttggaagtggagaagcaaaagggcaagtctattctcatgagtacccacgtgctggattcggcggagaagatgtgtgatgcctttgtcattcttcacaagggagaggtgcgtgcaaacaactctcctgcaactacgtga

SEQ ID NO: 1982 - DNA, 378 bp, Streptococcus pneumoniae
atgttagaaattaaaaacctgacaggtggctatgttcatgttcctgttttgaaagatgtgtcctttactgttgaaagtgggcagttggtcggtttgattggtctcaatggtgctgggaaatcaacgacgatcaatgagattatcggtctgttggcaccttatagtggctccatcaatatcaatggcctgactctgcaaggagatgcgactagctaccgcaagcagattggctacattcctgagacgcctagtctgtatgaggaattgaccctcagagagcatatcgaaacggttgctatggcttacggtattgagcaaaaagtggctttcgaacgagtagagcccttgttaaaaatgttccgtttggacagaaattag

SEQ ID NO: 1983 - DNA, 411 bp, Streptococcus pneumoniae
atgtcagattgcattttttgtaaaatcatcgcaggggaaattcctgcttcaaaagtatatgaagatgagcaggtccttgcctttcttgatatctctcaagtaacactaggacacaccttggtcgtgccaaaagaacactatcgcaatcttttggagatgaatgctacgagcgccagccaactctttgcccaagtaccaaaagtagctcaaaaagtcatgaaagtcactaaggctgctggtatgaatatcatttccaactgtgaagaagtcgctggtcaaacagtttttcatactcacgttcaccttgtgcctcgctacagtgctgacgatgacctcaagattgattttatcgcccacgaaccagactttgacaaacttgctcaagtcgctgaaaccatcaaaaacgcttaa

SEQ ID NO: 1984 - DNA, 288 bp, Streptococcus pneumoniae
atgaaattatccaacctactgctatttgcaggagctgcagccggaagttatctggttacaaaaaatcgccaaaccatcacagatgaagtcttgaataccactgaccgcgttcaagctatcaaagacgatgtggatattatccaaaatagcctgcaaatcatcgaccagcaaaaagaacttatcaaggaataccaagaagacttgacttacaagtttaaggtcttggaaaaggatatccagactagactagctgtgataaaagaaatgcagggaactgaagataagtaa

SEQ ID NO: 1985 - DNA, 255 bp, Streptococcus pneumoniae
ttgttagagattactttaaaatcctcttatcaatttgttcatattctatttcaatctactatatatatcccatcaactatgcatcataatttaggtaactcatactcaataaaaatcaaaaagcaaactagaaagctaggcacagactgctcaaaacaccgttttaaggttgtggatagaactgacgaagtcagctcaaaacactgttttgaggttgtagatacgactcacatatatacgacaaggcaacgctga

SEQ ID NO: 1986 - DNA, 1137 bp, Streptococcus pneumoniae
atgaacaatactgaattttatgatcgtctgggggtatccaaaaacgcttcggcagacgaaatcaaaaaggcttatcgtaagctttccaaaaaatatcacccagatatcaacaaggagcctggtgctgaggacaagtacaaggaagttcaagaagcctatgagactttgagtgacgaccaaaaacgtgctgcctatgaccagtatggtgctgcaggcgccaatggtggttttggtggagctggtggtttcggcggtttcaatggggcaggtggcttcggtggttttgaggatattttctcaagtttcttcggcggaggcggttcttcgcgcaatccaaacgctcctcgccaaggagatgatctccagtatcgtgtcaatttgacctttgaagaagctatcttcggaactgagaaggaagttaagtatcatcgtgaagctggctgtcgtacatgtaatggatctggtgctaagccagggacaagtccagtcacttgtggacgctgtcatggcgctggtgtcattaacgtcgatacgcagactcctcttggtatgatgcgtcgccaagtaacctgtgatgtctgtcacggtcgaggaaaagaaatcaaatatccatgtacaacctgtcatggaacaggtcatgagaaacaagctcatagcgtacatgtgaaaatccctgctggtgtggaaacaggtcaacaaattcgcctcgctggtcaaggtgaagcaggctttaacggtggaccttatggtgacttgtatgtagtagtttctgtggaagctagtgacaagtttgaacgtgaaggaacgactatcttctacaatctcaacctcaactttgtccaagcggctcttggtgatacagtagatattccaactgttcacggtgatgttgaattggttattccagagggaactcagactggtaagaaattccgcctacgtagtaagggggcaccgagccttcgtggcggtgcagttggtgaccaatacgttactgttaatgtcgtaacaccgacaggcttgaacgaccgccaaaaagtagccttgaaagaattcgcggctgctggtggcttgaaagtaaatccaaagaaaaaaggcttctttgaccatattaaagatgcctttgatggagaatga

SEQ ID NO: 1987 - DNA, 141 bp, Streptococcus pneumoniae
ttgcgcgaagaaccgcctccgccgaagaaacttgagaaaatatcctcaaaaccaccgaagccacctgccccattgaaaccgccgaaaccaccagctccaccaaaaccaccattggcgcctgcagcaccatactggtcatag

SEQ ID NO: 1988 - DNA, 357 bp, Streptococcus pneumoniae
atgagtgtattggatgaagagtatctaaaaaatacacgaaaagtttataatgatttttgtaatcaagctgataactatagaacatcaaaagattttattgataatattccaatagaatatttagctagatatagagaaattatattagctgagcatgatagttgtgtcaaaaatgatgaagcggtaaggaattttgttacctcagtattgttgtctgcatttgtatcggcgatggtatcagctatgatatcattagaaatacaaacatataaatttgtaataccgttcataattggtatgatttggacagtagttgtatttcttatgatcaattggaattatataggcaaatactaa

SEQ ID NO: 1989 - DNA, 258 bp, Streptococcus pneumoniae
ttgatcataagaaatacaactactgtccaaatcataccaattatgaacggtattacaaatttatatgtttgtatttctaatgatatcatagctgataccatcgccgatacaaatgcagacaacaatactgaggtaacaaaattccttaccgcttcatcatttttgacacaactatcatgctcagctaatataatttctctatatctagctaaatattctattggaatattatcaataaaatcttttgatgttctatag

SEQ ID NO: 1990 - DNA, 1824 bp, Streptococcus pneumoniae
atgtctaaaattatcggtattgacttaggtacaacaaactcagcagttgcagttcttgaaggaactgaaagcaaaatcatcgcaaacccagaaggaaaccgcacaactccatctgtagtctcattcaaaaacggagaaatcatcgttggtgatgctgcaaaacgtcaagcagttacaaacccagatacagttatctctatcaaatctaagatgggaacttctgaaaaagtttctgcaaatggaaaagaatacactccacaagaaatctcagctatgatccttcaatacttgaaaggctacgctgaagactaccttggtgagaaagtaaccaaagctgttatcacagttccggcttacttcaacgacgctcaacgtcaagcaacaaaagacgctggtaaaattgctggtcttgaagtagaacgtattgttaacgaaccaactgcagcagctcttgcttatggtttggacaagactgacaaagaagaaaaaatcttggtatttgaccttggtggtggtacattcgacgtctctatccttgaattgggtgacggtgtcttcgacgtattgtcaactgcaggggacaacaaacttggtggtgacgactttgaccaaaaaatcattgaccacttggtagcagaattcaagaaagaaaacggtatcgacttgtctactgacaagatggcaatgcaacgtttgaaagatgcggctgaaaaagcgaagaaagacctttctggtgtaacttcaacacaaatcagcttgccatttatcactgcaggtgaggctggacctcttcacttggaaatgactttaactcgtgcgaaatttgatgatttgactcgtgaccttgttgaacgtacaaaagttccagttcgtcaagccctttcagatgcaggtttgagcttgtcagaaatcgacgaagttatccttgttggtggttcaactcgtatccctgccgttgttgaagctgttaaagctgaaactggtaaagaaccaaacaaatcagtaaaccctgatgaagtagttgctatgggtgcggctatccaaggtggtgtgattactggtgatgtcaaggatgttgtccttcttgatgtaacgccattgtcacttggtatcgaaacaatgggtggagtatttacaaaacttatcgatcgcaacactacaatcccaacatctaaatcacaagtcttctcaacagcagcagacaaccaaccagccgttgatatccacgttcttcaaggtgaacgcccaatggcagcagataacaagactcttggacgcttccaattgactgatatcccagctgcacctcgtggaattcctcaaatcgaagtaacatttgacatcgacaagaacggtatcgtgtctgttaaggccaaagaccttggaactcaaaaagaacaaactattgtcatccaatcgaactcaggtttgactgacgaagaaatcgaccgcatgatgaaagatgcagaagcaaacgctgaatccgataagaaacgtaaagaagaagtagaccttcgtaatgaagtggaccaagcaatctttgcgactgaaaagacaatcaaggaaactgaaggtaaaggcttcgacgcagaacgtgacgctgcccaagctgcccttgatgaccttaagaaagctcaagaagacaacaacttggacgacatgaaagcaaaacttgaagcattgaacgaaaaagctcaaggacttgctgttaaactctacgaacaagccgcagcagcgcaacaagctcaagaaggagcagaaggcgcacaagcaacaggaaacgcaggcgatgacgtcgtagacggagagtttacggaaaagtaa

SEQ ID NO: 1991 - DNA, 360 bp, Streptococcus pneumoniae
agaacgtggatatcaacggctggttggttgtctgctgctgttgagaagacttgtgatttagatgttgggattgtagtgttgcgatcgataagttttgtaaatactccacccattgtttcgataccaagtgacaatggcgttacatcaagaaggacaacatccttgacatcaccagtaatcacaccaccttggatagccgcacccatagcaactacttcatcagggtttactgatttgtttggttctttaccagtttcagctttaacagcttcaacaacggcagggatacgagttgaaccaccaacaaggataacttcgtcgatttctgacaagctcaaacctgcatctgaaagggcttga

SEQ ID NO: 1992 - DNA, 654 bp, Streptococcus pneumoniae
ttgtatcttagttatacaccactaccattgctgggcgtaggatgcggtcatggagtttgtagcctttttgaaagacttgggcgatggtatctactgggtgttcatcgtctgctgggagagtttggatggccatatggtagttatggtcaaattcgccatctgctgcgatttcttcaattccttcttctttcaaagcgtgaatcaagctttcttgcaccatccccaagcccttcttcacatcatctgtcaaaccttcaactgcaagtgcacgctcaaggttgtcaagagatggtaagattgcttttgccaagtcctggctacgataacgttgcaagttttgacgttcttcattggcacggcgttggatattttgcatttctgcatgagcgcgaagatatttgttttcgaactcatctgcacgttcatttgccaagtccaactcagacttttcaggagttgtttcttcagctgtttccacaacttcctcttcttgaacttcttctacttcttcattttttatatcttgggccatgttcgcctcctttaatgatttcaatcttaatgtacttcataatgattactgctgaggtagcggtaaaaatctgtcaacttcatggtcaaaacacggttgaccacattgacttgattgattag

SEQ ID NO: 1993 - DNA, 549 bp, Streptococcus pneumoniae
ttgaaatcattaaaggaggcgaacatggcccaagatataaaaaatgaagaagtagaagaagttcaagaagaggaagttgtggaaacagctgaagaaacaactcctgaaaagtctgagttggacttggcaaatgaacgtgcagatgagttcgaaaacaaatatcttcgcgctcatgcagaaatgcaaaatatccaacgccgtgccaatgaagaacgtcaaaacttgcaacgttatcgtagccaggacttggcaaaagcaatcttaccatctcttgacaaccttgagcgtgcacttgcagttgaaggtttgacagatgatgtgaagaagggcttggggatggtgcaagaaagcttgattcacgctttgaaagaagaaggaattgaagaaatcgcagcagatggcgaatttgaccataactaccatatggccatccaaactctcccagcagacgatgaacacccagtagataccatcgcccaagtctttcaaaaaggctacaaactccatgaccgcatcctacgcccagcaatggtagtggtgtataactaa

SEQ ID NO: 1994 - DNA, 1068 bp, Streptococcus pneumoniae
gtgctaattgatcagacagagaggagtgatgagatggttacagagcgtcagcaggatattttaaatctgattattgacatctttaccaaaacgcacgaacctgtcggatcaaaagccttgcaagagtctattaactctagcagtgcaaccattcgtaatgacatggcggaactagaaaaacaagggttgcttgagaaggctcatacttcaagcggtcggatgccaagtgttgctggttttcagtactatgtgaaacactcactggattttgaccggctggctgaaaatgaggtatatgagattgtcaaagcctttgatcaggaattcttcaaattggaggatattctgcaagaggctgctaacttgctaacagacctgagtggctgtacggtagtggcactggatgttgagccgagcaggcaacgtttgacagcctttgatatcgttgttttggggcaacatacagccttggcggtatttaccctagacgagtcgcgaacggttactagtcagtttctgattccaaggaacttcttgcaggaggatttgctgaaactgaagagcatcattcaggaacgtttcctcggtcacaccgttttagatattcactacaagattcggacggagattccgcagattatccagcgttactttacaacaacggataatgtcatcgatctctttgaacacatctttaaggaaatgttcaacgaaaacattgtgatggcgggcaaggtcaatctcttgaattttgccaatctagcagcctatcagttctttgaccaaccgcaaaaggtggccttggagattcgtgaggggttgcgtgaggatcagatgcaaaatgttcgtgttgcagacggtcaagagtcctgtttagctgacctagcggtgattagtagtaagttcctcattccttatcggggagttggaattctagccattaccggtccagttaatctggattaccaacagctaatcaatcaagtcaatgtggtcaaccgtgttttgaccatgaagttgacagatttttaccgctacctcagcagtaatcattatgaagtacattaa

SEQ ID NO: 1995 - DNA, 510 bp, Streptococcus pneumoniae
atgaatagcagagtagaatttcggattttcactattgttgatttggacaaggaagaagaatatttacatgagatgcatttgaaaggttggaggtatagaacgagtcgttttggtttgttctattttgaccaatgtcaaccagacgatgtcatctaccgtatctatgattctagatttcttaaaaaatataagcatgaactgcaagattttagagatagaggttgggaattgataggagcaggttcttgttcgattcttcgtaaatcgtcttctgatttacttccagaggatcaagtctatatgagtaaggggctcaaatgggaagttatgcgatctagacttcgttcctgtacaactactttcttaggtggtcttgttgtttgtacgagtttgtttagagaggatctttctatgtctttctttcttatttttgttttatatgcttttctgatttcttatctaattcatggttatttcagactaaaaaggaaataccgagtagatgaatag

SEQ ID NO: 1996 - DNA, 2334 bp, Streptococcus pneumoniae
atggttgagtttataaagtctaagaaagaaatgagtgaggaggatattaaagcaaatttcatcactcctgctattgtatccaaaggatggaaaaatggtgagcatatcgcttacgaagaatacttcactgatggtcgaattgaggttagaggagataaggctcgtcgtaaagaaggaaaaaaatcagactattcactgtattaccaatttggaactcgaattgcaattgttgaggcaaaggataataaacacagcgttcgagcaggattacaacaagctattgaatatggagagattttagatgttccatttgtttattcttcgaatggtgatggctttattgaacacgaccgtatcacgagagaagaacgtgagctggagttagacgaattccctactcgtgaagaattattttctcgtatgacgaaggaaaaaggattgacgtacgaaattacagaagctatctcaactccatactatacagacgccttctcaatgaaaacgccacgctattatcagcaaatagctatcaaccgtactattgaaacagttgccagaggacaaaaacgagtaatgtttgtgatggcaacaggaacggggaaaacgttcatggcttttcaaattattcatcgccttcgaaaagctggtttggctaaacgagttttattcttagcggatagaaacatcttagtagaccaaacgatggctgaagactttaggccattcgaaaaggtaatgacgaaaattacaccaaaacttttgactgctcctgaaaaattaaattcttttgaaatttatctagggctttatcagcaactaactggtgaagatggaactgaaacacattatcaaaaatttgacaaagacttctttgatttaatcgtaattgatgaagcgcaccgtggttcagctaaggaaaacagtaactggcgtaagataattgattatttcagttctgcgacacagattgggatgaccgctactcctaaagaaaccaagaatgcttccaatacggaatactttggtgagccaatctatacttatagtttaaaacagggaatcgaggatggttttttggctccatatcgtgttatgagagttaatttagatgtagatgtggatggttatcgtccagaaactggaaaagttgatgctaacggacaattaatagaagataggtactacggcaggaaagattttgataaaaccattgtcattgatgatagaacgcaaagagttgccaagtttgtttctgattatatgaagcaaaacaatgcacgatttgataaaacaattgttttttgtgttgatattgaccatgccgagcgaatgcgtgctgcacttgtaaaagagaatctagacttagtccaagaagactatcgttatgtcatgcaagtaactggtgacaacgctgaaggaaaagctcaactggataactttatggatgtcaattctaattttcccgctattgtaacaacgtctaaattattaacgacaggagttaatgctaaaacatgtcgtttgattgttttagactctaatatccaatccatgactgaatttaaacaaattattggtcgtggcacacgtctttatcctcaaaaggggaaagaattttttacgattattgattttcgaaatgttaccaatttgtttgctgaccctgattttgatggtgatccagtgaaggtgctggaaacaggtgcgaaaacagtcagtggttctacgcccggtttcgtaggtgaggaaggtgacccagtagaaaaatatatcgttacagacaagcaggttaccattcttaattctactgttcaagtattggatgaaaacgggaaactgattaccgaaagcctgaccgactacactcgaaagaatatcttaggtagctacgccactttgaacgattttatcacagtttggcatacggcagataaaaagaagcttatcttagacgaactttataaaaaaggagtttatctagatgctattcgagagtcggagggaatatcagaacaagaaatcgatgattttgatttactcctaaaacttgcctatggtcaaaaagaattaaccaaaacggaacgtatcaataaactcaaacaaagcggatatttatataaatatagtgaggaagcgcgtgctgttttggaaattttactgaacaaatacatggataaaggtattggagaactcgaaagcattgaaacattaaaacttccagaatttcagatatatggtggaaccttcaaaatcatcaatacttattttggagataaaaaacgatatttacaagcaattaaagaattggagcaagagctatttacagtagcttaa

SEQ ID NO: 1997 - DNA, 1464 bp, Streptococcus pneumoniae
atgtcaattacatcatttgtaaaaagaattcaagatatcactcgaaacgatgctggtgttaatggtgatgctcaacgtattgagcaaatgtcttggttattattcttaaaaatttatgatagccgtgaaatggtttgggaattagaagaagacgagtatgagtcaattatcccagaggaattaaaatggcgaaattgggctcatgctcaaaatggggaacgggtattgacaggcgatgaattacttgattttgtcaataacaagttattcaaagagttgaaagagcttgaaataacttcaaatatgcctattcgaaaaacgattgttaaatcagcttttgaagatgcgaacaactatatgaaaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttgacttcgactctgaaccgtttaagtagtcaacgtaaaactagtgaagataccaaaaaatataatacagctgtttttggtattgaaaagaaagcatttcctcatcttttagcagttacaaatctgtttcttcacgaaattgatgaccctaaaattgttcatggaaatactttggagaaaaatgttcgtgaatatacggatgatgaaaaatttgacattattatgatgaatccaccttttggagggtcagaattagaaacaataaaaaataactttccagcagaattacggagttctgaaacagctgatttatttatggctgtcattatgtatcgtttgaaagaaaatggtcgtgttggagttattttacctgatggttttctatttggtgaaggtgtaaaaactcgcttgaaacaaaaactggtagatgagttcaacttacatacgattattaggttgcctcatagtgtctttgcaccgtatacaggaatccatacgaacattcttttctttgataaaacaaagaaaacagaagaaacttggttttatcgtttagatatgccagatggttataaaaatttctcgaaaactaagccgatgaagtcagaacacttcaatcctgttcgtgactggtgggaaaatcgtgaagagattctggaaggtaagttctacaaatctaaatcatttacacctagtgaattggctgagttgaattataatttagaccagtgtggctttccaaaagaggaagaggaaatcttaaatccctttgagttgattcagaattatcaagcggaaagagcaactttaaatcataagattgataatgtattagctgatattttgcagttgttggaggacaaataa

SEQ ID NO: 1998 - DNA, 1551 bp, Streptococcus pneumoniae
atgacaccagaacaacttaaagcaagtattctccaaagagcgatggaagggaaattagtgccgcaaaatcccaatgacgaacctgcaagtgaattattaaagagaattaaagctgaaaaagaaaaacttatcagtgaaggaaaaatcaaacgagataaaaaggaaactgagatatttcgtggtgatgatgggaaacattatgggaagtttgctgatggaagtactcaagaaattgatgttccttatgatattcctgatacttgggagtgggtgaggataaaatcaatttattggaattttgggcaaaataagccagagaaatcctttaggtatatagatacgtctagtattgatagaaaaaagaacataatcaactacaaaaatctacaatatctttcacctgaacaagcgccttcccgtgccagaaaattagtttcgcagaatagtgtcttattttcaacagttagaccatatctaaaaaatattgctgtagttagagaacttaaagagtatttgatagctagtacagcatttattgttttggatactttacttaacgaaacatatttgaaatattatttattatcagataattttatcaatcgtgttaataataaatctactggaacaagttatcctgcaatcaatgattataattttaatctattattaattgctctccccccactatccgaacaacaacgaatagtagaagcaatcgaatcagctttagaaaaagtagatgaatatgctgaaagttataatagactagaacagctagataaagaatttccagataaactaaaaaaatctattcttcaatatgctatgcaaggaaaattagttgaacaagacccaaatgatgaatcagtcgaagttttacttgaaaaaatacgagcagaaaaacaaaaactctttgaagaaggcaagattaaaaagaaagatttggacatttctattgtttcccaaggagatgataactcttattatgggaacaaagacgaaacaacctcttatcctatatataaaatcccagaagcatggagatatattaaatttgctagcctagttaacttcagaataggaaaaactcctccacgcagtgaagctactttttggggaactgaaataccttgggtatctatatcagatatgcctatatctggttatgtaactaatacgagagaatctatttctaaattagcattaaaatcaaagaaaatagacatttcacctaaaggaactttattaatgagttttaaattatctattggaaaagttgccatattggatattcctgccactcataatgaagccattatatcgatattcccctatgctaataaagaaaatattatcagagattacttaatgatatttttgccacttatctctactttaggtgattcaaaagatgctatcacagggaaaacattaaatagtaccagtatctccgaattattaatccctatttctaatcatgaagagatgaaaagaatcattttcaaagttgatttactttttcaaaaagtttctcaactttttgagtaa

SEQ ID NO: 1999 - DNA, 1290 bp, Streptococcus pneumoniae
gtgaggttttctacattggttgaaattgtcagaggtggctctccacgaccaatcaaagattatcttacttctgaagtagatggaataaattggataaaaataggtgatactgaaaagggtgaaaagtatataaataatgttaaagaaaaaatcaaaaaatcagggcttaacaaaactagatttgtaaaaaaaggtacatttttgttaactaattctatgagttttggtagaccttatattttgaatgttgatggtgcaatacacgatggatggttggctatttcgaactatgaaaactcattaaataaagattacctattctatattctttcatcaaatgtagtttattctcaatttctatctctaattagtggagctgttgtgaaaaacttgaatagtgataaagttgcttctattcttatccctctccccccactatccgaacaacaacgcataatagaagcaatcgaatcagctttagaaaaagtagatgaatatgctgaaagttataatagactagaacagctagataaagaatttccagataaactaaaaaaatctattcttcaatatgctatgcaaggaaaattagttgaacaagacccaaatgatgaatcagtcgaagttttacttgaaaaaatacgagcagaaaaacaaaaactctttgaagaaggcaagattaaaaagaaagatttggacatttctattgtttcccaaggagatgataactcttattatgggaatatacctatgaattgggttgttataaaaataaaagatattttttcaatgaatacaggtctttcttacaagaagggcgatttaagcattaataataaaggtgttagaattatacgtggtggtaatattaagcctttagaattttctctgttggataatgattactacattgatacacaattcatctcctctgaacaagtttatttaaaacataatcagctaataacacctgtatcaacctctttagaacatattggaaagtttgcaagaatcgataaagactatgatggtgttgtggctggtggatttattttccaattaacaccattcgaaagttcagagattatttcaaaatttctattatttaacttgtcttctccgttattttataaacaattgaaagcaataactaaactatcaggtcaagctttatataatattcctaaaactacactgagcgagctattaattccgttagctccttttgaggaacaggaacttattactcaaaaagttgagaaactttttgaaaaagtaaatcaactttga

SEQ ID NO: 2000 - DNA, 222 bp, Streptococcus pneumoniae
tcgatttgtttacatcttatttcaatctactatattatctcaataaatgatgatggcgactgttttgtttgtgcttgtcgatttttgaatcctgatcgagcggaagaatatttctgccgaggttgccaaggggaaaatcctgaagatattgaattttatgatgaacaattacaggcagaaaaggtggaggttttgaatattcgattggaagtaaaaaattga

SEQ ID NO: 2001 - DNA, 1347 bp, Streptococcus pneumoniae
atgccaatcacagctgcagatattcgtcgtgaagtcaaggaaaaaaatgttacctttattcgtcttatgttctcagatattttgggaaccatgaaaaacgtcgaaattcctgctacagatgaacagttagataaggtcttgtcgaacaaggttatgtttgatggatcttctattgaaggttttgtacgtatcaatgagtcggatatgtacttgtacccggacttggatacatggacagtcttcccttggggagatgaaaatggaagtgttgcaggtctgatctgtgatgtctatacaacagaaggtgaaccatttgcgggtgaccctcgtggtaatttgaaacgagctcttcgtcacatggaagaagttggattcaaatccttcaaccttggtccagagccagaattcttcctatttaagttggatgaaaatggggacccaacacttgaagtgaatgacaagggtggctactttgatttggcacctactgaccttgcggacaacacacgtcgtgagattgtgaatgtcttgaccaaaatgggatttgaagtagaagcgagtcaccacgaggttgcggttggacagcatgagattgactttaagtacgatgaagttctccgtgcttgtgataagattcaaatctttaagcttgttgttaaaaccattgctcgcaaacacggactttacgcaacatttatggcgaagccaaaatttggtattgctggatcaggtatgcactgtaatatgtccttgtttgatgcagaaggaaataacgccttctttgatccaaatgatccaaaaggaatgcagttgtcagaaacagcttaccatttcctaggcggtttgatcaagcatgcttacaactatactgccatcatgaacccaacagttaactcatacaaacgtttggttccaggttatgaagcgcctgtttacattgcttgggctggtcgtaaccgttcgccacttgtgcgcgtacctgcttcacgtggtatgggaactcgtcttgagttgcgttcagtggatccaatggcgaacccttacgttgctatggctgttcttttggaagttggtttgtatggtattgaaaataaaatcgaagcaccagctcctatcgaagaaaatatctacatcatgacagcagaagagcgcaaggaagctggtattacagaccttccatcaactcttcacaacgctttgaaagctttgacagaagatgaagtggttaaagctgctctcggagatcacatctatactagcttccttgaagccaaacgaatcgaatgggcaagttatgcaaccttcgtttcacaatgggaaattgataattatttagacctttactaa

SEQ ID NO: 2002 - DNA, 357 bp, Streptococcus pneumoniae
atgaaggaaaaagaatttcgccgaaatatggctgtttttcctatcggcagtgttatgaagttgaccgatctatcggcgcgtcagattcgttattatgaagatcaagagttgatcaagcccgatcgaaacgaaggaaatcgtcgcatgtattccttgaatgacatggatcgtctgcttgaaatcaaagattatatctctgaaggttataatatcgctgccattaagaaaaaatatgctgaacgtgaagcgaaatccaagaaagcggttagtcagactgaagtacgtcgtgcacttcacaatgaactcctccaacaggggcgttttgcttcagtacagtcaccttttggtcgcggttag

SEQ ID NO: 2003 - DNA, 528 bp, Streptococcus pneumoniae
atgagttattttaaaaaatataaattcgataaatcccagttcaaacttggtatgcgaacctttaaaacaggtattgctgtttttctagttctcttgatttttggcttttttggctggaaaggtcttcaaattggtgctttgacagccgtttttagcctgagggagagttttgatgagagtgttcattttgggacttcgcgtattctaggaaatagtatcggtggactctatgccttggtcttcttcttattaaatacttttttccacgaagccttttgggtgaccttggtagttgttccaatctgcaccatgttaaccattatgacaaatgtagccatgaataacaaagcaggggttattggtggtgtagcagctatgttaatcattaccctatcaattccaagtggcgagacaattttgtacgtgtttgtgcgtgtattagaaacgtttatgggagtttttgtcgcaattatcgtaaattacgatattgatcgtattcgtctctttttagagaaaaaagaaaaataa

SEQ ID NO: 2004 - DNA, 378 bp, Streptococcus pneumoniae
ttgtttataaaatcttatttttctgtcaaggctgcaagtcctggaagaaccttaccttcaagaagttccattgatgctccaccacccgtactaatccatgagaacttgtctgcacggccaaggttaatcgctgcggcagctgagtcaccaccaccgatgattgatttaactcctggttgtttcacgatagcgtccatcacaccgattgtaccagcttggaaatctgggttttcaaatacacccataggtccgttccatacaactgttttggcaccagtcaaagcttcgtcaaatttggcgatagattttggaccgatgtcaagaccaaggaagccttcagaaactgcttcaccttcagtgtcacgcacttcagtgtaa

SEQ ID NO: 2005 - DNA, 1197 bp, Streptococcus pneumoniae
atggcaaaacttactgttaaagacgttgacttgaaaggtaaaaaagtcctcgttcgtgttgacttcaacgtaccattgaaagatggcgtaatcactaacgataaccgtatcacagcagctcttccaactattaagtacatcatcgaacaaggtggacgtgcaattcttttctctcaccttggacgtgtgaaagaagaagctgataaagctggtaaatcacttgctcctgtagcagcagacttggcagcaaaacttggtcaagatgttgttttcccaggtgtcactcgtggtgctgaattggaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaaactccagaacgtccattcgtggctatccttggtggttcaaaagtttcagacaagatcggtgttatcgaaaacttgcttgaaaaagctgataaagtccttatcggtggtgggatgacttacacattctacaaagcacaaggtatcgaaatcggtaactcacttgtagaagaagacaaattggatgttgcgaaagctcttcttgaaaaagcaaatggtaaattgatcttgccagttgactcaaaagaagctaacgcatttgctggttacactgaagtgcgtgacactgaaggtgaagcagtttctgaaggcttccttggtcttgacatcggtccaaaatctatcgccaaatttgacgaagctttgactggtgccaaaacagttgtatggaacggacctatgggtgtatttgaaaacccagatttccaagctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccaggacttgcagccttgacagaaaaataa

SEQ ID NO: 2006 - DNA, 4941 bp, Streptococcus pneumoniae
atgaagaatccattttttgaaagacgttgtcgttgcagtattcgtaagttatcagtaggagcctgctcgctgatgattggtgctgttttatttgctggtccagccttggctgaagaaactgcagttcctgaaaatagcggagctaatacagagcttgtttcaggagagagtgagcattcgaccaatgaagctgataagcagaatgaaggggaacatactagagaaaacaagctagaaaaggcagaaggagtagcgacagcatctgaaactgcagaagcagctagcgcagctaaaccagaggaaaaagcaagtgaggtggttgcagaaacaccatctgcagaagcaaaacctaagtctgacaaggaaacagaagcaaagcccgaagcaactaaccaaggggatgagtctaagccagcagccgaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcggatctgttgtcctcgcttcacgtcggacaggtcatttagtcaatgaaaaagctagcaaggaagcaaaagttcaagccttatcaaacaccaattctaaagcaaaagaccatgcttctgttggtggagaagagttcaaggcctatgcttttgactattggcaatatctagattcaatggtcttctgggaaggtctcgtaccaactcctgacgttattgatgcaggtcaccgtaacggggttcctgtatacggtacactcttcttcaactggtctaatagtattgcagatcaagaaagatttgctgaagctttgaagcaagacgcagatggtagcttcccaattgcccgtaaattggtagacatggccaagtattatggctatgatggctatttcatcaaccaagaaacaactggagatttggttaaacctcttggagaaaagatgcgccagtttatgctctatagcaaggaatatgctgctaaggtaaaccatccaatcaagtattcttggtacgatgccatgacctataactatggacgttaccatcaagatggtttgggagaatacaactaccaattcatgcaaccagaaggagataaggttccggcagataacttctttgctaactttaactgggataaggctaaaaatgattacactattgcaactgccaactggattggtcgtaatccttatgatgtatttgcaggtttggaattgcaacagggtggttcctacaagacaaaggttaagtggaatgacattttagacgaaaatgggaaattgcgcctttctcttggtttatttgccccagataccattacaagtttaggaaaaactggtgaagattatcataaaaatgaagatatcttctttacaggttatcaaggagaccctactggccaaaaaccaggtgacaaagattggtatggtattgctaacctagttgcggaccgtacgccagcggtaggtaatacttttactacttcttttaatacaggtcatggtaaaaaatggttcgtagatggtaaggtttctaaggattctgagtggaattatcgttcagtatcaggtgttcttccaacatggcgctggtggcagacttcaacaggggaaaaacttcgtgcagaatatgattttacagatgcctataatggcggaaattcccttaaattctctggtgatgtagccggtaagacagatcaggatgtgagactttattctactaagttagaagtaactgagaagaccaaacttcgtgttgcccacaagggaggaaaaggttctaaagtttatatggcattctctacaacttcagactacaaattcgatgatgcagatgcatggaaagagctaaccctttctgacaactggacaaatgaagaatttgatctcagctcactagcaggtaaaaccatctatgcagtcaaactatttttcgagcatgaaggtgctgtaaaagattatcagttcaacctaggacaattaactatctcggacaatcaccaagagccacaatcgccgacaagcttttctgtagtgaaacaatctcttaaaaatgcccaagaagcggaagcagttgtgcaatttaaaggcaacaaggatgcagatttctatgaagtttatgaaaaagatggagacagctggaaattactaactggctcatcttctacaactatttatctaccaaaagttagccgctcagcaagtgctcagggtacaactcaagaactgaaggttgtagcagtcggtaaaaatggagttcgttcagaagctgcaaccacaacctttgattggggtatgactgtaaaagataccagcctaccaaaaccactagctgaaaatatcgttccaggtgcaacagttattgatagtactttccctaagactgaaggtggagaaggtattgaaggtatgttgaacggtaccattactagcttgtcagataaatggtcttcagctcagttgagtggtagtgtggatattcgtttgaccaagccacgtaccgttgttagatgggtcatggatcatgcaggggctggtggtgagtctgttaacgatggcttgatgaacaccaaagactttgacctttattataaagatgcagatggtgagtggaagctagctaaggaagtccgtggcaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtacaggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcgttaccaaggtcatgaattcaattttgatgttttggtatctccaaaagcagcattgaacgatgagtacctcaaacaaaaattagcagaagttgaagctgctaagaacaaggtggtctataactttgcttcaccagaagtaaaagcagctttcttgaaagcaattgaagcggccgaacaagtgttgaaagaccatgaaactagcacccaagatcaagtcaatgaccgacttaataaattgacagaagctcataaagctctgaatggtcaagagaaatttaaggaagaaaagacagaacttgatcgcttaacaggtgaggttcaagaactcttggctgccaaaccaaaccatccttcaggttctgccctagctccgcttcttgagaaaaacaaggccttggttgaaaaagtagatttgagtccagaagagcttgcaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttacgcttctattgtgaaaatcccaattgaaaaagataagaaagttaagaaagtatttttcttacctgaaggcaaagaggcagtagaattggcttttgaacaaacggatagtcatgttatctttacagcaccacactttactcattatgcctttgtttatgaatctgctgaaaaaccacaacctgctaaaccagcaccacaaaacaaagtccttccaaaacctacttatcaaccggcttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagataaagattaa

SEQ ID NO: 2007 - DNA, 513 bp, Streptococcus pneumoniae
ttgatttcctttggttttaatgttttttctgtatttttagggacatctggctggacttctttttcagtcttattagcttcggctgctggcttagactcatccccttggttagttgcttcgggctttgcttctgtttccttgtcagacttaggttttgcttctgcagatggtgtttctgcaaccacctcacttgctttttcctctggtttagctgcgctagctgcttctgcagtttcagatgctgtcgctactccttctgccttttctagcttgttttctctagtatgttccccttcattctgcttatcagcttcattggtcgaatgctcactctctcctgaaacaagctctgtattagctccgctattttcaggaactgcagtttcttcagccaaggctggaccagcaaataaaacagcaccaatcatcagcgagcaggctcctactgataacttacgaatactgcaacgacaacgtctttcaaaaaatggattcttcattttctcctcctaa

SEQ ID NO: 2008 - DNA, 1632 bp, Streptococcus pneumoniae
atgtccattaattggcaggaaattttatttcactttttaggtggtctggggctattcttatatagtatcaagaccatgggagacggtttacaacaagctgctggagatcgccttcgtttttacattgacaaatatactagtaatcctttctttggagttctggttggtattgggatgactgctctaattcagtctagttctggtgtaacagttatcacagtcggcctggtcagtgccggtctcttaaccttacgtcaggctatcgggattgtcatgggtgctaatattgggacaactgtcacatcctttctcatcggttttaaattaggtaactatgccctacctatgctctttatcggtgccgtctgtctcttttttacaaaaaatcggacagtcaataatatcggacgcatcctctttggtgtcggtggtatcttttttgccctcaatctcatgagcggcgcaatggctccactcaaggatttacaggtctttaaggactatatgattgagctaagtaaaaatcctgttttgggtgtctttgtcggtactggcttgaccttgctaattcaagcttcttcggctaccattgggattttacaaaacctctacgccggcaatctaattgacctacagggagctttgccggttctatttggtgacaatatcgggacaaccattacagccatcattgcctctttaggggctaatattgcagctaaacgggtagcaggagctcatgttgccttcaacgttatcggaacagtcgtctgcgttatttttctagttccttttactgtcctgattcattggtttgaagctacgctaaatctagcaccggaaatgaccatcgcctttgctcacggaacctttaatattaccaacaccattgtccaatttccatttatcggagctctggcttactttgtaaccaagattattcctggagaggacgaggttgtcaaatacgaacccttatatcttgatgaacatttcatcaaacaggccccatctatcgctctaggaaatgctaagaaagagctcttgcacttaggaaactacgctgctaaagcctttgacctttcctataagtacatcattgacttggatgaaaaagttgctgaaaaagggcataaaaccgaagaagcaattaacaccatcgatgagcaattaacacgttatctcattgccctttcaagcgaagctctcagccaaaaagaaagtgaagtgcttaccaatatccttgattcctcccgtgatttggaacggattggagaccacacggaggctctactcaatctgactgactatcttcaacggaaaaatgttgaattttctgatgccgccttgaaagaattagaggaagtttaccgccaaactagtgactttatcaaagatgctctggatagtgtggaaaacaatgatattgaaaaagcacgcagtcttgtagaacgtcatgaagcaatcaataagatagaacgtgttctcagaaaaacccacatcaaacgcctcaacaaaggcgaatgttcaacacaagctggggtcaactttatcgacatcatctcacactacactcgtgtatcagaccacgctatgaaccttgctgaaaaggtttttgcagaacaaatctaa

SEQ ID NO: 2009 - DNA, 1608 bp, Streptococcus pneumoniae
atgtctacgaaatatatttttgtaactggtggtgtggtatcgtctattgggaaagggattgtggcagcgagtctaggccgtctcttgaaaaatcgtggtctcaaagtaaccattcaaaagtttgacccttatatcaatattgatccgggaaccatgagtccttaccagcacggggaagtttttgtgacagatgacggagctgagacagatttggacttgggtcactatgaacgtttcatcgatatcaatctcaacaaatattccaacgtgacaactgggaaaatttatagtgaagttcttcgtaaagaacgccgtggagaataccttggggcaactgttcaagtcattcctcatatcacagatgctttgaaagaaaaaatcaagcgtgccgctctaacgaccgactctgatgtcattatcacagaggttggtggaacagtaggagatatcgagtccttgccattcctagaggctcttcgtcagatgaaggcagatgtgggtgcggataatgtcatgtatatccatacaaccttgcttccttacctcaaggctgctggtgaaatgaaaaccaaaccaacccaacactctgtcaaagaattgcgtggcttgggaatccaaccaaatatgttggttattcgtacagaagagccagctggtcaaggaattaaaaataaactggcccagttctgtgatgtggcaccagaagccgttatcgaatcgttggatgttgaacacctttaccaaattccactgaacttgcaggcacaagggatggaccaaattgtttgtgatcatttgaaattagacgcaccagcagcggatatgacagaatggtcagccatggtggacaaggtcatgaacctcaagaaacaagttaagatttcccttgttggtaagtatgtggagttgcaagatgcctatatctcagtggtcgaagccttgaaacactctggctatgtcaatgatgtagaagttaaaatcaattgggtcaatgccaatgatgtgacagcagagaatgtagcagaactcttgtctgatgcggacgggatcatcgtaccaggtggttttggtcaacgtggtacagaagggaaaatccaagccatccgctatgcgcgtgaaaatgatgttccaatgttgggagtctgcttgggaatgcagttgacatgtatcgagtttgctcgtcacgttttaggtcttgaaggtgccaattctgcagagcttgcaccagaaacaaaataccctatcattgatatcatgcgtgatcagattgatattgaggatatgggtggaacccttcgtttgggactttatccgtctaagttgaaacgtggctctaaggctgctgctgcttatcacaatcaagaagtggtgcaacgccgtcaccgtcaccgttatgagtttaataatgccttccgtgagcagtttgaggcagcaggttttgtcttttcaggagtttctccagacaatcgtttggtagaaatcgtggaaattcctgaaaataaattctttgtagcttgtcagtatcaccctgaactgtcaagccgtccaaaccgaccagaagaactctacactgcctttgttactgcagcggttgagaacagcaattag

SEQ ID NO: 2010 - DNA, 132 bp, Streptococcus pneumoniae
gtgttcctgactttgtcagtcttatctacaacctcaaaacagtgttttgagcagcctacggctagtttcctagcttgctctttgattttcattgagtataaaatacaagaagataacttcttgaaaaaataa

SEQ ID NO: 2011 - DNA, 588 bp, Streptococcus pneumoniae
ttggaattagaagtatttgctgggcaagaaaaaagtgaactatctatgattgaggtagcgcgtgctatcttggaacttcgtggtcgcgatcatgagatgcattttagcgatcttgtaaacgaaattcaaaactaccttggaacatcaaacagcgatatccgcgaagctttgcctttgttctacacagagttgaactttgacggtagcttcatctcacttggggacaacaaatggggtcttcgttcatggtatggtgtggacgaaatcgacgaagaaatcatcgctcttgaagaaaatgacgacgatgaagtagcaccaaaagctaagaaaaaacgtgtcaatgcctttatggatggtgattcagatgccattgactacaatgcagatgatccagaagacgaagatgcatacgaagcagatccagctctttcatacgatgatgaaaatccagatgatgaaaaaaatgaagtggaagcttatgatgcagaaatcaacgaaatcgctccagatgacttgggagaagatgtggatctcaacgaagacgacgacgagttttcagatgacgacgctgaaaccagcgaggaataa

SEQ ID NO: 2012 - DNA, 450 bp, Streptococcus pneumoniae
ttgtgttttgttccttattataaggtcaattattgtgaggaagcttttgcttggtatcagaatgtgaacttggtttacctcgtagatggggtgaagcttccttacagtcaagcgaccttgaaagccatgtattccaatttggatcggcatggtgagcttttttggattgaagtcaaggagaagggagaatggtttccaattggggatattacactatctcaggataatctccccattgtgattgggaattccgcttaccaacatcgaggacttggaaaaaagattctaagtgctttgattgaattggctcgagtaaaaggatggaaagaattgagagtcaaggaaatctacacctacaataatgcttctaggaggtgtttcaagtcgcttggatttgtggaaaatggagcaacagaaaaaggaaggagttttatattggaattagtctaa

SEQ ID NO: 2013 - DNA, 390 bp, Streptococcus pneumoniae
atgaaagtcaatatagcagatcttcatccgactcaactatatttatcagaaaagaagttgcaagatattcagatgctttaccagtcggcagaaacaatccaagtcgatccaatcagtattcttgcctttggagattgtttgctgattacagatgggcatcacagggcttatcaggctttattggcaggtcgggatacgatttctgctgagtgggatagagatggtggtgatgaactatatcatctctatgcgcaagcttgcgaggaaagaaagatttactctgtttttgatttagaagatcgtatcctagctcaagatgggtatgaagcaaaatggtataactggtgtgatggttttaatcaagcagcaactcttttgttgaaaaggtag

SEQ ID NO: 2014 - DNA, 651 bp, Streptococcus pneumoniae
atgaaagataaacaaacatttttaatgaagggcagttttgcccttttacttttcgttattcttggctatatggtcaaattttaccctgaaatgttggtcaattttgaccaatcgattcagactgccattcgaggagacttaccagattatttgactattctttttcgatccctcacacgtctgattgatatcccagtgattatcacttgggttgtcattacagcttttgtcttttatcgtaagcgatggaagatagaaagtttcttcatgctgggaaatctggctttggcaggtcttttaatcgtgacctttaaaaatatctaccagcgcccacgaccagctatcttacatctggtggaggagaagggattttccttcccaagtgggcattctctggctgtaaccttgatggtaggtactttgattgttattcttagtcagcggattaaagatccagtctggagaaaaatcgtacaaatcgtccttggcctctacctagtcagtgtgctggtatcaagagtctatctgggagttcattacccatcagacgtccttgccagtctctgtgtgggcttgggagtcctgtttatcgagtttcccttctatgacaagctccgcttccaatggcgatttaaaggcaaacagaagtga

SEQ ID NO: 2015 - DNA, 564 bp, Streptococcus pneumoniae
atgacaaacacacgtcgactttcgaccattgcaattttatcagccatctcatttgtgctgatgtactttgactttccgcttttaccagcggcatctttcctcaagatcgaatttagtatcttgccagtccttgtgggtctggtggtcatggatttgcctgctgctctaggagtgctcttgcttcgctcactattgaaattgcttcttaacagccaaggagtgaatacttacattggtttgccgatgaatatcgtagctttgggagtttttgtcatcgtatttgctttgatttggaaaaaggaacggacaacccttcgtttcctactaggctctctagctggaactgttggtttaaccttggccatgttggttctcaactatgtttatgctgttcctttgtacgctaagtttgctaactttgatattggaaaaattttgggactttccaactacctaatgaccatggtattaccttttaacttgattgagggtgtaatcttttccgtttcattctggttgttgtacgtccttttgaaaccaaccttaaaacactatgaaagataa

SEQ ID NO: 2016 - DNA, 219 bp, Streptococcus pneumoniae
ttggaaaggattcctctatctattctcactttttatatcccaaaagttccctcttactctattaaagaaaaacaaagcaagtggttacaatccggctataaatctatcaaaacagacaaagctattctttcgtcttctcccatccagactatactgtcggttgtggaatctcaccacatcagcttgcgctcgcggacttctttaaagagaaggaaatag

SEQ ID NO: 2017 - DNA, 468 bp, Streptococcus pneumoniae
atgacaaatcacattgtattatttgaacctcaaattccacaaaatacgggcaatatcgcgcgtacttgcgctgcgaccaattctcccctccacatcatcaagcctatgggctttcctattgatgaccgcaagatgaagcgggctggattggattactgggataagctagagatttatttttacgagagtttggaagatttcatatctcagatgaagggaaaactctatctgatttcgaaattcgcggaaaaagtctattctgaggtggatttatcgactgacgaggaccattattttctctttggacgtgaagacaagggcttacctgaagattttatgcgagaacattctgagaaggctctccgtattcccatgaatgatgaacattgtcgcagtcttaatgtgtctaataccgtctgcatgattgtctatgaagctcttttccagcagaacttttgcaggtcttga

SEQ ID NO: 2018 - DNA, 831 bp, Streptococcus pneumoniae
atgcaagctaaattaatcggttaccagcatagagatactgtgattcatcgcttgtcaggagctgggaaacttctctttttcattctggtatcattggcggccatgattagctatgataccagaatgctcttgctgattgccatcttttcagtctttctcctctatttatcagaaattcgctttaaagatgtttcctttgtagccgtttttgcgacggtatttgccgttttaaacgttttgatggtctatcgcttttctcccgagtatggggttggactttatggagagagaagtgtgatttggcagggaatcggtgtctacactctaaccagccaggagctcttttatctgctaaatttggccattaagtatctttgcaccattcctctggctattatctttttgatgacaacccatcctagtcagtttgcttccagtttaaatcaaattggtgtgccctataagattgcttattctgtcagcctgaccttgcgctatattccagatttgcaggaagaattctttactatcaagatgtctcaggaggcgcgtgggatggaattatccaagaaagcttctcttatgcaacgaatcaaaggcaatctgctcattattacgcccttgatttttagctcgctagaacgcattgataccattgcgactgccatggagcttcgccgctttgggaaagagaaaaaacgcacatggtatagttatcaggccttgaaaaaaggagactatattaccttgctcttggcaaccttgtttttagtagttagtttactacttatcttgcagaatcagggacgattttacaacccttggaaatag

SEQ ID NO: 2019 - DNA, 1248 bp, Streptococcus pneumoniae
  unsure (783): n at each above location is unknown.
ttgtcaggtggacaaaagcagcgagtcagtctagctggtgtcttgattgatgaaagtccgattctcttgtttgatgagccactcgccaatctagatcccaagtcaggtcaggatattatcgaattgattgaccagattcataaggaagaggggacgacgactctgattatcgagcaccgtttggaggacgttctgcatcgccctgtggatcggattatcttgataaacgatggtcgtatcctttttaatgggagccctgaccagttgcttgcgactgatttattgactcaaaatggaattcgagaacccctttatctaacgactctccgtcaattaggtgtggacttagtcaaggaagaacagttagcgaatctggataacatgtctatctcaaaaggtcaggttcagctgcagaatgaactggcaaaagaaactccagaattgcagtcactctttaaattagaggacgtgtctttctcttatgatgatagaccgattttaaaatccctacatttagatattaaaaagggtgaaaagattgctattgtcggaaaaaatggagcagggaaatcaactctagccaaggctataagtagctttattcagacggaaggacgctatctttgggaaaaacaggatataaaaggcgattctgttgcagagcgggcggaacgagtaggctatgtgctacaaaatcctaatcaaatgatttcaaccaatatgatttttgatgaggtggctctagggctccgtttgcgaggtgtggatgagaaggaaattganacgagagtctatgaaaccttgaaaatctgtggactttatgaattccgtaattggcctatttctgccctgtcatttggtcagaaaaaacgtgtcaccattgcttcaattttggtcttaggagctgaaattattctcctagatgaaccgactgcaggtcaagatcagaagaactatactgagattatggaatttctcgaagagttacatcaaaaagggcataccattgtcatgattacccatgatatgcaattgatgctggattattcagaccgggtccttgtcatggtggatggagaattgattgccgatactgttccagccagtctgttgagcgatcctgagctgttagtaaaagccaatctaaaagaaacctccatctttaacttggctaagaaactagatgtggatccactggatttaacggcattttacaaagaaaggagagagggatgcaagctaaattaa

SEQ ID NO: 2020 - DNA, 384 bp, Streptococcus pneumoniae
atgaaagaagctataattgagtggaaggatttctctttccggtatgaaacacaacaagaaccgaccttgcaagggatagacttgaccatttacaagggagagaaagtcttaattgttggaccatctggatcaggtaaatctaccttgggtcagtgtttgaatgggattattcccaatatttacaagggtcagacatatggagaatttttgataaagggtcaaacagcctttgatatgagcatctatgataagtctcatctggttagcacagttttgcaggatacagatgggcagtttattggcttgtctgtggcagaagatttggcgtttgctctggaaaatgatgtgacagccctagatgagatgaaagggtcgtgtttataa

SEQ ID NO: 2021 - DNA, 213 bp, Streptococcus pneumoniae
gactttctctcccttgtaaatggtcaagtctatcccttgcaaggtcggttcttgttgtgtttcataccggaaagagaaatccttccactcaattatagcttctttcatcttactctcttcattcgcttcttagacttctattttatcataaatcaagcccttcttgcagtctcttctcttaaaatcttagcgccaaaaagattcctatcctag

SEQ ID NO: 2022 - DNA, 258 bp, Streptococcus pneumoniae
atgaaaatcaaagagcaaactaggaagttagccgcaggttgctcaaaacagtgttttgaggttgtagatgaaactgacgaagtcagctcaaaacagtgttttgaggttgtagatgaaactgacgaagtcagtaaccatacctacggcaaggcgaaactgacgtggtttgaagagattttcgaagagtataaaatgatggggaaggctgggcaactagtctttttcgatgtttatagattagttaggcaagtaagctag

SEQ ID NO: 2023 - DNA, 549 bp, Streptococcus pneumoniae
atggaaatcaaatttacaattaaacaagttgttgctgtcggaattggcgctgccctctttgtcgtcatcgggatgatcaacattccaacccctgttccaaatacaagcatccagcttcagtatgcggtacaagcgctactttctattatttttggaccgattatcggtttgcttgtcgggttgattggtcatgcaatcaaagactctcttgttggttatggtctatggtggacttggattatctctagcggactctttggtttagttgtgggactttttagaaagtacgttcgcgtgatcaatagtgtttttgactggaaagatattcttatttttaatctcattcaactacttgcaaatgcccttgtttggggtgtcttggcaccacttggagatgttgtgatttatcaagaagcggcagaaaaagtatttgcacaagggattgttgcgggaattgccaatggtgtatctgtagctattgcaggaactcttctcttacttgcctatgcaggaacccaaactcgtgcaggaagtttgaaaaaggactaa

SEQ ID NO: 2024 - DNA, 876 bp, Streptococcus pneumoniae
atgataaaggatatacaaggagataaaatgaataataatttactggtattacaatcagactttggtctggttgatggtgcggtatcggctatgattggagtggctttagaagagtctccaaccttaaaaatccatcacttgacgcacgatatcacgccttataatatttttgaggggagctatcgtctctttcagacggtggattactggcctgagggaacgacgtttgtatcggttgtcgatccaggtgtcggttcgaaacgtaagagtgtagttgccaagactgcaaaaaatcaatacattgtcacgccagataatgggacgctttcctttatcaagaaacacgttggcattgtagccattcgtgagatttctgaggtggccaataggcgtcaaaacacagagcattcttataccttccacggtcgtgatgtctatgcctatactggtgctaaactggccagtggtcacattacttttgaggaagtagggccagagctcagtgtggaacagattgtagagcttccagtcgtagcgaccatcatagaagatcatctggtgaagggagccattgatattctggatgtgcgtttcggttcgctttggacctctatcacacgggaagaattttacaagctggaaccagaatttggtgatcgttttgaagtgaccatctatcatgctgatatgctggtctatcaaaatcaggttgtctatggcaaatcatttgcagatgtgagaattgggcaacccatcctttacatcaactctctctatcgtttaggtttggctatcaaccaaggttcctttgccaaggcctataatgtaggtgtcggttcatcttggaccattgaaataaagaaaatagaaggataa

SEQ ID NO: 2025 - DNA, 1350 bp, Streptococcus pneumoniae
atgaaaattatccttgtcggagggggaaaagttggttttgccctctgtcgctccttggttgcagaaaagcatgatgttttgctgattgagcaagacgaagctgttctcaatcatattgtcagtcgctttgatatcattggtatccttggtaacggggccgattttgccattcttgagcaagccagcgtccaagattgtgatatctttatcgccctgactgagcacgatgaagtcaacatgattgcagcagttctagccaagaaaatgggagctaaagaaactatcgttcgggtgcggaaccctgaatattctaactcttatttcaaggaaaagaatattctcggtttttctcttatcgttaatcctgagctcttggctgcccgcgctatcgcgaatatcattgacttccccaacgccctgtctgtcgaacgctttgctggtggacgcgttagcctcatggaatttgtcgtcaagtccaccagcggtctttgccaaatgcccatttctgattttcgtaaaaaatttggtaatgtcattgtctgtgcgatagagagggagcatcaaattatcattccaagcggtgacatgactgtacaggataaagatagaatctttgtcactggtaaccgtgtcgatatgatactcttccataattattttaaatcacgcgccgtgaagagccttctcatcgttggggcaggtagaattgcctattatctacttggtattctcaaagatagtcgtatcgatacaaaagtcattgaaatcaatcctgaaatcgccagcttctttagcgagaaattcccaaatctctacatcgttcaaggagatggaaccgcaaaagatatcctgctggaagaaagtgctcaacactatgatgccgttgcgactctaacaggtgtcgatgaggaaaatctgattacatctatgttccttgacagggtaggtgtacagaaaaatattactaaggtcaatcgtaccagtctcctcgagattatcaatgcgcctgatttttcaagtatcatcacacctaaaagcatcgctgtagatacgattatgcactttattcgtggtcgagttaatgcccagtattcagaccttcaagccatgcaccatctagccaatggccaaatcgaaaccctgcaattccatatcaaggaagccaataaaatgactgccaaacctctttctcaactgaaattgaaaaaaggggttcttattgcagccattattcgaaagggcaagactattttcccaactggggaggatatgttggaagttggagacaagctcctagtaacaaccttgttgccaaacatcaccaagatttatgacttgattgcgaggtaa

SEQ ID NO: 2026 - DNA, 1437 bp, Streptococcus pneumoniae
atgaataaaagtatgattcgttacctcctttcaaagttacttttgattgaagctgttctcctcttggttcctgtggctatcgctgtctattaccgtgaatcgagccaagtctttacggccctcttttcgaccatagggattctcgtattgttaggcggttcagggagtttacagaagccaaaaaatcaacggatttatgccaaggagggagtcttgatcgttgccctctgttggatcctttggtctttctttggtggtctcccctttgtcttttctgggcaaatccctagcgttattgatgccttttttgaaattagttctgggtttacaactactggagcaagtattttgaacgacgtttcggttctcagccgttccctcctcttctggcgaagttttacccacttgattggagggatgggagtgcttgtttttgcacttgctattatggacaatgccaaaaatagccacctagaggtgatgaaggctgaggttccaggtcctgtttttggcaaggttgtatccaaactaaaaaacactgcccagattctctatctcctttatctagctctcttctccctctttgtcatcatctattatctagctggtatgcctctctacgatagttttgtcattgctatggggacagcgggaactggaggctttaccgtctataacgacggaattgcccactatggcagctcactgattacctatctggtcagtatcggagttctgatttttggggtaaatttcaacctctactactacctcatgctccgtcgcatcaaggccttctttggtgacgaagaacttcgggcttacttggtcattgtactggtttctacaggcttgattagcctcaacaccctctacctctacccagggttttcaaagagctttgaaatgaccttcttccaggtttccaacatcattacaacaactggttttggatatggagatattaccaactggcccctcttctcccagtttatcctcctcttcctcatgacaatcggtggttctgctggatcaactgcaggtggactcaagattattcgaggcctcatcctttcaaaaattgccaaaaatcaaattttgtccattctatctccccaccgtgttttgactctccatgtgaataaaacggtgattgataaggatacccagcataaaattctcaagtactttgtcatctatgctatgattttgctatcccttatctttattgtcagcctagatagcaatgattttctgatcgtgaccagcgctgtctttagctgtttcaataatatcgggcctattctaggaaccacttctagtttctcaatctttagtcctatctcaaaaattctcctctcctttgcaatgattgcaggccgcttggagatttacccaatcctacttctctttatgaagagaacttggtctaagaga

SEQ ID NO: 2027 - DNA, 1680 bp, Streptococcus pneumoniae
atggataagctagtcgctgccattgaaaagcaacaagggaaatttgaaaaaatttctactaataactatatgatggctattaaagatggattcattgctactatgcctttaattatgttttcaagctttttgatgattattattatgattcctaaaaatttcggagtagagttaccgagtccagctattgtctggatgagaaaagtgtatatgttaaccatgggagttttgggtattattgtttcagggactgttggaaagtcattagttggaaatgttaacagaaaaatgcctcacggaaaggtaataaatgatacttctgcaatgttggcagccatatgtagttatctggtattaactgtaacgcttgtagttgatgagaagacgggatctacaagtttgtcgacaaactatttaggatctcaaggattgataacttcgtttgtcagtgcctttattactgtaaatgtttaccgattctgtattaagcgagacattactattcatttacctaaggaagttcctggggctatatcacaagcttttagagatatttttcctttttcttttgttttacttattagtggtttgttagatattgtatctcggtttagtttagatgttccttttgcccaagtatttcaacaactattgactcctatttttaagggggcagaatcatatcctgctatgatgttgatttggtttatgtgtgctttgctttggtttgttggaattcatggaccatctattgtcttacctgctgttacagctttacaactgagcaatatggaagagaatgctcaacttcttgcaaatgggcagttcccttatcattctttaacacctaatttcgggaattatatcgctgctattggaggaacgggggctacctttgttgtaccatttattttgattttctttatgcggtctaaacaattaaaatcggtaggtaaagctacaattactcctgttttatttgcggtaaatgaacctcttctatttggtatgcctgttattttgaatccctatctttttgtcccttttttgatgactccaccagtaaatgtatttctaggaaaggtatttattgatttctttggaatgaatggattttatatccagttaccttgggcttttcctggtcccttgggattgttaattggaacgaattttcaacctatctcctttgtgcttttatctttgatgttagttgtcgacatattgatttatttgccattctgtagagcgtatgatagacagttactgatgaaagaagatgttgcaagctcaaatgatattattttagaggaggatacaagtgaaataatgcctggtgagatagatgtaataaaaagtaaggagttgaaagtactggttctttgtgcagggtctggaacaagtgcgcaattagccaatgcaattaacgagggcgctcaattagcagaagttagagtgattgcgaattcaggagcgtacggagctcattatgatattatgggtgtttatgatttaattattctggctccacaagttcggagttattatagagagatgaaggtggatgcagaaagattaggtattcagatagttgctaccagaggaatggaatatattcatttaacaaagagtccaagtaaatccttacaatttgtattggagcattaccaagctgtgtag

SEQ ID NO: 2028 - DNA, 1413 bp, Streptococcus pneumoniae
atggaaaatttacagtttaaagccttaccgaaggagtttttattaggagctgctaccgctgcttatcaagtagagggtgcaactagggtagatggtaaaggaataaatatgtgggatgtttatttgcaagaaaatagtccgttcttaccagatccagctagtgatttttattatcgttacgaagaggatatagctttggcggcagaacatggtttgcaggctttgcgtttatctatttcttgggttcgtatatttcctgatatagatggagatgctaatatattggctgttcgttattaccatagagtctttcagtcttgcttaaaacataatgtgattccgtttgtttctttacatcattttgattcgcctcagaaaatgttagaaacaggggattggttggatagagagaatattgatcatttcatacgatatgctcgcttttgtttccaagaatttacagaagtcaagcattggtttacaatcaatgaactgatgtctcttgctgcaggtcaatatataggaggtcagtttcctccaaatcatcattttcaattatctgaagcaattcaagcgaatcataatatgttgttggcgcatgctcttgcagtcctcgaatttcatcaattaggaattgagggagagataggttgtattcatgctttaaagccaggctatcctattgatgggcaaaaagaaaatattttggcagctaaacggtatgatgtttataataataaatttctattagatggaacttttttgggctactacagtgaggacacgctttttcacttgaatcaaatattggaagctaataattctagctttattattgaagatggtgatttagaaattatgaagagagctgcacctcttaatacgatgtttgggatgaattattatcgttcagaatttattcgtgaatacaaaggtgaaaatagacaagaatttaattcaacaggaataaaaggacagtcttcttttaaattaaatgctctaggtgaatttgtaaaaaaaactggtattccgacaacagattgggattggaatatttatcctcaagggttatttgatatgttgcttcgtatcaaagaagaatatcctcaacatccggtcatttatttaactgaaaatggtacagcccttaaagaagttaagccagagggcgagaatgatattattgatgacagtaagagaatccgttatattgagcaacatttacacaaagttttagaggctcgagatagaggagtcaatattcaaggctattttatatggtctttgcaagatcaattttcttgggcgaatggctacaataagcgatatggtcttttctttgttgattatgaaacacagaagagatatattaagaaaagtgctctttgggtaaaagggctaaaacggaattaa

SEQ ID NO: 2029 - DNA, 195 bp, Streptococcus pneumoniae
gatagcctggctttaaagcatgaatacaacctatctctccctcaattcctaattgatgaaattcgaggactgcaagagcatgcgccaacaacatattatgattcgcttgaattgcttcagataattgaaaatgatgatttggaggaaactgacctcctatatattgacctgcagcaagagacatcagttcattga

SEQ ID NO: 2030 - DNA, 345 bp, Streptococcus pneumoniae
atgaaatcaaaagaagaaataaatatgcttggttttacaattgtcgcttacgcaggagatgcaaggtcagatttgatggatgctttggcgtttgcgagagatggatattttgaacaggcaagagaattggttgagtctgcaaacgactcaatagtgtctgcccatcgagaacagactaatttattagcggaggaggcatctggagataattttgaagtgagttttatcatgattcatggtcaagatactttgatgacaacgatgctattgtatgatcaggtcaagttttttattgatgaatatgaacgaattcgaaagattgaagaacatattggtttgcaatga

SEQ ID NO: 2031 - DNA, 1941 bp, Streptococcus pneumoniae
ttgcagataaacgcaatcttgaaaaagaaaaagctactgttggagggaaataagatggttatcagagtatttgatcaacagaaaaatacttattctagctttgccttagaggaattaagttactatatgaatcgggtctttaagactaacatagagcttgtcgaggagaaggaagcggatatttttgtaggattagtcaataaagaggacagaaaagaccatgttcttatctcattagacaagggtaaggggagaattgagtctaatacaattgtaggtttacttattggaatttaccgaatgtttcatgaatttggggttgtgtacactagaccagggcgcagacatgactttgttccagagttacgatttgaagattttttagataaagagctatctatagatgaaacagccagttactatcataggggagtatgtatagagggagcggattcatttgaaaatatactagatttcattgattggctacctaagattgggatgaacagttttttcatccagtttgaaaatccttactcttttttgaaacgttggtatgaacatgagtttaatccatacctaaataaagaaaaattctcaaatgaattagtacaagaattgagtgataggttggataaagaattgcaaaaaagaggtcttattcatcatcgtgttggtcatggatggacaggtgaggttttaggttactcttcaaaatttggctgggaatcaggtcttagtatttcagaggagaagaaaccgtatgtcgctgaaataaacgggaaacgagaattatttaatacggctccgattttaaccagtctggatttttcaaatccagatgtggcggataagatggtagaaattatcaaggattatgccaagaaaagacctgatgttaactacttacatgtatggttgtcggatgctcgtaataatatttgtgaatgcgaaaactgtagacaagaattggtttcggatcagtatattcgtattctcaatcaattggatagggctttaacgagtgagggattagatacaaagatttgttttctgctttaccatgagttgctatgggcgcctcagaaagaaaaattagataatcctgaacgctttaccatgatgtttgcaccgattacaagaacatttgaaatgagttatgcagatgtagattttgacaattccatacctacgcctaaaccttatctgcgtaataaaattatacttccgaattctcttgaggaaaatttatcttatctttttgagtggcaaaaaacatttaaaggagatagtttcgtatatgactatcctttagggcgtgctcattatggcgatttaggctatatgaaaattagtcaaaccatttacagagatgtatcttatctttctaacctacatttgaacggttacatttcgtgtcaagaattacgtgccggattccctcataattttcctaattatgttatgggggaaatgctctggaagaagacaagaagttatgaagaattgattgaagaatacttttctgctttgtatggggaaaattggcagtctgttgttgaatatttagaaaaattatccagttattcctcatgtgattattttaatgcaattggcagtcgtcaaaatgatgttttagcgaatcattattatatagcttacaatctagctgataattttttgccaattattgaggaaaatatttctaagttattaaatagtcaaaaggatgaatggaaacagctcagttatcatcgtgaatatgttgttaagatggcgaaggctttatatcttcaagcaaccggaaaaacaaggcaagctcaagatgaatggagaaatgtgttgaattatatccgtgggcacgaactgctattccaatctaatttggatgtttatcgtgtaattgaagtagcaaaaaattacgctggtttccacttataa

SEQ ID NO: 2032 - DNA, 1323 bp, Streptococcus pneumoniae
atgaacaatattttagcgtttttagaaacaaaagtcgctccgtttggtgaaaaagttggcaaccaacggcatttgaaagctattcgtgaaggatttatgatggcaatgcctttgattttagtcggctctttatttcttattctaatcagttggcctcaagaggcttttacaaattggctgaatagtgttggattgctaagtatcttgacaactatgaatcagtcaacagtagcgattatctccttggtcgcttgtttcggtattgcctacaggttgtcggaaggatatggtacagatggtccgtcggcagggatcatagccttatccagttttgtattgatggcacctcgtttttcgagtatggtttatgataaaaatggggagcaggtcaagcagttatttggcggcgcaataccattttctagcctgaatgcatcttctttgtttatggcgattactattggattggttacagcagagatttatcgtatgtttatccagcgcggaattacgataaaaatgccaagtggtgtcccagatgtagtaagtaaatcattttcagctcttttacctggttttactacttttgttttgtgggctttggtcttaaaaggtcttgaagcggcaggagttgcaggaggtctcaacggactcctaggtgcaattgttggaacaccgcttaagttaattgcaggaacgcttccaggtatgattctatgtgttattgtaaactcattcttttggttctgtggagttaatgggggacaagttttaaatgcttttgtagacccagtttggttacaatttactacagaaaaccaagaagctgtggctgcaggacaaacactccaacacattattacattaccgtttaaagatttatttgtatttattggtggcggtggagcgactattggtcttgcgatttgtctcttcctatttagtaagagtcgtgcgaataaaacattaggtaagctagctattataccgtctatttttaatatcaatacagctattctatttacgtttccaacagttttaaatccgattatgctgattccgtttattgctactcctacaatcaatgccttgattacctatgtatcaatggctgtaggattagtaccctatacaacaggtgtaatccttccgtggacaatgccaccgattataggaggcttccttgcaacaggggctagttggcgaggagctctattacaagttgttttgattttggtttctgtagcaatttattatccattcttcaaaattgcagataaacgcaatcttgaaaaagaaaaagctactgttggagggaaataa

SEQ ID NO: 2033 - DNA, 1224 bp, Streptococcus pneumoniae
atgattacaaaacaatcagcctttttacaaaatagagccactatactggagtttctatatcgaaatccagcaacatcccgtacagatattgttaatgaaacaggacttactccagcaacaacgactaacatcataaaagaactaagcgaacagtccctcatatacgaaactggtgatgaatttagcgagttttccggatctggaagacgtagaaaaactatttctatcacagataatattccgtatgttgttggaggtattgaaataaacgtcctaggtatctttctcagtctatgtgacttacaagggaaaactcttttcgagacagaaattttgaatgaagattatcctatttcagaaatcaattccaccattaccaatatgataaaaacagctatagagtacgtccctttggaaacaaaattacttggatttggcttatcaatacctggacattattacaaagactccggaagtatcattacaaacaaccccatatgggaatcttttaatttattaaatgtaattaaaagattcaattttccttttattgtaaaaaataatatcgattgtatggctataggacaatacctttttaatccacacaatacccccgataactttattttcctacacgctggattaggtatttacacttcctttttcacaaaagaaaaaataggagcctctaaaaatccttatatcggagaaattggacacaccattgtcgaattgaatgggcaatattgtgaatgcggaaaaaaaggttgtttacaaacatatatttcggatgcttggttaatcaaacacgcccaattattatttaaaaattcccaactaactgtactaaaaagccttgtaaagactgaaaaagacattcatttagacacccttttaacggcttataatttaggcgactccgctttacgtcaacaaattgataaaggagtcaatttattagccacttctattgcaaatctcctcctcatcaatcctgctgataaaatctatatcaacagtcaattgcttaattatcaacctttcactcatgaagtcagggataaaatccaagaccagctccacttcgttccctttactcgtaatatagaaattgaaattttaccttacaacaaacatcgtggaagtataggagcttgtgcattagctatcgtcgcttttttcatagaacatagcaatgtattacaagatattatttcaccttaa

SEQ ID NO: 2034 - DNA, 219 bp, Streptococcus pneumoniae
aaagaaacgtcaaatgctcatgaaacaacgaatacaggtatcaaaactatgacaaaacaaatccctaaatttactaaagatactgctcaactttacacctgtaaatggttgttgtataataaagttacaaagatgtacgaccacactgttgtaaatcatagtgttcgcgaatatattactgatagcatttctacaaatacaagtaaagagagcggatga

SEQ ID NO: 2035 - DNA, 174 bp, Streptococcus pneumoniae
ttgcttattatcaatcgtttttttagcttatttgtcttagattggtatagaactgagctatggattaatactcttgtatcttatcctgttcctaaatatgttggtagaaaaatgaagcagttgttacgagtgtctgtattggaaaaaattttgtctatagaattctttaaatga

SEQ ID NO: 2036 - DNA, 186 bp, Streptococcus pneumoniae
attccaaattttctctatctgctcattttaataaacaatactagtgtaactatccttccagtcagaagcttgtcaaatcacaccgaaaattcttctaaaatttatctcgttaggcaatcaagcaaaaactcgacgatagtacaaacattatcatacaggattgacttcctaaattatatactttag

SEQ ID NO: 2037 - DNA, 285 bp, Streptococcus pneumoniae
atggattggtacgattatatgatacaggcatccaaacaatcacaattcaacgcaagccattggtttcgctatttgcgaaaagttatttttgaagactattcttatttaacaaaccaagatgtagaaaagttgctagactccaaagaactaacccgttttcaaaaaattagcttgaagtatgcctttcaagagcatactccaactcataaatatgtgatttcattaaataaacctgctaagttaaccaatgttcaaaaattgatggagaaatacaaacatggataa

SEQ ID NO: 2038 - DNA, 519 bp, Streptococcus pneumoniae
atggaacaattacattttatcacaaaattactagacattaaagaccctaatatccagattttagacatcatcaataaggatacacacaaggaaatcatcgccaaactggactacgacgccccatcttgccctgagtgcggaaaccaattgaagaaatatgactttcaaaaaccgtctaagatcccttacctcgaaacaactggtatgccttctagaattctccttagaaaacgccgtttcaagtgctatcactgttcaaaaatgatggtcgctgaaacttctatcgtcaagaagaatcatcaaattcctcgtattatcaaccaaaaaattgcgcaaaagttgattgagaagatttctatgaccgatattgctcatcagctggccatttcaacttcaactgtcattcgcaagctcaatgattctcactttgagcatgatttttcgcgtcttcctgagattatgtcctgggacgttgaaacagtccggggagtgactgtttcaatcgggagatggagatga

SEQ ID NO: 2039 - DNA, 768 bp, Streptococcus pneumoniae
atggagatgagctttattgcgcaagattttgaaaagctcgatatcatcactgttcttgaaggtagaacacaagctgtcatccgagatcactttcttaaatatgatagagccgtccgatgtcgcgtcaaaatcattactatggatatgtttagtccttactatgacttagctagacaacttttcccgtgtgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagctgtaaactgagtgataagcgattttatcgtcctatttttcgtatgcacttaaccaataaagagattttaaacaagcttttgagctattcggaagacttgaaacaccactatcaactctatcagctcttgctttttcacttccagaataaggaaccagagaaatttttcggacttattgaggacaatcttaagcaggttcatcctatttttcagactgtctttaaaaccttcctcaaagataaagaaaagattatcaacgcccttcaactacactattctaatgccaaactggaagcgaccaataatctcatcaaacttatcaagcgcaatgcctttggttttcgaaactttgaaaacttcaaaaaacggatttttatcgctctgaatatcaaaaaagaaaggacaaaatttgtcctttctcgagcttag

SEQ ID NO: 2040 - DNA, 1263 bp, Streptococcus pneumoniae
atggaacacatcaatcataccacattactcatcggaataaaagacaaaaacatcaccttaaataaagccattcagcacgatacccatatcgaagtcttcgctacacttgattatcacccacctaaatgtaaacactgtaaaggaaaacaaatcaaatacgacttccaaaagccttctaaaatcccttttatcgagattggtggtttccctagcctcattcatttgaaaaagagacgatttcaatgcaagtcctgtcggaaagtcactgtagctgaaacaactctcgttcagaaaaattgccaaatctcggaaatggtgagacagaaaattgcccaactcctactcaacagagaggctcttacacatatcgcttctaaattagccatctctacctctacctctaccgtctatcgtaagctcaagcaatttcatttccaagaggattacaccactttgcctgaaatcctctcctgggatgaattctcctaccagaaggggaaattggctttcattgctcaggatttcaacactaagaaaatcatgaccattcttgataacagacgtcaaacaaccatccgaaatcatttcttcaagtactcgaaagaagctagaaaaaaagttaaagtcgtcactgttgatatgtctggaagttatatccctctcattaagaaattatttcccaatgctaaaattgttctcgatcgtttccacattgtccaacacatgagcagggctcttaatcagactagaatcaacatcatgaagcaatttgatgataaatctctggaatacagagctcttaaatattactggaaatttatcctaaaagatagtcggaaactctctcttaagcctttctatgctagaactttcagagagaccttaactcctagggagtgtctgaagaaaatctttactctagtacctgaacttaaagattactatgacctgtatcaactactcctatttcatctacaagagaagaatactgaccagttttggggcttaattcaagacacgttacctcatctcaaccgcacctttaaaaccactttgagcacatttatttgctataaaaactacatcactaacgccattgaattgccttattctaacgctaaacttgaggccactaacaaactcatcaaagacatcaagcgcaatgcctttggttttcggaactttgaaaacttcaaaaaacggattttcatcgctctgaacatcaaaaaagaaaggacaaaatttgtcctttctcgagcttag

SEQ ID NO: 2041 - DNA, 258 bp, Streptococcus pneumoniae
tgggttgaagaaaagctaagctcgagaaaggacaaattttgtcctttcttttttgatgttcagagcgatgaaaatccgttttttgaagttttcaaagttccgaaaaccaaaggcattgcgcttgatgtctttgatgagtttgttagtggcctcaagtttagcgttagaataaggcaattcaatggcgttagtgatgtagtttttatagcaaataaatgtgctcaaagtggttttaaaggtgcggttgagatgaggtaa

SEQ ID NO: 2042 - DNA, 2325 bp, Streptococcus pneumoniae
atggttgttaagacagttgttgaagcacaagatatttttgacaaagcttgggaaggcttcaaaggcgtagattggaaagaaaaagcaagtgtatcacgctttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatctttggtatccaaaatgatgaactcttcaaattgaacttcatgccaaaaggtggtatccgtatggctgaaactactttaaaagaaaatggatacgaaccagacccagctgttcacgaaatcttcactaaatatgtaacaacagttaacgacggtattttccgtgcctacacttcaaatattcgtcgcgctcgtcatgcacacactgtaactggtcttccagatgcatactcacgcggacgtatcatcggtgtttacgcacgtcttgctctttacggtgcagactacttgatgcaagaaaaagtaaacgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtaccaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctaaaggtggttggttgcaaaacttgaactcactttctagccttgactttagttatgcagctgacggtatctcattgactacacaagtatcacctcgcgctcttggtaagactcgtgatgaacaagttgataacttggtaacaatccttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaa

SEQ ID NO: 2043 - DNA, 276 bp, Streptococcus pneumoniae
cacctttttatactcttcgaaaatctcttcaaaccacgtcagcttccatctgcaacctcaaaacagtattttgagctgacttcgtcagttctatttacaacctcaaagcagtgctttgagcagcctgcggctagtttcctagtttgcttttcgatttccattgagtgtaactgcttattttcttttattatacccttttttctgaaaaaaagaaaaaaggactttatttttttcaaaaatataatacagtttgaaataaaatatagactgttttag

SEQ ID NO: 2044 - DNA, 234 bp, Streptococcus pneumoniae
aacagtctatattttatttcaaactgtattatatttttgaaaaaaataaagtccttttttctttttttcagaaaaaagggtataataaaagaaaataagcagttacactcaatggaaatcgaaaagcaaactaggaaactagccgcaggctgctcaaagcactgctttgaggttgtaaatagaactgacgaagtcagctcaaaatactgttttgaggttgcagatggaagctga

SEQ ID NO: 2045 - DNA, 1071 bp, Streptococcus pneumoniae
gtgctaggcatgttgatttttcctttgttaaatgatttgtcaagaaaaatcatccatattgacatggatgccttttttgctgcagtggaaatcagggataatcctaaactcagaggaaaacctgtcattattggaagcgaccctcggcaaacaggtggacggggagtcgtttctacctgtagttatgaggcaagagcttttggtgtccattctgccatgagttccaaggaagcttatgaacgttgtccccaggctgtctttatctcagggaattatgagaaatacaagtctgtgggactccggattcgagctatttttaagcgctatacagatttgattgaacccatgagcattgacgaagcctatttggatgtgacagaaaataaactcggtatcaagtcagcggtcaaaattgctcgcctcattcaaaaagatatctggaaagaactccatctaactgcttccgcaggcgtttcttacaacaaattcttagctaaaatggcgagtgattatcaaaaaccacatggtttgacagtgattctacctgaacaggctgaggattttctcaaacaaatggatatttccaaatttcatggagtaggaaaaaagacagtagaacgtcttcatcaaatgggcgtttttactggtgctgatttacttgaagttcctgaggtaaccctaatagaccgttttggtagactaggctatgatctgtatcgaaaggctcgtggcattcacaactctccagtcaaatccaatcgcatccgtaaatcaatcggcaaggagaaaacctacgggaagattctccgtgccgaggaagatatcaaaaaagagctgactcttctatcagaaaaagtcgctctcaatctacatcaacaagaaaaagctggaaaaattgtcattttgaaaatccgctacgaggacttttcaactcttaccaaacgaaaaagtcttgctcaaaaaacacaagatgctagtcagataagccaaatagccctgcaactctatgaagaattaagcgagaaagaaagaggtgtccgcctattggggattaccctgactggattttaa

SEQ ID NO: 2046 - DNA, 189 bp, Streptococcus pneumoniae
ttggtaaataccgtatcgtgcttggtagtgttttgctactttacagttttgtccgtttatttgtataagaaaaaccttgaaggggtaactcttcaaggttttatactcttagaaaatctcttcaaaccgcgtcagctttatctgcaacctcaaaacagtgttttgagcagcctgcggctagcttcctag

SEQ ID NO: 2047 - DNA, 846 bp, Streptococcus pneumoniae
atgtatcttattgaaattttaaaatctatcttcttcgggattgttgaaggaattacggaatggttgccgatttccagtacaggtcatttgattttagcagaggagtttatccaataccaaaatcaaaatgaagcctttatgtccatgtttaatgtcgtgattcagcttggtgctattttagcagttatggtgatttattttaacaagctcaatccttttaaaccgactaaggacaaacaggaagttcgtaagacttggagactatggttgaaggtcttgattgctactttacctttacttggtgtctttaaatttgatgattggtttgatacccacttccataacatggtttcagttgctctcatgttgattatctacggggttgccttcatctatttggaaaagcgcaataaagcgcgtgctatcgagccaagtgtaacagagttggacaagcttccttatacgaccgctttctatatcggactcttccaagttcttgctcttttaccagggactagccgttcaggtgcaacgattgtcggtggtttgttaaatggaaccagtcgttcagttgtgacagaatttaccttctatcttgggattcccgttatgtttggagctagtgccttaaagattttcaaatttgtgaaagccggagaactcttgagctttgggcaattgtttttgctcttggtcgcgatgggagtagcttttgcggtcagcatggtggctattcgcttcttgaccagctatgtgaaaaaacacgacttcaccctttttggtaaataccgtatcgtgcttggtagtgttttgctactttacagttttgtccgtttatttgtataa

SEQ ID NO: 2048 - DNA, 651 bp, Streptococcus pneumoniae
ttggataaaatcgttggaaagcattcagaatatacctaccaactcttgacacgctaccctaatcctcagaaaaggcttgaggcaggatttgataagctgatagaaattaagcgattgaccgcttctaaaattcaggatatcctctcagtcgcacctcgttctatcggaacaacatctcctgctcgtgaattcgaaatcatcgaaatcatcaaacattacaagaggctcattgacaaggcggaaacatgtgtcaatgacttgatggctgagttcaactcggtcatcacgacggttactgggattgggggtcgtttaggggcggtcattttagccgagattcgaaatattcatgcctttgataatcctgctcaattacaagctttcgctggactggattcttctatttatcagtcaggtcagattgatttagctggaagaatgatcaaacggggttcccctcatctgcggtgggcactcatacaagctgccaaagcatgcgctcgcttttcacctgcttttaaggtctatcttaagactaagttagaacaaggaaaacattacaatgtagccatcatccaccttgcaaaaaaacttatccgaaccctgttttatatcctaaaaaagagctgccatttgacgaacaaaaagtga

SEQ ID NO: 2049 - DNA, 186 bp, Streptococcus pneumoniae
atgctagtgtcgcaaatacagcaagtacctactccgtatcttctggaagtggaagttctggcggtggcttctctggaggcggaggtggcggcagtatcggagccttttaaagagagctaccatagactgaaaaagtatgatataatggaagatagaagaaagacaaactataagaaaagtcaatag

SEQ ID NO: 2050 - DNA, 1893 bp, Streptococcus pneumoniae
ttgatgaaaaaaacttttttcttactggtgttaggcttgttttgccttcttccactctctgtttttgccattgatttcaagataaactcttatcaaggggatttgtatattcatgcagataatacggcagagtttagacagaagatagtttaccagtttgaggaggactttaagggccaaatcgtgggacttggacgtgctggtaagatgcctagcgggtttgacattgaccctcatccaaaggttcaggctgcgaaaaacggtgcagaactagcagatgtgactagcgaagtaacagaagaagcggatggttatactgtgagagtctataatccaggtcaggagggcgacatagttgaagttgacctcgtctggaacttaaaaaatttacttttcctttatgatgatatcgctgaattaaattggcaacctctgacagatagttcagagtctattgaaaagtttgaatttcatgtaaggggagacaagggggctgaaaaactctttttccatacagggaaactttttagagagggaacgattgaaaagagtaaccttgattatactatccgtttagacaatcttccggctaagcgtggagttgagttgcatgcctattggtctcggaccgattttgctagcgctagggatcagggcttgaaagggaatcgtttagaagagtttaataagatagaagactcgattgttagagaaaaagatcagagtaaacaactcgttacttgggtcctcccttcgatactttctatctccttgttattgagtgtctgcttctattttatttatagaagaaagaccactccttcagtcaaatatgccaaaaatcatcgtctctatgaaccaccaatggaattagagcctatggttttatcagaagcagtctactcgacctccttggaggaagtgagtcccttggtcaagggagctggaaaattcacctttgatcaacttattcaagctaccttgctagatgtgatagaccgtgggaatgtctctattatttcagaaggagatgcagttggcttgagattggtgaaagaagatggtttgtcaagatttgagagagactgtctaaatctagccttttcaggcaaaaaagaagccactctttccaatttgtttgcggattacaaggtatctgatagtctttatcgtagagccaaagtttctgatgaaaaacggattcaagcaagagggcttcaactcaaatcttcttttgaagaggtattgaaccagatgcaagaaggagtgagaaaacgagtttccttctgggggctcccagattactatcgtcctttaactggtttggaaaagactttgcaagtgggtatgggtgtcttgactatcttgcccctatttatcggatttggtttgttcttgtacagtttagacgttcatggctatctttacctccctttgccaatacttggttttctagggttagttttgtctgttttctattattggaagcttcgactagataatcgtgatggtgttctaaatgaagcgggagctgaggtctactatctctggaccagttttgaaaatatgttacgtgagattgcacgactggataaggctgaattggaaagtattgttgtttggaatcgtctcttggtctatgcaaccttatttggctatgcggacaaggttagtcatttgatgaaggttcatcagattcaagttgaaaatccagatatcaatctctatgtagcttatggctggcacagtatgttttatcattcaagcgcgcaaatgagccattatgctagtgtcgcaaatacagcaagtacctactccgtatcttctggaagtggaagttctggcggtggcttctctggaggcggaggtggcggcagtatcggagccttttaa

SEQ ID NO: 2051 - DNA, 1566 bp, Streptococcus pneumoniae
atgagaaaaatatacttatctattttcacaagtctcttgctgatgctaggacttgtcaatgttgctcaagccgatgaatatttacgcatcgggatggaagcagcatatgctccctttaactggacccaggatgatgatagcaacggagctgtcaaaatcgatgggaccaatcagtatgccaacggatacgatgttcaaatcgccaagaaaatcgctaaggacttaggtaaagaacctttggttgttaaaaccaagtgggaaggtctagtccctgcccttacttctggtaagattgacatgattatcgcaggtatgagtccaactgcagaacgcaaacaagaaattgccttttcgagcagttactacactaccgatccagttttgcttgtcaaaaaagattctgcgtacgcaagtgctaaatctttggatgactttaatggtgcgaaaatcacttctcaacaaggtgtctacctctacgacttgattgcacaaatcccaggtgctaaaaaagaaacagccatgggagacttcgctcaaatgcgccaagctcttgaggctggtgtcattgatgcttatgtttctgaacgtccagaagcactgactgctgaagctgcgaactctaagttcaagatgattcaagtagaacctggtttcaaaactggggaagaagatacagctatcgctatcgggcttcgtaaaaatgacaatcgtattagccaaatcaatgccagcattgaaaccatttcaaaagatgaccaagttgccttgatggatcgtatgatcaaggaacaacctgccgaagctacaacaactgaagagactagcagtagtttctttagccaagtcgctaaaattctttctgaaaactggcaacaactcttgcgtggtgctggtatcactcttttaatctctatcgtcggaaccatcataggtctcattattggacttgccattggtgtcttccgtactgctcctctctctgaaaacaaagccatttatggccttcaaaaactagtcggctgggttctcaatgtctacattgaaattttccgtggtacgccaatgattgttcaatcgatggttatctactatggaactgcccaagctttcgggatcaaccttgaccgtacactggctgctatcttcatcgtttcaatcaataccggtgcctacatgactgaaatcgtccgtggtggtatcctagcagttgacaagggacaatttgaagctgcgactgctcttggtatgacccataaccagaccatgcgtaagattgtcctacctcaggtagtccgtaacatcctacctgcaactggtaatgaatttgtcatcaatatcaaagatacatctgtattgaacgttatctctgttgtcgaactttatttctcaggaaataccgtggcaacacaaacctatcaatacttccagacatttacaatcatcgccgtgatttactttgtcctcaccttcaccgtaacacgtatcctacgatttatcgagcgccgaatggacatggatacctatactacaggtgctaaccaaatgcaaacggaggatttgaaataa

SEQ ID NO: 2052 - DNA, 741 bp, Streptococcus pneumoniae
atgacacaagcaatccttgaaattaaacacctcaaaaaatcctatggacaaaacgaagtgctaaaagacatttcactcactgtccacaagggagaggtcatctctatcatcggaagctctggaagcggaaaatcgaccttcctacgctccattaacctacttgaaacaccaactgatggacaaatcctttatcatggacaaaacgtcctcgaaaaaggctatgacctcacgcaataccgtgaaaagttggggatggttttccaatcctttaacctctttgaaaatctcaatgttcttgaaaacacaatcgtcgctcagacaactgtcctaaaacgcgaacgcacagaagctgaaaagattgccaaagaaaacctggaaaaggtcggcatgggagaacgctactggcaagccaaaccaaaacaactctcaggtggtcaaaaacaacgtgtggccatcgctcgtgccctctccatgaatccggacgctattctctttgatgaaccaacatcagctctcgatccagaaatggttggagaagtcctcaaaatcatgcaggacctggctcaggaaggcttgaccatgattgtcgtaacccatgaaatggaatttgcccgtgatgtctctcaccgtgttatctttatggataagggcgtgatcgctgaagaaggtaaaccagaagacctcttcaccaatcctaaagaagaccgaacaaaagagttccttcaacgctatctcaaataa

SEQ ID NO: 2053 - DNA, 216 bp, Streptococcus pneumoniae
atggctaagtcaaactttgaaaaagtagaatcagttgttggctgggttcgtgataagaaaatcacaggctaccgtatctctaaagaaacgaatgcgcgtgaaatgtctatcattgctctggcgcagggtcgtgcaaaagtaaaaaatatttcatttgaaacagccctaggcctaattgatttctatgaaaaaaattatgaaaaatttgaagattaa

SEQ ID NO: 2054 - DNA, 231 bp, Streptococcus pneumoniae
ttgttccatatgaatctttctaatgatggttttgtcgcttttcattataggtcatatgggactttttttctacacaaaaataggctccataatatctatagtggatttacccactacaaatattatagagccttttttttattgacaaaagtagtaaaaacgtatacaattaaatattataaagaagaaaataggagaaaaacatggctaagtcaaactttgaaaaagtag

SEQ ID NO: 2055 - DNA, 198 bp, Streptococcus pneumoniae
atgaaaagcgacaaaaccatcattagaaagattcatatggaacaattacattttatcacaaaactgctcgatattaaagacccaaacatcaagattctagatatcatcaatatggatacccacaaagaaattatcgctaagctggattatgaggcttcatcttgccctgattgtggaagtctaattgaagaaatatga

SEQ ID NO: 2056 - DNA, 384 bp, Streptococcus pneumoniae
atgattaaagaattgtatgaagaagtccaagggactgtgtataagtgtagaaatgaatattaccttcatttatgggaattgtcggattgggaccaagaaggcatgctctgcttacatgaattgattagtagagaagaaggactggcagacgatattccacgtttaaggaaatatttcaaaaccaagtttcgaaatcgaattttagactatatccgtaagccggaaagtcagaagcgtatatccgataaagaaccctatgaagaagtgggtgagatcagtcatcgaataggtgagggaggctctggcttagagattattatctcttttcttgaaccctttggagttttggaaccatcttggttaggggaaacccgagaactttag

SEQ ID NO: 2057 - DNA, 552 bp, Streptococcus pneumoniae
atgaaaggaaatatcatggatagttttgataaaggatggtttgttttacaaacttattctggttatgaaaataaggtgaaagaaaatctattacaacgtgcacaaacctacaatatgttggataatattctacgcgttgaaattccaacacaaacagtgcaagttgaaaaaaatggaaagagaaaagaagttgaagaaaatcgctttccaggttatgttcttgtagaaatggtcatgacagatgaagcttggtttgttgttcgaaacacaccaaatgttacaggatttgtcggatcacacgggaacagatcaaaaccaactccattattggaacaagaaattcgtgacattttggtatctatgggacaaactgttcaagaatttgatttcgatgttgagattggtcaaactgtacgtattattgatggtgcttttgcagactacactggtaagattacagaaattgataataacaaagtgaaaatgattatctctatgtttggtaatgacacagttgcagaagtaaacctaaaccaaatcgcagaattataa

SEQ ID NO: 2058 - DNA, 177 bp, Streptococcus pneumoniae
atgcgttttattggagatatttttagacttcttaaagacacaacatggccaactcgcaaggaaagctggagagattttcgttctatcatggaatacacagctttctttgtagtaattatttacatttttgaccagttgattgtttcaggtttgattcgatttattaacattttttag

SEQ ID NO: 2059 - DNA, 2196 bp, Streptococcus pneumoniae
atgaaattagataaattatttgagaaatttctttctctttttaaaaaagaaacaagtgaactagaggactctgattctactatcttacgtcgctctcgtagtgatcgaaaaaaattagcccaagtaggtccgattcgaaaattctggcgtcgttatcatctaacaaagattatccttatactaggtttgagtgcaggattgctagttggaatctatttgtttgctgtagccaagtcgaccaatgtcaatgatttgcaaaatgccttgaaaactcggactcttatttttgaccgtgaagaaaaagaggctggtgccttgtctggtcaaaagggaacctatgttgagctgactgacatcagtaaaaacttgcagaatgctgttattgcgacagaagaccgttctttctataaaaatgacgggattaactatggccgtttcttcttggctattgtcactgctggacgttcaggtggtggctctaccattacccaacagctggctaaaaacgcctatttatcgcaggatcaaactgttgagagaaaagcgaaagaatttttccttgccttagaattaagcaaaaaatatagtaaggagcaaattctaaccatgtaccttaacaacgcttattttggaaatggtgtgtggggtgtagaagatgcgagtaagaaatactttggagtttctgcatcagaagtgagtctggatcaagctgcgactctggcagggatgctcaaggggccggaactgtataatcccttgaattctgtagaagattctactaatcggcgcgatactgtcttgcagaatatggttgcagcaggatatattgataaaaaccaagaaaccgaagctgctgaagttgatatgacttcgcaattgcacgataagtatgaaggaaaaatctcagattaccgttacccctcttattttgatgcggtggttaatgaagctgtttccaagtataatctaacagaggaagagattgtcaataatggctaccgcatttacacagagctggaccaaaactaccaagcaaatatgcagattgtttatgaaaacatatcgctatttccgagggcagaggatggaacgtttgctcaatcaggaagtgtagctctcgaaccgaaaacagggggagttcgtggagttgtcggtcaagttgctgacaatgataaaactggattccggaatttcaactatgcaacccaatcaaagcgtagtcctggttctacaattaagcctttagttgtttatacgccagcagttgaagcaggctgggctttgaataagcagttggataaccataccatgcagtatgacagctataaggttgataactatgcagggatcaaaacgagtcgagaagttcctatgtatcaagccttggcagaatcgcttaatctacctgctgttgccactgttaatgatttgggtgtcgacaaggcttttgaggcaggcgaaaaattcggactcaacatggaaaaggtcgaccgtgttcttggtgtcgccttgggaagcggtgttgaaaccaaccctcttcaaatggctcaagcatacgctgcctttgcaaatgaaggtttaatgcctgaagctcattttattagtagaattgaaaatgctagtggacaagttattgcgaatcataaaaattcacaaaaacgggtgattgataagtctgtagctgacaagatgaccagtatgatgttggggactttcaccaacggtaccggtattagttcatcgcctgcagactatgtcatggcagggaaaactggaacaactgaagcagttttcaatccggagtacacaagtgaccagtgggtaattggttatactccggatgtagtgattagccactggcttggctttccgaccactgatgaaaatcactatctagctggctctacttcaaacggtgcagctcatgtctttagaaacattgccaataccattttaccttatacgccaggaagtacctttacggttgaaaatgcttataagcaaaatggaattgcaccagccaatacaaaaagacaagtacaaaccaatgataatagccagacagatgataatttgtctgatattcgagggcgtgcgcaaagtctagtagatgaggctagccgggctatctcagatgcgaagattaaggaaaaggctcaaacaatatgggattcgatagtcaatctatttcgctaa

SEQ ID NO: 2060 - DNA, 876 bp, Streptococcus pneumoniae
atgcaattcacatttacattacccgcctctctacctcaaatgacggtaaagcaattacttgaggaacaactcctcatccctagaaaaatccgtcattttttgagaatcaagaaacatattttgataaatcaagaagaagtccactggaacgaaatcgtaaatcctggagatgtttgccagttgacttttgacgaggaagattattcccaaaagacgatcccttggggcaacccagacttagtgcaggaagtttatcaagatcaacacttgattattgtaaacaaaccagaggggatgaaaacgcatggtaatcaaccaaacgaaattgcccttcttaaccatgtcagtacctatgttggccaaacctgctatgtcgttcatcgtctggacatggaaaccagtggcttagttctctttgccaaaaatccttttatcctgcccattctcaatcgcttattggagaaaaaagagatttctagagaatattgggctctagttgatggaaatatcaacagaaaagaacttgttttcagagacaaaattggacgtgatcgccatgatcgtagaaaaagaatagttgatgcaaaaaatgggcaatatgctgaaacgtatgtaagcagattaaagcaattctcaaacaagacttccttggctcattgcaagctaaagacagggcgaacccatcagattcgtgtgcacctttcgcatcataacttccctattttgggcgaccctctctataacagcaattcaaagacaagtcggcttatgcttcatgcctttcgactttcctttacccatccacttacattagaaaaattaaacttcactgccctctcaaatacttttgaaacagaattaaaaaagaatggatga

SEQ ID NO: 2061 - DNA, 1080 bp, Streptococcus pneumoniae
gtgatttgtagtgattcaagttactcttttcacaataaaaatttcatgattttcataaggaggaaatcactaatggtagttaaagttggtattaacggtttcggacgtatcggtcgtcttgctttccgtcgtatccaaaacgtagaaggtgttgaagttacacgcatcaacgaccttacagatccagttatgcttgcacacttgttgaaatacgacacaactcaaggtcgtttcgacggtactgttgaagttaaagaaggtggattcgaagttaacggtaaattcgttaaagtttctgctgaacgtgatccagagcaaatcgactgggctactgacggtgtagaaatcgttcttgaagctactggtttctttgctaagaaagaagcagctgaaaaacaccttaaaggtggagctaaaaaagttgttatcactgctcctggtggaaacgacgttaaaacagttgtattcaacactaaccacgacgttcttgacggtactgaaacagttatctcaggtgcttcatgtactacaaactgcttggctccaatggctaaagctcttcaagataactttggtgttgttgaaggattgatgactactatccacgcttacactggtgaccaaatgatccttgacggaccacaccgtggtggtgaccttcgccgtgctcgcgctggtgctgcaaacatcgttcctaactcaactggtgctgctaaagctatcggtcttgtaatcccagaattgaacggtaaacttgacggatctgcacaacgcgttccaactccaactggatcagttactgaattggtagcagttcttgaaaagaacgttactgttgatgaagtgaacgcagctatgaaagcagcttcaaacgaatcatacggttacacagaagatccaatcgtatcttcagatatcgtaggtatgtcttacggttcattgtttgacgcaactcaaactaaagttcttgacgttgacggtaaacaattggttaaagttgtatcatggtacgacaacgaaatgtcatacactgcacaacttgttcgtactcttgaatacttcgcaaaaattgctaaataa

SEQ ID NO: 2062 - DNA, 276 bp, Streptococcus pneumoniae
ccgtatgattcgtttgaagctgctttcatagctgcgttcacttcatcaacagtaacgttcttttcaagaactgctaccaattcagtaactgatccagttggagttggaacgcgttgtgcagatccgtcaagtttaccgttcaattctgggattacaagaccgatagctttagcagcaccagttgagttaggaacgatgtttgcagcaccagcgcgagcacggcgaaggtcaccaccacggtgtggtccgtcaaggatcatttggtcaccagtgtaa

SEQ ID NO: 2063 - DNA, 951 bp, Streptococcus pneumoniae
atgggcaagaaaagatgggcaagaaatggatctgagtcaaacgatgcttcttatgctcaagtagtgagtctttatgatgatacaagtatctctgttagtaataatgagacggacaaagtgttgactggatccctctatactgaaacaaatgaacagggattaacgattccaagcagtttactaaaaaattggaatgaacagacaggaaaaaatttgacaactaatgatcttattggcaaatcagtctcagccagcattgtagaaagtgctgccgaaactagtaagattgctcaatttcaaacgaagattgtacgtgtaatcaatgatgaagatgacatggaggacagcaacagtttcatgctgtctcatcaaatggaaacgattttgaaagaggctggatttacgaaagctgtatcttattttatcttggaactcaaagatccatcacagacaaaagtagtaacagaagaattacagaaaaataagaagtatactgtgctttctcaacagagagttcttgatattgtgattacctttattcgtgttattcagggattattgattgtgctttcatcacaagctattgtggtagcagcggttatgattggtatcattatttacatcaatatcatgcaacgttccaaggaaataggtgtcatgaaagcagttggttatcagaatcgtggtgtcaaaggaatttttatttacgaggctatctggattgtaggcatcgccttgctgctggcatttttggttgcacaaggggtgggaagtttggcgaatgcgattgtaagtcacttttacccatccatcactaaggtttttgaattaaatcttttatctgttttaggaactctagttttcgctctattacttggttatgtctcagcctacttcccggcgcgtaagattagtaaaatggatcctgtagaatcgttacgctatgaataa

SEQ ID NO: 2064 - DNA, 339 bp, Streptococcus pneumoniae
ttggttgcaggtctaacaaatggtgagttaatcgctccaatgacttacgaagagatgatgacgagcgacttttttgaagcttggtttcagaagtttctcttaccaacattaaccacaccatcggttattattatggataatgcaagattccatagaatgggtaagttagaacttttatgcgaggagtttgggcataaacttttatctcttcctccctactcacctgagtacaatcctattgagaaaacatgggctcatatcaaaaagcacctcaaaaaggtattaccaagttgcaataccttttatgaggctcttttgtcctgctcttgtttcaattga

SEQ ID NO: 2065 - DNA, 261 bp, Streptococcus pneumoniae
atggtgtggttaatgttggtaagagaaacttctgaaaccaagcttcaaaaaagtcgctcgtcatcatctcttcgtaagtcattggagcgattaactcaccatttgttagacctgcaaccaaagaaatcctctgatatcttcttccagatactttacctcttcttaactgaccttttaatgagcgaccatattctcgataaaaataagtatcgaatcctgtttcatcaatctaaacaggtgctaggtgctttaaactattaa

SEQ ID NO: 2066 - DNA, 348 bp, Streptococcus pneumoniae
atgtggtataatcttcttatggcatattcaatagattttcgtaaaaaagttctctcttattgtgagcgaacaggtagtataacagaagcatcacacgttttccaaatctcacgtaataccatttatggctggttaaagctaaaagagaaaacaggagagctaaaccaccaagtaaaaggaacaaaaccaagaaaggttgatagagatagacttaaaaactatcttactgacaatccagacgcttatttgactgaaatagcttctgaatttggctgtcatccaactaccatccactatgcgctcaaagctatgggctacactcgaaaaaaagaaccacacctactatga

SEQ ID NO: 2067 - DNA, 900 bp, Streptococcus pneumoniae
gtgatattaaaaatagaggacttagtgatgtcaatcatttcaactgatttaaccccttttcaaatagatgatacattgaaagcagccttgcgagaagatgttcattccgaagattacagtaccaatgccatttttgatcatcatggccaagccaaggtgtcgctttttgccaaggaagctggtgttttagcgggactaaccgtttttcaaagggtttttaccctatttgatgccgaggtgaccttccagaatcctcatcaatttaaggatggggatcgtttgactagtggcgatttagttttagaaatcataggctcggtgagaagtctcttaacatgtgaacgcgttgccttgaattttttacaacatttatcagggattgcttcgatgacagctgcttatgtagaagccttaggcgatgattgcattaaggtatttgatactcgaaaaactactcctaatttacgtctttttgagaaatatgccgtgagagttggcggtggctataatcatcgctttaatttatcagatgctatcatgctaaaagacaatcacattgcggcagtaggtagtgttcagaaggcaattgctcaagcgcgtgcctatgccccttttgtgaaaatggtcgaggtggaagtggaaagccttgctgctgccgaagaagctgcggcggcgggtgctgatattatcatgttggataatatgtcattggaacagattgaacaggccattaccctaattgcaggacgttctcggattgaatgttctggaaatattgatatgaccactattagccgttttcgtggtttagcgattgattacgtctccagtggtagtttaacccatagtgctaagagtcttgatttttccatgaagggtttaacctaccttgatgtctaa

SEQ ID NO: 2068 - DNA, 1311 bp, Streptococcus pneumoniae
atgattcatttaataatgattagcgccattgctctagccattggaattggttaccgcaccaaaatcaatattggcctgctggctattgctttttcttacctcatcgcaaccactctcatgggattaagccccaaagaacttcttcatttttggccaacctcactcttttttaccatttttagcgtctctctcttttataacgttgcaacaactaacggtactcttgatgttttggctcaacacattctctaccgcacacgcacccaccctaacgccctctacatgattttatacctgatggcaacccttttgtctgctttaggtgctggatttttcactactatggccgtttgctgtcctctagcgattaccctctgtcaaaaagcggacaaacaccctttgattggagctcaagccgtcaattggggagcttcaggaggggctaatttgataaccagtagctcaggcattgtctttcaaggcctgtttaagcaaatgggatgggaagagcaagctttttcacttggcaatcatatctttatcgtcagcattatctacccactcatcgtcttgcttttattatcctgttacagtcactatagtaagggaagaacaaactcatccttgactattgaccaaccaccactcctcagcaaggttcaaagacaaaccaccttgctcatgatcagcagcatggttttggtttggctttttcccttgttgcatctcattttcccaaacatcgcctggatagctacttatcaaaaaacatttgatattggctttgtctcaatactcatggtctgcctcgccttaaggctcaaattagggaagcaagaagccattttagctaaggttccctgggctacaattatcatgctctgcggcatgagcttactaatgtctctagcggtcaagtcaggtttagtcacactgatagggcacctcatgacaacaaccattcctcatttctggttacctctgttcttttgtgtgatagccggagtgatgtcactctttagttccaccctatccgttgtagctccagccctctttcccatcattgctatcatcagtgctcaaaatcctcagattgatattcacttactcacaacagccaccgttattggcgctctatctactaatatctcacccttttcatcagctggttctctcattcaactctcacttcccaatatagaggaacgtggccttgccttcaaaaagcaaattattctgggtgtccccatcagcttaagtttgggactcttgaccacctggattctcatccttctagcttccttaagttag

SEQ ID NO: 2069 - DNA, 186 bp, Streptococcus pneumoniae
aatattgttagaaatcgatttgactatcctgatctatttgtcctgttcttatttcatttcactatatctcaaattgagtatgacgaagtgcgctcccatgtcctgggaacgcactttcttcatatttttcatattcttgaatccatcgataaagactattgggatgaatttttaaagttgaactaa

SEQ ID NO: 2070 - DNA, 195 bp, Streptococcus pneumoniae
atgaaggggaaagagtatgaaaacagaactgtttcttttgctattagttcaaaaggagaaaaaatgaaagtagaaaatatttcgtatagggtggatcatcgtatattgtttgataatatttcttttgatacttcgagttcaggcgtgacattaattactggtaaaaatggtacaggaaagtcaactttactatag

SEQ ID NO: 2071 - DNA, 729 bp, Streptococcus pneumoniae
atgagtacaaaatatttatttatttacaatgagattcgtgaaaagattctttgtaataaatataccatgaacgaacaattacctgatgaaatgacattagctaaacagtttgcctgtagtcgaatgacgatcaaaaaagctttagacttgttagtttctgagggcttaatttttagaaaacgtgggcagggaacctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttacgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcttcctag

SEQ ID NO: 2072 - DNA, 1410 bp, Streptococcus pneumoniae
atgaaaaaaaagttagtatttcctaatctgttttggtggggagcagcttctagcggacctcagacagaaggtcaatatggaaaagtacatgaaaatgtgatggactactggttcaaaacgcatccagaagattttttcgataatgtcggacctcttgtagccagtaacttttttcatacttacaccgaagatttccacttgatgaaggaaattggagttaattctttccgcacttccatccaatggagtcgactcatcaagaatttagagacaggtgagcctgatccaaaaggtattgctttctacaatgccatcattgaagaagctaaaaagaaccagatggatcttgtgatgaatttacatcattttgatttaccagtggaacttcttcaaaaatacggtggttgggaaagcaaacatgtagtggagttattcgtgaagtttgccaagactgctttcacatgctttggagataaggttcattactggacaactttcaatgagccaatggtcattccagaagcaggatacttatatgctttccattatccaaatctaaaaggaaagggaaaagaggccgtacaagtcatctataatctaaaccttgctagtgcaaaagtgattcaactatatcgctcattagaacttgatggaaagattgggattattttaaacttgacacctgcttatccaagaagtaattctccagaagacttagaagcaagtcgatttacagatgacttctttaacaaagtcttcttgaatccagctgttaaaggaactttcccagaaagattggtaaaacagctagagagagatggcgtgttatggagtcataccgaaaaagagcttcaactgatgaaatcaaatacggttgattttcttggagtaaactactaccatccaaaacgtgttcaagcacaagcaaatcctgaggaatatcagacgccctggatgccagaccaatacttcaaagagtatgaatggccggagcgtcgcatgaatccatatcgtggttgggaaatttttccgaaatccatttatgatattgctatgattgtgaaggaagaatatggtaatatcccatggtttatcagtgaaaacggaatgggtgttgaaaacgaagcacggtttatcgatgaaaatggagttatcgatgacgtgtatcgtattgaattttatgaagaacatttaagatggctacataaagccattgaagagggaagtcactgttttggataccacgcttggaccgcatttgattgctggtcttggaataatgcatataagaatcgttacggatttatctccgttgatttagaaacgcaaaagagaaccatcaagagctcaggaagatggtatcgcaaagtaagtgacaataacggttttgaagtagaaattgaggagtaa

SEQ ID NO: 2073 - DNA, 1296 bp, Streptococcus pneumoniae
atgaaaaactcaaaatttatagaccaatttgccacctttgctggtaaactagggaaccaaattcatttaaaaaccctaagagatgcattcgtaacagtaatgccattatatattttggcaggtttaatcgttcttttgaacaacacggtatttaagtggattttccaaggggatacattaacaagattccaatattggggaataacaattgcaaacggtactttaagtatttcaggtatgattattgctgtaatggttggttatttcttagctaaaaacagagatttcgaaaacccgttagcagcatcaatgctatcattagtttctttaattgtgatgatgccaaatacagtttctgtagttcctgacggagcaaaagatgctgtaaacatttcaggtgttctttcattcaacaacacaggtacaggcgcaatgttcgccggggttatcgtagcgattattgcaacagaattattcattgaattatcaaatgttaaagctttacaaatgaaccttggtgaaaatattccaccagctgttagtagatcatttagcgtattacttccagtcatgaccgtcatctccttatttggggttgtttcagcattattattcaatataactggaatgaacttaatctcaatcattacaatctttattcaagaaccaattcgtcatattggtacaagcttaatcggggtcattattatttactctttaggaaatatgttatggctatttggtattcaccaagcagttatttacagtgccatcctagaaccattactattaattaacattactgaaaacatcactgcagcaaataatggacaagccattccacacatcatcaacctatcacaaatacaaacattcgctttaatgggtggtagtggatctacattatgtttattaatagcaacattcttagtgagtcgcaatgctgtctctaaaaacgtggctaaattatcttttggacctggtatcttcaatatcaatgaaccagtattattcggttacccaatcgtttataacatttcattagctattccatttatcacagttccagtccttggtattttaatcagctacttagcaacagttacaggattcatgagtcctgcatttatacaagttccttggactacaccagtattcttaaatgcatggttagcaacagcaggggacgtgagagcagttctagttcaattcatcatctttgcacttggagttcttctatacattccatttatcaaagttaatgacaaagttgttgaacaagaaatggaaggttaa

SEQ ID NO: 2074 - DNA, 387 bp, Streptococcus pneumoniae
atgattgagattaagttcattccagttatattgaataataatgctgaaacaaccccaaataaggagatgacggtcatgactggaagtaatacgctaaatgatctactaacagctggtggaatattttcaccaaggttcatttgtaaagctttaacatttgataattcaatgaataattctgttgcaataatcgctacgataaccccggcgaacattgcgcctgtacctgtgttgttgaatgaaagaacacctgaaatgtttacagcatcttttgctccgtcaggaactacagaaactgtatttggcatcatcacaattaaagaaactaatgatagcattgatgctgctaacgggttttcgaaatctctgtttttagctaagaaataa

SEQ ID NO: 2075 - DNA, 309 bp, Streptococcus pneumoniae
atgaaacaaattttattagtatgtaatgcgggaatgtcgacaagtatgcttgttaaaaaaatgcaacaaagtgcgactgaacgtgggattgaaatctctatccaagcaaaatcaatgacagaagctaaaaagaatatccatgaagcagatgtcattctaattgggccacaaattcgttatgagttacttgctgtgaaagaaattgcaggaaatatccctgtagataccattgatatgcgggattacggaatgatgaatggagcaaaagttctggaacaagcacttgcatggataggagaaataagatga

SEQ ID NO: 2076 - DNA, 309 bp, Streptococcus pneumoniae
atgacagaagaaatggaatatatctgttttcagctcattgccaatagtggagcagccaaatcatcctttattgaagccatccaactagctaaggcaggaaatttaaaagaagcgaaaattaaagttgaagaagcggaagactccttagtagaagcgcacaagattcactctaatctcatacaaaaagaagctactggagaaaaaataggattctccttgctatttatgcatgcagaagaccaaatggcttcaacagagattattcagttgctatctaaagaattcatcgatctctatcaaaataaatag

SEQ ID NO: 2077 - DNA, 225 bp, Streptococcus pneumoniae
gatagtattttaaaacgaaaggactataaaagctcatttccttcgcacttattttatagagatctatcattatactctttagaaatcaaaaagcaacacaccttgtcatcgttttatcgtaaacctgttaatgaggggctagtcttatctgcaatctcaaatcagtgttttgagctgaatggcactcgttttctagtttgctctttgattttaattgggccttag

SEQ ID NO: 2078 - DNA, 2673 bp, Streptococcus pneumoniae
ttgaaagctatggaggaaaatatggctgataaaaaaactgtgacaccagaggaaaagaaactcgttgctgaaaaacacgtagatgagttggttcaaaaagctctagttgcccttgaagaaatgcgtaaattggatcaagagcaagttgactacatcgttgccaaagcatcagtagcagctttggatgcccacggagaattggctttacatgcctttgaagaaacaggacgtggtgtatttgaagacaaagcaactaagaacttgtttgcctgtgaacacgtagtaaacaacatgcgccacactaagacagttggcgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaggcggcttattcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatacacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtgaattagccttcctggcttatgaagaccaatgttcaccagctaacccacgtcttccaatggtagaccatatgcaagaaatcatcgaagatgcatactatggctacaaagaaagaccaggacgccgtaaataa

SEQ ID NO: 2079 - DNA, 411 bp, Streptococcus pneumoniae
gtggaaaatcttacgaatttttacgaaaagtatcgtgtttatctgactcgtccacgtttagagattttggcagtagttaccattgttttctgtgctgtactcgtcttttttctaaatattccaggaaaaggtgtcttaaaactcgataatggaacgattgtttatgatggcagtcttgtccgcggtaaaatgaatggccaaggtaccattaccttccaaaatggagaccaatatacaggtggcttcaacaatggagccttcaacggaaaaggtacctttcaatctaaagaaggctggacctacgaaggtgattttgtaaatggtcaggctgaaggaaaagggaaactaacaacagaacaagaagtcgtttatgaaggaacttttaaacaaggcgtttttcaacaaaaataa

SEQ ID NO: 2080 - DNA, 429 bp, Streptococcus pneumoniae
atgaaaaaattagtctttgtctgtctgggaaatatttgccgtagccctatggccgagtttgttatgaaatcaatgacagataactacgaaatccaaagtcgagcaacttcctcttgggaacatggcaatccgattcataaggggactcagggaatttttcaagagtatgagattccttatgacaagaacaagacatcgcttcagattagtaaggaagattttgaagcctttgattatattatcggaatggacgcttcaaatgtttccgacttacgtcagatgtgtccagtagactgtcaagataagatttactcattttcatctgaaagtgttccagacccttggtatacaggagattttgaagaaacctatcgacgtgttcaagagggttgtcaagcttggttagaacgtttagaaaaggagagttaa

SEQ ID NO: 2081 - DNA, 300 bp, Streptococcus pneumoniae
atgaatccaaatattacttttttaatcatgcttgtaggtatgatggccttgatgttctttatgcaacgttctcaaaagaaacaagctcaaaagcgtatggaaagcttaaataaactacaaaaaggctatgaagtgattacaatcggtggactttatggaacagtcgatgaagtagatacggagaagggaacaatagttcttgacgtagatggagtttacttgacttttgaactagctgctatcaagacagtattaccgctgaaagaaacagcttcactagaaggcgcaattgaaaaataa

SEQ ID NO: 2082 - DNA, 1977 bp, Streptococcus pneumoniae
atgtcaaatctatctgttaatgcaattcgttttctaggtattgacgccattaataaagccaactcaggtcatccaggtgtggttatgggagcggctccgatggcttacagcctctttacaaaacaacttcatatcaatccagctcaaccaaactggattaaccgcgaccgctttattctttcagcaggtcatggttcaatgctcctttatgctcttcttcacctttctggttttgaagatgtcagcatggatgagattaagagcttccgtcaatggggttcaaaaacaccaggtcacccagaatttggtcatacggcagggattgatgctacgacaggtcctctagggcaagggatttcaactgctactggttttgcccaagcagaacgtttcttggcagccaaatataaccgtgaaggctacaatatctttgaccactatacttacgttatctgtggagacggagacttgatggaaggtgtctcaagcgaggcagcttcatatgcaggcttgcaaaaacttgataagttggttgttctttatgattcaaatgatatcaacttggatggtgagacaaaggattcctttacagaaagtgttcgtgaccgttacaatgcctacggttggcatactgccttggttgaaaatggaacagacttggaagccatccatgctgctatcgaaacagcaaaagcttcaggcaagccatctttgattgaagtgaagacggttattggatacggttctccaaacaaacaaggaactaatgctgtacacggcgcccctcttggagcagatgaaactgcatcaactcgccaagccctcggttgggactacgaaccatttgaaattccagaacaagtatatgctgatttcaaagaacatgttgcagaccgtggcgcatcagcttatcaagcttggactaaattagttgcagattataaagaagctcatccagaactggctgcagaagtagaagccatcatcgacggacgtgatccagtcgaagtgactccagcagacttcccagctttagaaaatggtttttctcaagcaactcgtaattcaagtcaagatgccttgaatgttgtggcagctaaattaccaaccttcctaggtggatcagctgaccttgctcactcaaacatgacttatataaagacggatggacttcaagacgatgccaatcgcttgaatcgtaacattcagtttggtgttcgtgaatttgcaatgggaacaatcttgaacgggatggcccttcatggtggacttcgtgtatacggtggaactttcttcgtcttctctgactatgtgaaggcagctgtccgcttgtcagccttacaaggacttcctgtgacttatgtctttacccatgattcaatcgcagttggggaagatggtccgactcacgaaccagttgagcatttagcaggtcttcgtgctatgccaaatctaaatgttttccgtccagcagatgcgcgtgaaactcaagcagcttggtaccttgcagtgacaagtgagaaaacaccaactgcccttgttttgacacgtcaaaacttgactgttgaagatggaacagacttcgacaaggttgctaaaggtgcttatgttgtatatgaaaatgcagccgactttgataccatcttgattgcgacaggttcagaggttaatcttgctgtctcagctgctaaagaattggctagtcaaggcgaaaaaatccgcgtagtcagcatgccatctacagatgtctttgataaacaagatgcagcttacaaggaagagattcttccaaatgcagtccgtcgtcgtgttgcagtcgaaatgggtgcaagtcaaaactggtacaaatatgttggtctcgatggtgccgttctaggtattgataccttcggagcctctgccccagcaccaaaagtattggcagaatatggctttactgtagaaaatcttgtaaaaattgttcgaaacttgaaataa

SEQ ID NO: 2083 - DNA, 243 bp, Streptococcus pneumoniae
tggaaggtgtctcaagcgaggcagcttcatatgcaggcttgcaaaaacttgataagttggttgttctttatgattcaaatgatatcaacttggatggtgagacaaaggattcctttacagaaagtgttcgtgaccgttacaatgcctacggttggcatactgccttggttgaaaatggaacagacttggaagccatccatgctgctatcgaaacagcaaaagcttcaggcaagccatctttga

SEQ ID NO: 2084 - DNA, 306 bp, Streptococcus pneumoniae
ttgacgccattaataaagccaactcaggtcatccaggtgtggttatgggagcggctccgatggcttacagcctctttacaaaacaacttcatatcaatccagctcaaccaaactggattaaccgcgaccgctttattctttcagcaggtcatggttcaatgctcctttatgctcttcttcacctttctggttttgaagatgtcagcatggatgagattaagagcttccgtcaatggggttcaaaaacaccaggtcacccagaatttggtcatacggcagggattgatgctacgacaggtcctctag

SEQ ID NO: 2085 - DNA, 735 bp, Streptococcus pneumoniae
gtgatcatatcgacccatacacagttgcagcaattctcaacatttcctaagttagagcatgttaagtttatcggtcttacccactgtggacgaatctgggaaggatggggtgttccaaaagaacgtatcatcgttgttaaagcaggtgacactatcgaattaaaagatatgaagattcatgcagtagaatcatttgaccgtacttgcttggtaactctcccagtgaacggtgctgatgagacaggcggtgaacttgctggcttggctgttacagatgaagaaatggctcaaaaggctgttaactatatctttgaaacaccaggtggaaccatctatcatggtgcagattctcacttctcaaactattttgcaaaacatggtaaagactttaaaattgatgttgctttgaataactatggtgaaaatccggtaggtatccaagacaaaatgacatctatcgaccttcttcgtatggcagaaaatctgcgtaccaaagtcattatcccagttcactatgatatctggtctaacttcatggcttctactaatgagattctagaactttggaaaatgcgaaaagatcgcttgcaatacgatttccatccatttatctgggaagttggcggtaagtacacttatcctcaagatcaacacttagtagaataccatcatccacgtggttttgatgattgttttgaacaagactctaacattcaatttaaagctttgctataa

SEQ ID NO: 2086 - DNA, 408 bp, Streptococcus pneumoniae
atgccaaacgtcaaagaaattacaagagagtcatggattttagccactttcccagagtggggaacatggttgaacgaagaaatcgaagaagaagtcgtacctgaaggcaactttgccatgtggtggctaggcaactgtggtacttggattaagacaccagctggtgctaacgttgtcatggacctttggtcaaaccgtggaaaatcaaccaaaaaagtgaaagatatggttcgtgggcaccaaatggcaaatatggcaggtgttcgtaagttgcaaccaaacttgcgtgttcagccaatggttatcgatccatttgctatcaacgaactagactattacttagtttcacacttccacagtgatcatatcgacccatacacagttgcagcaattctcaacatttcctaa

SEQ ID NO: 2087 - DNA, 1674 bp, Streptococcus pneumoniae
atggtactggataaggcaagttgtgatttgcttcaatatttgatggatcaagaaacgtccaaaacgattatggcgatttcgaaagatttgaaagagtcaagaaggaaaatttattatcacattgacaaaatcaatgctgctctggttgacgaggcgcttcacatcattagtattccacgaattggtattcacttaacggaagagcagagagatgcttgttgtaaactattatcggaagtagattcgtacgattatatcatgagtgcgcatgaacgtatgatgataatgttactatggataggtatttctaaagaacgtattacgattgaaaaattgatagagttaacagaggtatctaggaatactgttctcaatgatttgaatagcattcgttatcaactaactttggaacaatatcaggtgaccttgcaagtgagcaagtcacagggataccaccttcatgcccaccctcttaataaaattcagtatcttcaatcgcttctatatcatatttttatggaagaaaatgccacttttgtatctattttagaagataagatgaaagagaggttagatgatgagtgtttgctttctgttgaaatgaaccaattttttaaggaacaggttcctttagttgaacaagatttagggaagaaaataaaccatcatgaaataacttttatgttgcaggttctaccttatttgctgttaagctgtcataatgttgaacagtatcaagaaagacatcaggatatagagaaagaattttctttgataagaaaaagaatagagtatcaggtgtctaagaaattaggagaacggttgtttcaaaagtttgaaatttctttgtcaggacttgaagtttctcttgtagctgttctcctcctctcctatcgtaaagatttggatattcatgcagaaagtgatgattttcgtcaattaaaacttgctttagaagaatttatctggtattttgaatcacaaatccgaatggagattgagaacaaggatgatttgttacgaaatttgatgatccactgtaaagccttgttatttagaaagacttacggtattttttctaaaaatcctctaacaaaacaaattcgatccaagtatggagaattatttttagtcactagaaaatctgcggaaattttagaaggagcatggtttattcggctaacagacgatgatattgcctatttgacgattcatattggaggatttttaaagtatacaccatcgtctcaaaaaaatatgaaaaaagtttatctcgtttgtgatgaaggtgttgcggtttcgagacttttgctgaaacaatgcaaactttattttccaaatgagcaaattgacactgtatttacaacagaacaatttaagagtgtggaagatattgcacaagttgatgtagtgattactactaatgatgatttggatagcagatttccgattttaagggttaatcctatccttgaagcagaagatattttgaaaatgctagactatcttaaacacaatatatttcgtaataagagcaaaagtttcagtgaaaatctttctagtcttatttcgtcttatattgtagacagcaagttggctagtaagttccaagaagaggttcaaacacttataaatcaagaaatagtagttcaagcttttttggaagatatttga

SEQ ID NO: 2088 - DNA, 705 bp, Streptococcus pneumoniae
atgaatcaagtaatcaatgctatgcgtaaacgagtctgtgatgccaatcaatcattgccaaaacatggacttgtcaaatttacctgggggaatgtatctgaagtcaatcgcgaactcggtgtcattgttatcaaaccatcaggcgtggattatgacgaattgacacctgaaaacatggtagtgactgatctagatggtaagatcctagaaggggatttaagaccatcttccgacctcccaactcatgtgcaattatataaggcttggtcagaaattggtagtgtggttcacacccattcgacagaagctgttggttgggctcaggcaggtcgtgatattcctttctacggaacaacccatgcagattatttctacggttcaatcccttgcgcccgtagtttgaccaaggacgaagtagaagtggcctatgaaaaagatactggcctggttatcgtagaagagtttgaacatcgcggacttaacccggttgaagtaccaggaattgttgtacgcaatcacggtccattcacctggggcaaaaatccagaggatgctgtttatcactctgtcgtactagaggaagtatcaaagatgaatcgctttacagaacaaatcaattcaagagttgaacctgctccccagtacatactagagaaacactaccaacgtaaacatggaccaaatgcttattatggtcaaaagtaa

SEQ ID NO: 2089 - DNA, 864 bp, Streptococcus pneumoniae
atggtacgtccaattggaatttatgaaaaggcaaccccaacacactttacttggctagaacgtttaaattttgccaaggagttaggctttgattttgtcgagatgtctattgacgaacgtgacgagcgtttagcaagacttgactggagtaaggaagaacgcttggaagttgtcaaagcaatctatgaaactggtgttcgtattccttctatctgtttttcaggccatcgtcgctacccattgggttcaaaagatccagttctagaggaaaaatctctagaactcatgaaaaaatgtatcgaattagctcaagacttgggagttcgtacgattcaattagctggttacgatgtttactatgaggaaaagtcaccccagacacgccaacgttttatcaaaaatttgagaaaagcctgtgactgggctgaagaagctcaggtggtacttgctattgaaattatggatgatcctttcatcagtagcatcgaaaaatatttggctatagaaaaagagattgactctcccttcctctttgtatatccagatattggtaatgtgtctgcatggcataatgatatctatagtgagttttatcttggtcatcatgccatcgcagctctccatctcaaggatacttatgcagtgacagaaagttcaaagggccagttccgagatgtacctttcgggcaaggttgtgtcaaatgggaagaagctttcgatattttaaaggaaaccaattataatggacctttcctaatcgaaatgtggtctgaaaattgtgaaacagtagaagaaacacgcgcagccattcaagaggcgcaagcttttctctatccactcattaagaaagcaggtttgatgtaa

SEQ ID NO: 2090 - DNA, 666 bp, Streptococcus pneumoniae
atgacaaaaagaatacctaatttacaagttgcattagaccattcagacttgcaaggagcgattaaagcagctgtttctgttggtcaggaagtagatattatcgaagctggaactgtttgcttgcttcaagttggaagtgaactggctgaagtcttgcgtagccttttcccagataagattattgtggcagacacaaaatgtgctgatgctggtggaacagttgctaaaaataatgcggttcgtggagcagactggatgacttgtatctgttgtgcaaccatccctactatggaagcagctctaaaggctatcaagactgaacgaggagaacgaggcgaaatccagatcgagctttatggcgattggacttttgaacaagctcagctttggctagatgcaggtatctcacaagctatttatcaccaatctcgtgatgctcttcttgctggtgaaacttggggtgaaaaagaccttaataaggttaaaaaactcattgacatgggcttccgtgtatctgtaacaggtggtctagatgtagatactctcaaactctttgaaggtgttgatatctttacctttatcgcaggtcgtggaattacagaggctgcggatccagcaggagcagcgcgtgccttcaaggatgaaatcaaacgaatttgggggtaa

SEQ ID NO: 2091 - DNA, 486 bp, Streptococcus pneumoniae
atgaatttaaaacaagctttaattgacaatgactcgatccgactaggtttagaggctaacaattggaaagaagcagtcaaggtagcagtagatcccttaattgaaagtggggcaattttgccagagtattacgatgctatcattgaatcgactgaagagtatgggccttactatatcttgatgccaggtatggctatgccccacgctagacctgaagctggtgtgcaaagtgatgccttttcattgattaccttacaaaatcctgttgtattttcagatgggaaagaggtatctgttttgttggcactagcagcaacaagttcaaaaattcacacaagtgtagccattccacaaattattgccctgtttgaattagaagattctattgcacgtttacaggcttgccagactaaagaagatgtcttggctatgattgaagaatctaaggatagcccttatctcgaaggattggatttggaaagttag

SEQ ID NO: 2092 - DNA, 282 bp, Streptococcus pneumoniae
atggttaaagtattagcagcgtgcggaaatggaatgggttcatcaatggttatcaagatgaaggttgaaaatgctctccgtaagcttaatcaaacagattttacagtcaattcatgcagtgtcggtgaagctaaaggtttagcagtaggatatgacatcgtaatcgcttctcttcatttgattcaagaattggaagggcgaactaatgggaagttaattgggcttgataacttgatggatgataaagaaatcaccgaaaaactcagtcaagcactacagtaa

SEQ ID NO: 2093 - DNA, 1527 bp, Streptococcus pneumoniae
ttggtctttttgtttgcgctttcgcattatataataaacttacaaaaacaattcaaaaggagaacaattatggaagtcgtttcaagtgttctaaattggttttctagcaatattttgcagaatcccgcatttttcgtaggtttattggtgttgataggatatgcacttttgaaaaaacctgcccatgacgttttttcagggtttgttaaagcaacagtagggtatatgttgcttaacgtgggtgctggtggtttggttacaacctttcgtccaatcttagcagctcttaactacaaattccaaattggtgcagcggttatcgacccttactttggacttgctgcagcaaacaacaaaattgtagcagagtttccagattttgttggaactgcaactacagctctattgattggttttggaataaatatcttgctcgtagctcttcgaaagattacgaaggtaagaaccctctttattactggtcacatcatggtacaacaagctgcaacagtatctcttatggttctattcttagtaccacaattgcgcaatgcttacggtacagcagcgattggtatcatctgtggactttactgggcagttagttcaaatatgactgttgaggcaactcaacgcttgactggtggtggcggatttgcgattggtcaccaacagcaatttgcaatctggtttgtagataaagtagcaggacgctttggtaagaaagaagaaagtttagacaatcttaaattacctaagttcctctcaatcttccacgatacagttgttgcatctgctaccttgatgctcgtattcttcggagccattcttttaatcttgggtccagacattatgtctaataaagaagtcatcacttcaggaactctattcaatcctgctaaacaagatttctttatgtacattatccaaacagcctttaccttctcagtttacttgttcgttttgatgcaaggtgtccgaatgttcgtatctgagttgacaaacgccttccaaggtatttcaaacaaattgttgccaggttcattcccagcggttgacgttgcagcttcttatggatttggttctccaaatgctgtcttgtcaggatttacctttggtttgattggtcaattgattacaattgttttgctcatcgtctttaaaaatccgattcttattattacaggatttgtaccagtgttctttgacaatgcagccattgcggtctacgctgataaacgcggcggatggaaagcggctgttatcctttcctttatatcaggtgtccttcaagttgctctaggagctctttgtgtggcccttctcgatttggcatcttatggtggctaccatggaaatatcgactttgaattcccatggcttggatttggatatatcttcaaataccttggtattgttggttatgtacttgtgtgtctcttcttgcttgttattcctcaacttcaatttgccaaagcaaaagataaagagaaatattacaacggtgaagttcaagaagaagcttag

SEQ ID NO: 2094 - DNA, 624 bp, Streptococcus pneumoniae
atgttgaataagataagagactatctagacttttctggtttgcagtaccgtagtcctgataaagcgggagcagagcgagagaagatgctggcgttccgccacaaaggacaagaggcccgaaaggcttttacagaactggccaaagcctttcaagcaagccatccagaatggcaactccaacagactagtcagtggatgaatcaggcccagcgtttgagaccacatttttgggtttatctacagagagacggacaagtgacagaacctatgatggccttacgtttgtatgggacatctactgactttggaatttctttggaagtcagtttcatcgaacgtaagaaggatgagcaaacactgggcaagcaggccaaagttttagacattccaaccgttaaagggatttattatctaacctactctaatggtcaaagtcaacggtgggaggcgaatgaagaaaagcgtcgtactttacgcgagaaggtgagaagtcaagaagttcgaaaagttttagtgaaggtagatgttcctatgacagaaaattcgtctgaagaagaaatcgtagaaggcttattgaagtcttattctaaaattcttccctattatctagctacgagaaaataa

SEQ ID NO: 2095 - DNA, 987 bp, Streptococcus pneumoniae
atggtagtatttacaggttcaactgttgaagaagcaatccagaaaggattgaaagaattagatattccaagaatgaaggctcatatcaaagtcatttctagggagaaaaaaggctttcttggtctatttggtaaaaaaccagcccaagtggatattgaagcgattagtgaaacgactgttgtcaaagcaaatcaacaggtagtaaaaggcgttccgaaaaaaatcaatgatttgaacgagcctgtgaagacggttagtgaagaaaccgttgaccttggtcatgtggttaatgctattaaaaaaatagaggaagaaggtcaaggtatttctgatgaagtcaaggctgaaatcttaaaacatgaaagacatgccagcactatcttagaagaaactggtcacattgagattttaaatgaacttcaaatcgaggaagcgatgagggaagaagcaggcgctgatgaccttgaaactgagcaagatcaaactgaaaatcaagacttgaaagagatgggcttgaaggtcgagcaaagttatgatattgcccaggtggctacggatgtgactgcctatgttcaagcgattgtggatgacatggatgttgaagctacactttcaaatgattataaccgtcgtagcatcaatctacaaattgacaccaacgaaccaggtcgtattatcggctaccatggtaaagtcttgaaggccttgcaactgttggctcaaaattatctttacaaccgctattccaaaaccttctacgttacaatcaatgtcaatgattatgtcgaacaccgtgcagaagtcttgcagacctatgcgcaaaaattggcgaatcgtgttttggaagaaggtcgcagtcataaaacagatccaatgtcaaatagcgaacgcaagattatccatcgtattatttcacgtatggatggcgtgactagttactctgaaggtgatgagccaaatcgctatgttgttgtagatacagaataa

SEQ ID NO: 2096 - DNA, 831 bp, Streptococcus pneumoniae
atgggagtgaaaaagaaactaaagttgactagtttgctaggactgtctctgttaatcatgacagcctgtgcgactaatggggtaactagcgatattacagccgaatcggctgatttttggagtaaattggtttacttctttgcggaaatcattcgctttttatcgtttgatattagtatcggagtggggattattctctttacggtcttgattcgtacagtcctcttgccagtctttcaggtgcaaatggtggcttctaggaaaatgcaggaagctcagccacgcattaaggcgcttcgagaacaatatccaggtcgagatatggaaagcagaaccaaactagagcaggaaatgcgtaaagtatttaaagaaatgggtgtcagacagtcagactctctttggccgattttgattcagatgccggttattttggccctgttccaagccctatcaagagttgactttttaaagacaggtcatttcttatggattaaccttggtagtgtggatacaacccttgttcttccgattttagcagcagtattcacctttttaagtacttggttgtccaacaaagctttgtctgagcgaaatggcgctacgactgcgatgatgtatgggattccagtcttgatttttatctttgcagtttatgcgccaggtggagtcgccctatactggacagtgtctaatgcttatcaagtcttgcaaacctatttcttgaataatccattcaagattatcgcagagcgcgaggccgtagtacaggcacaaaaagatttggaaaatagaaaaagaaaagccaagaaaaaggctcagaaaacgaaataa

SEQ ID NO: 2097 - DNA, 372 bp, Streptococcus pneumoniae
ttgaagaaaaactttcgtgtaaaaagagagaaagattttaaggcgattttcaaggaggggacaagttttgctaatcgcaaatttgtgatctaccaattagaaaaccagaaaaaccattttcgagtaggtctatcagttagcaaaaaactggggaatgccgtcactagaaatcaaattaagcgacggattcggcatattatccagaatgcaaaagggagtctggtagaagatgtcgactttgttgtcattgctcgaaaaggagtcgaagccttgggatacgcagagatggagaaaaatctactccacgtattaaaattatcaaagatttaccaggaaggaaatgggagtgaaaaagaaactaaagttgactag

SEQ ID NO: 2098 - DNA, 1191 bp, Streptococcus pneumoniae
atgacaaaaacaattgcaatcaatgcaggaagttcaagtttgaaatggcaattatacttaatgccagaagaaaaagtattggcgaaaggtttgattgaacgtatcggtttgaaagattcaatttcaactgtaaaatttgacggccgttctgaacaacaaattttggatattgaaaatcatacacaagccgttaaaattttattggatgacttgattcgtttcgatattatcaaggcttatgacgagattacaggtgttggacatcgtgttgttgctggtggagaatatttcaaagaatcaacagttgttgagggagatgttttagaaaaagttgaagagttgagtttgttggctcctctacacaacccggccaatgcagcaggtgttcgtgccttcaaggaattgttgccagacattaccagtgtagttgtttttgatacttccttccacacaagtatgccagagaaagcttatcgctaccctctaccaacaaaatattacacagaaaacaaggttcgtaaatacggtgctcatggtacaagtcaccagtttgtagcaggagaagctgcaaaactcttgggacgtccattagaagacttgaagttaattacctgtcatattggtaacggaggctcaattacagctgtgaaagccggcaaatctgtagacacttctatggggttcactcctcttggtggtattatgatgggaacgcgtacaggggatattgatccagctatcattccttatttaatgcaatatacagaggattttaacacaccagaagatatcagtcgtgttcttaaccgtgaatcaggtcttttgggagtttctgctaattctagcgatatgcgcgatatagaagcagctgtagcagaagggaatcacgaggctagcttggcttatgaaatgtatgttgaccgtatccaaaaacatatcggtcagtaccttgcagtgctaaatggagcagatgccattgttttcacagcaggtgtcggtgaaaatgcagagagtttccgtcgtgatgtaatctcagggatttcgtggtttggttgtgatgttgatgatgaaaagaatgtctttggcgttacaggagacatctcaacagaggcagctaaaatccgtgtcttggttattccaacagatgaagaattagtcattgcccgtgacgttgaacgcttgaaaaaataa

SEQ ID NO: 2099 - DNA, 954 bp, Streptococcus pneumoniae
atggattttgaaaaaattgaacaagcttatacctatttactagagaatgtccaagtcatccaaagtgatttggcgaccaacttttatgacgccttggtggagcaaaacagcatctatctggatggtgagactgagctagaacaggtcaaagacaacaatcagacccttaagcgtttagcactacgcaaagaagaatggctcaagacctaccagtttctcttgatgaaggctgggcaaacagaacccttgcaggccaatcaccagtttacaccggatgctattgctttacttttggtgtttattgtggaagagttgtttacagaggaggaaattactatcctcgaaatgggttctgggatgggaattctaggcgctactttcttgacctcgcttgataaaaaggtggattacttgggaatggaagtggatgatttgctgattgatctggcagctagcatggcagatgtaattggtttgcaggctggctttgtccaaggagatgccgttcgcccacaaatgctcaaagaaagcgatgtggtcatcagtgacttgcctgttggctattatcctgatgatgccgttgcgtcgcgccatcaagttgcttctagccaagaacatacttacgctcatcacttgctcatggaacaagggtttaagtaccttaagtcagatggatatgctatttttctagctccgagtgatttgttgaccagtcctcaaagtgatttgttgaaagtctggttgaaagaggaggcaagtctggttgctatgattagtctgcctgaaaatctctttgctaatgccaaacaatctaagactatttttatcttacagaagaaaaatgaaatagcagtagagccttttgtttatccacttgctagcttgcaagatgcaagtgttttaatgaaatttaaagaaaattttcaaaaatggactcaaggtactgaaatataa

SEQ ID NO: 2100 - DNA, 588 bp, Streptococcus pneumoniae
atgaaacatgattttaaccacaaagcagaaactttcgattcccctaaaaatatcttcctcgcaaacttggtatgtcaagcagtcgagaaacagattgatattttatcagacaaagtaattttagatttcggtggtggcacgggtctattagccttgcccctagccaagcaggctaagtcagtcactcttgtagacatttctgagaaaatgttggagcaagctcgtttgaaagtggagcagcaagcaatcaagaatatccagtttttggagcaagatttaccgaaaaatcccttggagaaagagtttgattgccttgctgttagtcgggttcttcatcatatgcctgatttggatgcggctctctcactgtttcatcaacatttgaaggaagatgggaaactcatcattgctgattttaccaagacagaagctaatcatcatggatttgatttagctgaactggaaaacaagctaattgagcatggtttttcatctgtgcatagtcagattctctatagcgctgaagacctgtttcaaggaaatcactcagaattctttttaatagtagcccaaaaatcactcgcctag

SEQ ID NO: 2101 - DNA, 414 bp, Streptococcus pneumoniae
gtgtggaaaaagaagaaagttaaggcaggtgttctcctctacgcagtcaccatagcagccatctttagtcttttgttgcaattttatttgaaccgacaaatcgcccactatcaagactatgctttaaataaagaaaaattggttgcttttgccatggctaaacgaaccaaagataaggttgagcaagaaagtggggaacagttttttaatctaggtcaggtaagctatcaaaacaagaaaactggcttagtgacgagggttcgtacggataagagtcaatatgagtttctgtttccttcagtcaaaatcaaagaagagaaaagagataaaaaggaagaggtagcgaccgattcaagcgaaaaagtggagaagaaaaaatcagaagagaagcctgaaaagaaagagaattcctag

SEQ ID NO: 2102 - DNA, 507 bp, Streptococcus pneumoniae
ttgagattcaggtattttctagtgaaaaaggattggaggtctaccatggttcagaacagttgttggcaatcaaagagccataaggtcaaggcttttaccttgttagaatccctgcttgccctcattgtcatcagtgggggattactcctttttcaagctatgagtcagctcctcatttcagaagttcgctaccagcaacaaagcgagcaaaaggagtggctcttgtttgtggaccaacttgaggcagaattagaccgttcgcagttcgaaaaagtagaaggcaatcgcctatacatgaagcaagatggcaaggacatcgccatcggtaagtcaaagtcagacgattttcgtaaaaccgatgctagtggacgggggtatcagcctatggtttatggcctcaaatcagctcagattacagaggacaatcaactggttcattttcgtttccagtttcaaaaaggcttagaaagggagttcatctatcgtgtggaaaaagaagaaagttaa

SEQ ID NO: 2103 - DNA, 303 bp, Streptococcus pneumoniae
atggaaaaattaaacgcattaaggaaacaaaaaattagggcagtgattttactggaagcagtagtcgctctagctatctttgccagcattgcgaccctccttttgggacaaattcaaaaaaataggcaagaggaagcaaaaatcttgcaaaaggaagaagtcttgagggtagctaagatggccttgcagacggggcaaaatcaggtaagcatcaacggagttgagattcaggtattttctagtgaaaaaggattggaggtctaccatggttcagaacagttgttggcaatcaaagagccataa

SEQ ID NO: 2104 - DNA, 405 bp, Streptococcus pneumoniae
atgattaaggcctttaccatgctggaaagtctcttggctttgagtcttgtgagtatccttgccttgggcttgtccggctctgttcagtccacttttgcggcagtagaggaacagattttctttatggagtttgaagaactctatcgggaaacccaaaaacgcagtgtagccagtcagcaaaagactagtctgaacttagatgggcagacgattagcaatggcagtcaaaagttgccagtccctaaaggaattcaggccccatcaggccaaagtattacatttgaccgtgctgggggcaattcgtccctggctaaggttgaatttcagaccagtaaaggagcgattcgctatcaattatatctaggaaatggaaaaattaaacgcattaaggaaacaaaaaattag

SEQ ID NO: 2105 - DNA, 327 bp, Streptococcus pneumoniae
atgaaaaaaatgatgacattcttgaaaaaagctaaggttaaagcttttacattggtggagatgttggtggtcttgctgattatcagcgtgcttttcttgctctttgtacctaatctgaccaagcaaaaagaggcagtcaatgacaaaggaaaagcagctgttgttaaggtggtggaaagccaggcagaactttatagcttggaaaagaatgaagatgctagcctaagcaagttacaagcagatgggcgaatcacggaagaacaggctaaagcttataaagaataccatgataaaaatggagtagcaaatcgtaaagtcaatgattaa

SEQ ID NO: 2106 - DNA, 1044 bp, Streptococcus pneumoniae
atgagcaaattgaccagcttcttaaagatggacatatcacaagtcttcaggctgagacggaaaaaattagctacagctaagcaaaaaaatatcatcaccctatttaacaatctcttttctagcggttttcatctggtggagactatctcctttttagataggagtgctttgttggacaagcagtgtgtgacccagatgcgtgtgggcttgtctcaggggaaatcattctcagaaatgatggaaagtttgggatgttcaagtgctattgtcactcagttatccctagctgaagttcatggcaatctccacctgagtttgggaaagatagaagaatatctggacaatctggctaaggtcaagaaaaaattgattgaagtagcgacctatcccttgattttgctgggttttcttctcttaattatgctggggctacggaattacctgctcccacaactggatagtagcaatattgccacccaaattatcggtaatctgccccaaatttttctaggcatggtagggcttgtttccgtgcttgcccttttagcactcactttttataaaagaagttctaagatgagtgtcttttctatcttagcacgccttccctttattggaatctttgtgcagacctacttgacagcctattatgcacgtgaatgggggaatatgatttcacagggaatggagttgacgcagatttttcaaatgatgcaggaacaaggttcccagctctttaaagaagtcggtcaagatctggctcaaaccctgaaaaatggccgtgaattttctcagacgataggaacctatcctttctttaggaaggaattgagtctcatcatagagtatggggaagttaagtccaagctgggtagtgagttggaaatctatgctgaaaaaacttgggaagccttttttacccgagtcaaccgcaccatgaatttggtgcagccactggtttttatctttgtggcactgattatcgttttactttatgcggcaatgctcatgcccatgtatcaaaatatggaggtaaatttttaa

SEQ ID NO: 2107 - DNA, 942 bp, Streptococcus pneumoniae
atggttcaagaaattgcacaagaaatcattcgttcagctcggaaaaaagggacgcaggatatctattttgtccctaagttagacgcctatgagcttcatatgagggtaggagacgagcgctgtaaaattggtagctatgattttgaaaagtttgcagccgttatcagtcactttaagtttgtggcgggtatgaatgtgggagaaaaaagacgtagtcaactgggttcctgtgattatgcctatgaccataagatagcgtctctacgtttatctactgtaggcgattatcgggggcatgagagtttggttatccgtttgttgcacgatgaggagcaggacctgcatttttggtttcaggatattgaagaattaggcaagcagtacaggcaacggggactctatctttttgctggtccggttgggagtggtaagacgaccttgatgcatgaattgtccaagtcactctttaaaggacagcaagttatgtccatcgaagatcctgtcgaaatcaagcaggacgacatgcttcagttgcagttgaacgaagcaatcggcctaacctatgaaaatctaatcaaactttccttgcgtcatcgaccagatctcttgattatcggagaaattcgtgacagcgagacggcgcgtgcagtggtcagagctagtttgacaggtgcgacagtcttttcaaccattcacgccaagagtatccgaggtgtttatgagcgtctgctggagttgggtgtgagtgaagaagaattggcagttgttctgcaaggagtctgctaccagagattaatcgggggaggaggaatcgttgactttgcaagcagagattatcaagaacaccaagcagccaagtggaatgagcaaattgaccagcttcttaaagatggacatatcacaagtcttcaggctgagacggaaaaaattagctacagctaa

SEQ ID NO: 2108 - DNA, 372 bp, Streptococcus pneumoniae
atgaatatgtatcgtgttatagaaatgtacggagattttgaaccgtggtggttcttagaaggttgggaagaagatattgtagcaagtagaaaatttgaccagtattatgatgctctcaaatactacaaaacttgctggtttagattggaacaagaatcgcctctttataaaagtagaagcgacttgatgaccattttttgggacccggaagaccaacgctggtgtgatgaatgtgatgagtatttacaacaataccattctttggctcttttgcaggatgagcaggttatcccagacgaaaaactacgctcaggctatgaaaaacaaaccagtcaggaaaggaatcgttcttgccgtatgaaattaaaatag

SEQ ID NO: 2109 - DNA, 1059 bp, Streptococcus pneumoniae
atgaaagcctatacttatgttaaaccaggacttgcttcttttgttgatgtagacaaaccagttattcgcaagccaacagacgctattgtgcgtattgtaaaaaccactatttgtggaacagacctccatattatcaaaggggatgttcctacttgccaaagtggtaccattcttggccacgaagggattgggattgttgaagaagttggggaaggagtttccaacttcaaaaaaggtgacaaggtcttgatttcttgcgtctgtgcctgtggtaaatgctactactgtaaaaaaggaatttatgctcactgtgaagacgaagggggctggattttcggtcacttgattgatggtatgcaggctgaatatctacgtgtccctcatgcagataatactctttaccatactccagaagacttgtcagatgaagctttggttatgctgtcagacattctgcctactggatatgaaattggtgtcttaaaagggaaagtagaacctggttgcagcgtagccattattggttcaggtccagttggattggctgctcttttaacagcccaattctattcaccagctaaattgattatggtagacctagacgataaccgcttggaaactgccctatcattcggtgcgactcataaggttaattcttcagaccctgaaaaagccattaaagaaatttatgatttgacagatggtcgtggtgtggatgtcgctatcgaagctgttggtattcctgcaacatttgatttctgtcaaaagattatcggtgtagacggaacggttgccaactgtggtgtgcatggtaaaccagttgaattcgatttagataaactttggattcgcaacatcaatgtaacaactggtttggtatctacaaatacgactccacaattgttgaaagcacttgaaagtcataagattgaaccggaaaaattggtaactcactatttcaaactcagtgaaattgaaaaagcctacgaagtcttcagtaaggcagcagaccaccatgccattaaggtcattatcgaaaacgatatctcagaagcctaa

SEQ ID NO: 2110 - DNA, 426 bp, Streptococcus pneumoniae
gtgaccgaaaatccagcccccttcgtcttcacagtgagcataaattccttttttacagtagtagcatttaccacaggcacagacgcaagaaatcaagaccttgtcaccttttttgaagttggaaactccttccccaacttcttcaacaatcccaatcccttcgtggccaagaatggtaccactttggcaagtaggaacatcccctttgataatatggaggtctgttccacaaatagtggtttttacaatacgcacaatagcgtctgttggcttgcgaataactggtttgtctacatcaacaaaagaagcaagtcctggtttaacataagtataggctttcataaagcactcctccgtttttttatttgtaatatttatagttcaattgtaagcctttttctttgtttcttcaagctttttttgtga

SEQ ID NO: 2111 - DNA, 1152 bp, Streptococcus pneumoniae
atgcctaactatattaaagcggatcagtttttctacccacacggagttcgtcgaggtggttacttggaacttgtggacggcaagtttgggaaacatgtagagcagattcctgaaggggctgaggtgattgactatacaggttatagcattgccccaggtcttgtggatactcatattcatggatatgcaggtgtagatgtgatggacaacaacattgaaggtacattgcatactatgagtgaaggacttcttagtaccggtgttaccagtttcttacccacaactttaacagccacttatgagcaattgcttgcagtcactgaaaatcttggaaaccattataaagaagcaacaggtgctaagattcgtgggatttattatgaaggtccatatttcacagaaacttttaagggggcacaaaatccaacttatatgagagacccgggtgttgaggagtttcattcttggcaaaaagcggcaaatggcttgcttaataaaattgcccttgcaccagaacgtgatggggtggaagactttgttcgtacagttacgggcgaaggtgtgacggttgctcttggacattcaaacgcgacttttgatgaagccaaaaaagcagtcgatgctggagcgagtgtttgggtgcatgcctacaatggaatgcgtgggttgactcaccgtgaattgggtatggttggagccatgtaccaattgccacatacctatgcagagttgatctgtgatggtcaccacgtagatccaaaggcttgcgaaattcttatcaaacaaaaaggaacagaaaacatcgctcttatcacagactgtatgacagctgggggattggaagacggagattatatgttgggagaattcccagttgtcgttgcaaatggaactgcacgcctcaaatcgacaggtaacttggcaggttctatcctcaaactcaaagatggtttgaagaatgtggtcgaatggggaattgcgaatccgcatgaagcagtcatgatggccagcttcaacccagctaaatccgttcacatcgatgacgtctgtggccaaatccgtgaaggctacgacgctgacttcatcgtattagataaagatttggaattggtagcaacctacctagatggcgtaaaacgttatcaagcataa

SEQ ID NO: 2112 - DNA, 1818 bp, Streptococcus pneumoniae
  unsure (435): n at each above location is unknown.
atgcgcattaaatggttttccttgattaggattataggtttacttttggtactcttgtatcacttctttcagacgatctttcctggaggatttttcggggtagatgtctttttcacattttcaggtttcctgattacagctctactcattgaagaattttctaaaaaccatgagattgatttgataggattttttagaagacgcttttatcggattgtgccacctgtggttttgatggtcttggtgaccatgccttttactttcttggttcgccaagactatgttgctggaattggtggccagattgcgagcgtcttaggctttatgaccaacttctatgaactcctaacaggtgggagttatgaatctcagttccatcctcatttgtttgttcataattggagtctggcagttgaggttcactactatattctntggggattggcagtttggttcttatccacacacgctaaatcaaatggtcagttgaaggggatggtctttctcttatctgctgttgccttcttgatcagtttcttctccatgtttattggtagttttctagtgacctcttattcctctgtttatttctccagtttaactcatgtctatccattctttttgggaagtatgttagcaactattgtaggcgttcgtcagacgacttccctcgtcaagcagttggataaaatctgggatttacgaaagactttggtagtttttggaggaggctttggtttcctagttcttttgactttctttgtcaaattcacttatctttttgcctatcttatcggcttcttacttgccagtcttgcagctcttgccatgattctggcggcgcgtgtcttacatgaaaagacacatcatatacaggagccgaagattatcagctttttagcggatactagctatgcggtttatcttttccattggcctttctatatcattttctcacagttgacatcaaatcttcttgctgtattactgactctgatttgttcttatggctttgccagtctgtcattttatgtattggaaccttggattgcaggcaagaacacacctattgtccaaacccttcgtcccctgccttatattcacgcaattcttgcagcaggtacaggaatcttgaccatcattgtctgcacggtgaccttgttggcaccacaagtgggagcgtttgagacagacttgactgtcaatggcttgaagcaagctgcaacaaatattggccagaccaaggtgatggcagaacgggcagatgcaaacagtttgggaattgctgatggcactatgttaattggtgactcagtggctttaagggcaaatacagcactacagacagctcttcctggagcacagattaacgcgcaggtcagcgtaacaaccaagaccgcaaatgaaatcatgctaaataatagccagaataaatttttacctaagacggtggtcattgcgactggggtaaataatcctgagaattacaaggatgactgggacagtatcgtgaaaaatcttcctaagggacaccatatgattttggtgactccttatgagggagataagacaaaagagacctatgccatcgttgagaaggctgctgcctatatgagagaattggcagagaagacaccttacattacgatagcagattggaatcaagttgcgaaagagcatccagaaatttgggcaggaacagaccaggttcatttcgggagtgagagtagcactatcgaagcaggagcaaaattgtatgcagatacgattgccacagctttgcagacagctcaagacaagccggttaaatcaaaataa

SEQ ID NO: 2113 - DNA, 1143 bp, Streptococcus pneumoniae
atgtcagattcaccaatcaaatatcgtttgattaagaaagaaaaacacacaggagctcgtctgggagaaatcatcactccccacggtacctttccgacacctatgtttatgccagttgggacacaagccactgtcaaaactcagtcacctgaagaattgaaggagatgggttcgggaattatcctatcaaacacctatcatctctggcttcgccctggagatgaactcattgcacgcgctggtggtctccacaagttcatgaattgggaccagcctatcttgacagatagtggtggttttcaggtttattctttagcagatagccgtaatatcacagaagaaggagtaacctttaaaaatcatctaaatggttctaagatgttcctatccccagaaaaagccatctctattcagaataatctgggttcagacatcatgatgtcctttgatgaatgtcctcagttttatcaaccttatgactacgttaagaaatcgatcgagcgtaccagccgttgggctgagcgtggtttgaaggctcaccgtcgtccacatgaccaaggtttgtttggaattgtgcaaggtgcaggatttgaagaccttcgccgccaatcagctcatgatcttgtcagcatggatttctcaggctactctatcggtggtttggcagtgggagaaacccatgaagagatgaatgcggtcttggactttacaactcaactgctgcctgaaaataaacctcgttatctgatgggtgtgggagcgccagatagcttgatcgatggggtcattcgtggggtggatatgtttgactgtgtcttaccgactcgaattgctcgtaacgggacttgtatgaccagtcaaggacgtttggttgtgaaaaatgcccagtttgctgaggactttacgccactggatcctgagtgtgattgctacacatgtaataactatacacgcgcttaccttcgtcacctgctcaaggctgatgaaacctttggtatccgcttgactagctaccacaatctttacttcttgcttaacctgatgaagcaagtgcgacaagccatcatggatgacaatctcttggaattccgtgagtattttgtggaaaaatatggctataataagtcaggacgtaatttctaa

SEQ ID NO: 2114 - DNA, 858 bp, Streptococcus pneumoniae
atgaactatccaaaaattgatttaaaaacaattcgtcaggagtcaaaacattttcaggctgacaccccccgtctctttctcctctatatccttcccagtatgctggtcatcttatctggttttcttaatcccttatctcggatccacgggactgttttagaacagccatttttcagcatacttggccaaatacttcaaacctacctctttcctctactagtctcctttatcgggactattcttttgaccagttccgtctatgcaacactgacactcatgaaagattctaaaacggagccatctgtaaaaaacagcctagctctctttgatgaggagcgcttttctcaaacctttttgaccctacttctcaaacgtttctatctctttttatggagtatccctaatttacttgggatttacctcctcttttatagtagctttttagccaaaaaattcgtcaccctacatcctgagtttccaaatctagatctctcatcagttgaaaccgagcgtttcctcatggtctttggactctactttcttgcaagtctcatcttgatcattgtaggaaatatcctctatattccacagtattatgcctattcacaggtggaatttcttctctgttatagtctagacctaggacaggtcccaccaagacgaatcctaaaaactagccgttcctttatgaagggctacaagttccagcactttgtcctagatttacagcttcttccttggtacttcctcaattggattacctttggcattgctagtttttcactcctaccttatatccaatgcactaaaattatgttttaccgagcagtattggcccgaaaacgtccaaaagcttga

SEQ ID NO: 2115 - DNA, 645 bp, Streptococcus pneumoniae
atgaaagtattagtgacaggttttgagccctttggaggggaaaagggcaatccagctttggaggccattaaaggtttaccagctgaaatccatggtgctgaggtccgttggctagaggtgccgacagtttttcacaaatctgctcaagtattggaagaagagatgaatcgttatcaacctgactttgtcctttgtattgggcaagctggtggaagaactagtttgacacctgaacgagtgaccattaatcaagacgatgcatgcatttctgataacgaagataatcaaccgattgaccgtcccattcgcccagatggtgcttcggcctactttagtagtttgccgattaaagcgatggttcaagctataaaaaaagagggcttaccggcctctgtttccaatacggcagggacttttgtctgcagccatttgatgtatcaggctctctatttggtagaaaagaaatctccatatgttaaggcaggttttatgcatattccttatatgatggaacaggtggtgaacagaccgactactccagctatgagtttagtggatattcggcgagggatagaagcagcaatcggcgctataatagaacatggagatcaggaactcaagttggtaggcggagaaactcattga

SEQ ID NO: 2116 - DNA, 270 bp, Streptococcus pneumoniae
tggcctccaaagctggattgcccttttcccctccaaagggctcaaaacctgtcactaatactttcatttctaactcctcaaaaccaattcaatgagacttttttcttaaaaacaagtataacatatttcccttattctggattaaaaaggattagcgagattagaatcgaccttcaagtgtatttaaagagtaaaatactaatcaaggccaaaatagctgatccaccttgtttcaaaataatttttttatccgctgttaaagagccgtaa

SEQ ID NO: 2117 - DNA, 360 bp, Streptococcus pneumoniae
atgtcaattattttaacaacgatcgttgctttggagcatttttacattttttatttggaaagtattgccacgcaatcagatgcgactagtcgtgtatttaatatggaaaaggaagaattggctcatccgtcagtaagttcattgttcaaaaatcaaggaatttataaggctctgctaggagtctttctcttgtatgtcatttatttctcacagaatttagaaattgtgactatttttgtcttatttgtgattggtgctgcgacttacggctctttaacagcggataaaaaaattattttgaaacaaggtggatcagctattttggccttgattagtattttactctttaaatacacttga

SEQ ID NO: 2118 - DNA, 426 bp, Streptococcus pneumoniae
atgctagagattcaagatttactgtatcaactccgcttgtctgagcaagcgagtacgcaattgtttgaaaaaaggcttgggattagtttgacacggtatcagattttactgtttttgctggagcattctccttgtaaccaaatggcggttcaggagcgtttgaaaattgatcaggctgctttgacacggcatttcaaaattttggaaacggaaggtttggtggagcgtcatcgtaatcctgaaaatcagcgggaagtgttggtagaggctgcgaagtatgccaaggagcagttagtggtgaatccccctctgcaacatatcagggttaaggaagagatagaaagtatcttaacagagtttgagagaacagaactcagccgtttattaaataaattggttttgggtattgaaaatatagaaatttaa

SEQ ID NO: 2119 - DNA, 207 bp, Streptococcus pneumoniae
gatctagctttcgtgatggaaagcgattctcgttcgttttttctttgtcatactcttcgaaaatctcttcaaaccacgtcagttttatctgaaacttcaaagctgtgctttgagcaacctgcgactagcttcctagtttgctttttgattttcattgagtatcaatttgaatggaaaatggaaagttatcatcttgtaatgagttaa

SEQ ID NO: 2120 - DNA, 1113 bp, Streptococcus pneumoniae
atgaagaaaagaatgttattagcgtcaacagtagccttgtcatttgccccagtattggcaactcaagcagaagaagttctttggactgcacgtagtgttgagcaaatccaaaacgatttgactaaaacggacaacaaaacaagttataccgtacagtatggtgatactttgagcaccattgcagaagccttgggtgtagatgtcacagtgcttgcgaatctgaacaaaatcactaatatggacttgattttcccagaaactgttttgacaacgactgtcaatgaagcagaagaagtaacagaagttgaaatccaaacacctcaagcagactctagtgaagaagtgacaactgcgacagcagatttgaccactaatcaagtgaccgttgatgatcaaactgttcaggttgcagacctttctcaaccaattgcagaagttacaaagacagtgattgcttctgaagaagtggcaccatctacgggcacttctgtcccagaggagcaaacgaccgaaacaactcgcccagttgaagaagcaactcctcaggaaacgactccagctgagaagcaggaaacacaagcaagccctcaagctgcatcagcagtggaagtaactacaacaagttcagaagcaaaagaagtagcatcatcaaatggagctacagcagcagtttctacttatcaaccagaagagacgaaaataatttcaacaacttacgaggctccagctgcgcccgattatgctggacttgcagtagcaaaatctgaaaatgcaggtcttcaaccacaaacagctgcctttaaagaagaaattgctaacttgtttggcattacatcctttagtggttatcgtccaggagacagtggagatcacggaaaaggtttggctatcgactttatggtaccagaacgttcagaattaggggataagattgcggaatatgctattcaaaatatggccagccgtggcattagttacatcatctggaaacaacgtttctatgctccattcgatagcaaatatgggccagctaacacttggaacccaatgccagaccgtggtagtgtgacagaaaatcactatgatcacgttcacgtttcaatgaatggataa

SEQ ID NO: 2121 - DNA, 621 bp, Streptococcus pneumoniae
atgcaaaaaacagcttttatttgggatttagacgggactttattggactcttacgaagcgattttatcagggattgaggagacttttgctcagttttctattccttatgataaggagaaggtgagagagtttatcttcaagtattcggtgcaagatttgcttgtgcgggtggcagaagatagaaatctggatgttgaggtgctaaatcaggtgcgtgcccagagtctggctgagaagaatgctcaggtagttttgatgccaggtgcgcgtgaggtgctagcttgggcagacgaatcaggaattcagcagtttatatatactcataaggggaacaacgcttttaccattctcaaggacttgggggtggaatcctattttacagagattttaaccagtcagagtggctttgtgcggaagccaagtccagaagcggctacctatctgctagataagtatcagttgaattctgataatacttattatataggggatcggactctggatgtggaatttgcccagaatagtgggattcaaagcatcaactttttagagtctacttatgaagggaatcacaggattcaagcgttagcagatatttcccgtatttttgagactaagtga

SEQ ID NO: 2122 - DNA, 1281 bp, Streptococcus pneumoniae
ttgtttaagaaaaataaagacattcttaatattgcattgccagctatgggtgaaaactttttgcagatgctaatgggaatggtggacagttatttggttgctcatttaggattgatagctatttcaggggtttcagtagctggtaatattatcaccatttatcaggcgattttcatcgctctgggagctgctatttccagtgttatttcaaaaagcatagggcagaaagaccagtcgaagttggcctatcatgtgactgaggcgttgaagattaccttactattaagtttccttttaggatttttgtccatcttcgctgggaaagagatgataggacttttggggacggagagggatgtagctgagagtggtggactgtatctatctttggtaggcggatcgattgttctcttaggtttaatgactagtctaggagccttgattcgtgcaacgcataatccacgtctgcctctctatgttagttttttatccaatgccttgaatattcttttttcaagtctagctatttttgttctggatatggggatagctggtgttgcttgggggacaattgtgtctcgtttggttggtcttgtgattttgtggtcacaattaaaactgccttatgggaagccaacttttggtttagataaggaactgttgaccttggctttaccagcagctggagagcgacttatgatgagggctggagatgtagtgatcattgccttggtcgtttcttttgggacggaggcagttgctgggaatgcaatcggagaagtcttgacccagtttaactatatgcctgcctttggcgtcgctacggcaacggtcatgctgttggcccgagcagttggagaggatgattggaaaagagttgctagtttgagtaaacaaaccttttggctttctctgttcctcatgttgcccctgtcctttagtatatatgtcttgggtgtaccattaactcatctctatacgactgattctctagcggtggaggctagtgttctagtgacactgttttcactacttgggacccctatgacgacaggaacagtcatctatacggcagtctggcagggattaggaaatgcacgcctccctttttatgcgacaagtataggaatgtggtgtatccgcattgggacaggatatctgatggggattgtgcttggttggggcttgcctggtatttgggcagggtctctcttggataatggttttcgctggttatttctacgctatcgttaccagcgctatatgagcttgaaaggatag

SEQ ID NO: 2123 - DNA, 1485 bp, Streptococcus pneumoniae
atgacattagtttatcaatcaacgcgtgatgccaacaatacagtaactgccagccaagcaattttgcaaggtttggcgacggacggcggtttgtttacaccggatacttatccaaaggtagatttgaactttgacaaattgaaagatgcttcttaccaggaagttgctaagctagttttgtcagcatttttagatgactttacagttgaggagttggactactgtatcaacaatgcctacgatagcaaatttgatactccagctattgcaccattagtgaaattagatgggcaatacaatttggaacttttccatggttcaacgattgcctttaaggatatggccttgtctattttgccatactttatgacgactgctgctaagaaacatggtttggagaacaagattgttatcttgacagcgacatctggtgacacggggaaagctgctatggcggggtttgcgaatgtgcctggtactgagattatcgtcttttatccaaaggatggtgtcagcaagattcaagagttacaaatgaccactcagactggcgacaatactcatgttattgctattgatggtaactttgacgatgcgcaaacaaatgtgaagcacatgtttaacgacgtggctcttcgtgaaaaattgactaccaacaagttgcaattttcatcagctaactctatgaacattggtcgtctggtgccacaaattgtttattatgtttatgcttacgctcaattggttaagactggtgaaattgtagctggtgaaaaggttaacttcacagtaccaacaggaaactttggaaatatcttggctgccttttatgccaaacaaattggtttgccagttggtaaattaatctgtgcttcaaatgacaacaatgttttgacagacttctttaaaacacgtgtctatgacaaaaaacgtgagtttaaggtaacaaccagcccatctatggatatcttggtatcttcaaacttggagcgcttgattttccatcttttgggaaataatgctgaaaagacaactgaacttatgaatgccttgaacacgcaaggacaatataagttgacagactttgatgcagagattttggacctctttgcagctgaatatgcgactgaggaagaaacggcagcagagatcaagcgtgtttgtgagttagattcttatatcgaggaccctcatacagctgttgcttcagcagtttataaaaaataccaatcggccactggagatgtaactaagacagtgattgcttcaacagctagtccatacaagttcccagtagttgcagtagaagctgtaactggaaaagcaggtttaacagactttgaagccttggctcaattacatgaaatctcaggcgttgcagtgccaccagcagttgatgggcttgaaatagctccaattcgtcacaagacaacagtggcagctgctgacatgcaagcagcggttgaggcttatttaggactttaa

SEQ ID NO: 2124 - DNA, 1278 bp, Streptococcus pneumoniae
atgtcttgttctatcgatttattaaaacatcggtatttgaaaaatattaaagaaaatcctgaattgtttgtcggaattgagttggagtatcctgttgcaagtttagaaggggatgctacagatgttgaagttatgaaggatctatttcattatttagtttctactttggatctcaccgtagcaaaggtagatgattttggcaatctgatccagttagtagatccgataagtcaggatgctattttatttgaagtttcctatacaacgattgagtttgcatttggtaaggctgaaacgattcaagaggtcgaaaatcgtttcaataattatatgaatgtaattcagagaaagttagctgaatcaaatcatgctattgttggctgtggtatccatcccaactgggataaaaatgagaattgtccagtggcttatccacgctatcagatgttgatggattatttgaatttgagtagaaatattattaaatcagatttacatcatttccctgaatatggtacttttatctgtgggagccaggttcagctggatatttcaaaaaccaactacttacgggtgattaatgcttttactcaaattgaagcggctaaggcttatttatttgcaaactctgaattttcgggtgcggattgggatacgaaaatttcaagggatattttctgggaagaatctatgcatggtatctatccagagaatgttggggtcaatgctagactccttaatgatgaaactgatttttttgactatctaaatcattctgcgatttttactgcggaacgtgatgggcagacctattatttttatcctattcaggctggggactatttggctacgtccgaaatccaagcatttgctctgaatggggatgaggttattatttacccccaagagaaggattttgaaactcatcgtagttaccagtaccaagatttaacgactcgaggaacagttgagtttcgtagtgtgtgtacacagccacttgataggacttttgcttctgcagcttttcacttgggattattggttaatttagacaagttagaagcttacttagaaacagcacctttctttaaagtatttggttatgattacaagtctttaaggagacaattttctaagaaaaatcttacagatgaggaagaaactacgattattgaattttccaaagacttactcctactagctgaggagggactagtggtgagaaataaggaagaaatgacctatttacagcctttgagagaagaattgagcctataa

SEQ ID NO: 2125 - DNA, 177 bp, Streptococcus pneumoniae
ataccggcggccggggtcgaaccggcacgtccttgcggacactggattttgagtccagcgcgtctgccaattccgccacgccggcaaatagtaactggggtagctggattcgaaccaacgcatgagggagtcaaagtcccttgccttaccgcttggctataccccaatataaaatag

SEQ ID NO: 2126 - DNA, 183 bp, Streptococcus pneumoniae
atgggcacgagtggactcgaaccaccgacctcacgcttatcaggcgtgcgctctaaccacctgagctacgcgcccaagtcaaaaacttggtacaaagaacaaagttcaaagcgggtgacgagaatcgaactcgcgacaacagcttggaaggctgtagttttaccactaaactacacccgctaa

SEQ ID NO: 2127 - DNA, 234 bp, Streptococcus pneumoniae; identical to SEQ ID NO: 274

SEQ ID NO: 2128 - DNA, 246 bp, Streptococcus pneumoniae; identical to SEQ ID NO: 273

SEQ ID NO: 2129 - DNA, 156 bp, Streptococcus pneumoniae
ttgactcaatttacaccttactgcttagacagactcttccaatcgtctgctttagttagcctacttggtcccttcatcactacatactctagtacaggaatatcaacctgttgtccatcggatacaccttttggtctcttcttaggtcccgaataa

SEQ ID NO: 2130 - DNA, 315 bp, Streptococcus pneumoniae
gtggaaccctttataggtatggtaagaacaccgtttcaacgggttaagaagggaacccggtgggaactgttggaacgcataaaattgagaattcccggaataagaagcgaaagcagggtgagaattctggtcccccgtaagcctaaggtttccaggggaaggtggtccgcccttggttattcgggacctaagaagagaccaaaaggtgtatccgatggacaacaggttgatattcctgtactagagtatgtagtgatgaagggaccaagtaggctaactaaagcagacgattggaagagtctgtctaagcagtaa

SEQ ID NO: 2131 - DNA, 438 bp, Streptococcus pneumoniae
atgagccccctcggatccttccagccccgtggtgaagacactaagataaaaaattattgcctgttagtcttaaccgaccggcggagcagacaccaaattataaggttaattccaaataaaactgctgaatctgtcaatcaggcgcttacgttactattaggggagcatcgtattctgtccattactgcagataatggttcggagttcaaacgattgtctgaggtatttcctgaggaacatatctactacgcacatgcttactcttcatgggagagaggttcaaatgaaaatcataatcgattaattcggagatggttacctaaaggaaccaagaaaacgactccgaaagaagtagcttttatcgaaaattggattaacaactaccctaaaaaatgcttggactacaagtcgccaagtgaatttcttttgggtggctaa

SEQ ID NO: 2132 - DNA, 1062 bp, Streptococcus pneumoniae
atgaataaacgcgtacaagcatttctagctaaaatgcaagaaaaagaactagatggtgtcatcatcaacaatcttaaaaacgtctattatttgactggtttttggggctcaaacggaacagtctttatcagccgtgaccgtcaggtcttagtgacagactctcgctatatcatcgcagctaagcaagaaaccagtggttttgagattgtggctgatcgtgatgaattggctgtcattgcaggaattgttaaggacatgggcttgactcgtatcggttttgaagatgagatttcagtgtcttattaccaccgtatgcaggcagcttttgcaggtttggacttgtttccgcaaactcagtttgtggaaggtcttcgtatgattaaggatgaggcagagattgcagcgattcgcaaggcttgttctatctcagaccaagctttccgcgatgcgcttgactttatcaaaccaggaaaaactgaaattgagattgccaacttccttgacttccgcatgcgtgagttgggagcatctggcttatcttttgatacgatcctagctagcggtatcaattcttctaaaccccatgcccatccaatgcacaaaccagtggagttgggagaagccattaccatggacttcggctgtctctatgaccactatgtcagtgatatgacccggactatctatctagggcatgttagcgatgagcaggcagagatttacaatacggttctaaaagctaaccaagccttgattgaccaagctaaggcaggcttaggtttccgtgactttgacaaaatccctcgtgatattatcattgaggcaggttatggcgactactttactcacggcattggccacggtattggtctggatatccatgaggaaccctactttagtcagacttctacagaaactattaagacaggtatggccttaaccgatgaaccaggtatctatatcgaaggcaaatatggcgttcgtatcgaggatgatatcctgattacagagacaggttgtgaattattgaccctagctccaaaagagttgatagtcatttag

SEQ ID NO: 2133 - DNA, 2832 bp, Streptococcus pneumoniae
atgcaagataaaattgtcattcatggggcgcgtgcccataatttaaaaaatattgatgtggagattccgcgagacaagttggttgtcgtgactggcttgtcaggttcagggaagtccagtctggcttttgatactctctatgcggagggacaacgtcgctatgtagagagtttgtccgcctacgctcgtcagttcttgggaaatatggaaaaaccagatgtagatgccattgatggtctcagcccagctatttccatcgaccagaaaacgactagtaaaaatcctcgctcgacggtgggaacgacgactgaaatcaatgactatctgcgtctcctctacgcacgtgtggggacgccttactgtatcaacggacatggagctatcaatgcttcttctgtggagcaaatcgttgataaggttttggagttacctgaacgccagcgcttgcagatcttggctcctgtcatccgcaagaaaaaaggccaacataagagtgttatcgagaaggttcagaaagacgggtatgttcgtgttcgtgtggatggggaagtctatgatgtgaccgaagtgccagagttgtctaagagcaagcaacacaatatcgatgtcgtggttgaccgtattgttatcaaggagggcattcgtagtcgtctctttgattccattgaggctgcccttcgtattgcagaaggttatgtcattatcgacaccatggacgattcggagttgctcttctctgagcattatgcctgtccagtttgtggttttactgtcccagagttagagcctcgtctcttctctttcaatgctccttttggctcttgtagtgagtgtgacggcttgggcatcaagctggaggtggatactgatttggtagtgccagatgccagcaaaaccttacgtgagggagcgctagcaccttggaatcctatctcatccaactactatccaaacatgttagagcaggccatgaaagtctttggagtggctatggataagccttttgaggacctgtcagaagaagataagaacttgattctctatgggtcagatggtaaggaattccatttccactatgagaatgaatttggtggcgtgcgcgatatcgacattccgtttgagggagttatcaataatatcaaacgtcgttaccatgaaaccaatagcgattacactcgcactcagatgcgtctctacatgaatgagctgacctgcggaacctgtcaaggctatcgtctcaatgaccaggccttgtctgtccgtgtgggcggccagcaagggccacatattggagaaatctcagacctgtctatcgctgaccacttggacttggtgagccagttaactttgtctgaaaatgaagccatcattgctcgtcccattctcaaggaaatcaaggatcgtttgaccttccttaataatgtgggtcttaactatctaaccctgtcacgttcagcaggaaccctttcaggtggggaaagtcagcgcattcgtttggcaacccagattggttccaacctatcaggcgtcctctatatcctagacgagccgtcaatcggtcttcaccagagggacaatgaccgcctgattgccagtctgaaaaagatgcgtgacttgggcaatactcttatcgtggtggaacacgacgaagataccatgcgtgaagctgattatctgattgacgttggtcctggtgccggtgtttttggtggtgagattgttgcagcaggtacacctaagcaagtggctcgcaacagcaagtctatcacaggtcagtacttgtcaggcaaacgtgtcatcccagtaccagaagagcgccgtgtcggaaatggtcgttttattgaagtgataggagcgcgtgagaacaacttgcaaaatgtcacggctcgctttccactaggaaaatttatcgcagtgacaggtgtgtcgggttcagggaaatcgactctaatcaacagcattctcaaaaaagccattgcccagaagctcaaccgtaattcagacaaacctggtaagtttaagactattacagggattgagcatgtcgaccgtttgattgatattgaccagagccctatcggacggacgccgaggtctaacccagctacctatacaggagtttttgacgatatacgtgacctttttgctcagacaaatgaagccaagattcgaggctacaagaaggggcgcttcagtttcaacgtcaagggaggtcgctgtgaagcttgctcaggtgacgggattatcaagattgagatgcacttcttgccagatgtttatgtggcttgtgaagtttgccacggaacccgctataacagtgaaaccctagaagttcactacaaggaaaagaatatttcgcaggtcttggatatgacggtcaacgatgcggtagaatttttccaacacattccgaaaattcaacgcaaactccagaccatcaaggatgtagggctaggctatgtgaccttgggacagccagctaccaccctttctgggggagaagcccaacgtatgaagttagctagcgaactccacaaacgctcgacaggaaaatctttctacattctggatgagccgacgacagggcttcatacagaggacattgctcgcctgctcaaggttttagctcgctttgtagacgatggcaatacagtcctcgtcatcgagcacaatctggatgttatcaagacggcagaccatatcattgacttgggacctgagggcggtgtcggtggtggaaccatcatcgtaacaggaactccagaagaagtagctgccaacgaagccagctatacaggacactatttgaaaggaaagttacatcatgaataa

SEQ ID NO: 2134 - DNA, 945 bp, Streptococcus pneumoniae
atgaaacaagtttttctctgtacaacaactgaatttaaagagatcgatacgcttgaaccgggtacttggatcaatctcgtcaatccgactcaaaatgaatcactcgaaatcgccaacaccttcgatattgatattgccgaccttcgagcaccgctcgatgcggaagaaatgtctcgtattaccattgaagacgagtataccctgattatcgtagacgtgccggtcacggaggaaagaaataaccgcacctactacgtaaccatcccgcttggtattatcatcactgaggaaaccattatcactacgtgtttggaaccactacctgtccttgatgtctttatcaaccgtcgattgcgtaatttctataccttcatgcgttcacgttttatctttcaaattctttatcgcaatgcagagctttacctaacagcccttcgttcaatcgaccgcaagagtgaacaaatcgaaagtcaactgcatcaatcaactcgtaatgaagaattgattgagctcatggaattggaaaaaactatcgtctatttcaaggcctccctcaaaacaaatgagcgcgtgattaagaaattgaccagttcaaccagcaatatcaagaaataccttgaggacgaagacctgcttgaagacaccctgattgaaacccaacaggccatcgagatggcagatatttatggaaacgtcttgcattctatgacagagacctttgcctctatcatttctaacaaccagaacaacatcatgaaaaccttggcccttgtgaccatcgtcatgtccatcccaaccatggtcttttctgcctacgggatgaactttaaggataatgaaatccccctaaacggagagccaaatgccttctggttaatcgtctttatcgcctttgctatgagtgtctcgctcactctctatctcatccataaaaaatggttctaa

SEQ ID NO: 2135 - DNA, 204 bp, Streptococcus pneumoniae
atgtctcaaattgatctacaaaaattaactaagaaaaaccaagagtttgtccacattgctacccaacaattcatcaaagatgggaaaacagacgctgaaatccagactatttttgaggaagtcattccccaaatccttgaggagcaatctaaaggtacaactgcccgttccctatacggcgcaccaactcattggggctcatag

SEQ ID NO: 2136 - DNA, 639 bp, Streptococcus pneumoniae
ttgtccacattgctacccaacaattcatcaaagatgggaaaacagacgctgaaatccagactatttttgaggaagtcattccccaaatccttgaggagcaatctaaaggtacaactgcccgttccctatacggcgcaccaactcattggggctcatagcttcactgtcaaagagcagtacgaaaaagagcatccaaaagaaaatgatgatccaaaactgatgattatggactcagctcttttcatcactagcctctttgcccttgtcagcgccctcacaaccttctttgcggcagatcaagctttcggctatggattgattactcttctattagttggactggttggtggatttgccttctacttgatgtactactttgtttaccaatactatggaccagatatggatcgcagtcaacgtccacctttctggaaatctgtactagttatcctagcttctatgttcctttggttgcttgtcttctttgcaacaagcttcctaccagctagccttaacccagtactggatccattgccactagctattattggagcagccctcctagcccttcgcttctatctcaagaaacgcttgaatatccgtagtgcaagtgcaggaccaacacgctatcaagaataa

SEQ ID NO: 2137 - DNA, 153 bp, Streptococcus pneumoniae
gtgggatttcagaagaatacttttaatactcttcgaaaatctcttcaaaccacgtcagttttatctgcaacctcaaagctgtgctttgagcaacctgcagctagcttcctagtttgctctttgattttcattgagtataactcaaaaaagtaa

SEQ ID NO: 2138 - DNA, 1032 bp, Streptococcus pneumoniae
atggtttctactattggtattgttagtttatctagtggcattatcggagaggattttgtcaaacacgaagtggacttgggtatccaacgtctcaaggttctgggactcaatcccatctttttgccccattcgttaaaaggattagactttatcaaggaccatcctgaagctcgtgcagaggatttgattcatgccttttctgatgatagcatcgacatgatcctatgtgccataggtggagacgatacctatcgcttgctaccttatctttttgaaaatgaccaactccaaaaggctatcaaacaaaaaatttttcttggcttctcggatacaaccatgaaccacctcatgttgcataaattaggaatcaagactttttatggtcaatcctttttagcagacatttgtgaattagacaaagaaatgctagcctatagccttcactactttaaagaattgattgagacgggaagaatttcagaaatccgccctagtgacgtttggtatgaggaacgaactgattttagtcccacggccctgggaacacctcgtgtcagtcatacaaatacaggttttgacttgttgcaaggaagtgctcagttcgaggggaaaatcctcggtggttgcctcgaatccctctacgatatctttgacaactctcgatacgcagatagcacggaactctgccaaaaatacaaacttttccctgacttgtcagactgggaagggaaaatcctcttgctcgaaacaagcgaagaagagcctaagccagaagacttcaaaaagatgttgctaactttaaaggacactggcatattcgcggtcatcaatggactcttggtcggaaaacctatggatgaaactttccatgacgactataaagaggcactattggatatcattgacaacaatatcccgattgtctataatctgaatgtcggccacgcaactccaagagcaattgtaccctttggggtccatgctcatgtagatgcacaggaacaagtcattcgctttgactataacaaataa

SEQ ID NO: 2139 - DNA, 678 bp, Streptococcus pneumoniae
atgatgtctaacaaaaataagggaattctgatttttgcgattctctatacagtcctctttgtgtttgatggcgttaaattgctggcttctttaatgccatctgtcattgcaaattatcttgtttatgtagttttagctttatatggctccttcttgttcaaggatagattgatccaacaatggaaggagattagaaagactaaaagaaaattcttctttggcgtcttaacaggatggctctttctcattctgatgactgttgtctttgaatttgtatcagagatgttgaagcagtttgtgagactagatggacaaggtctaaatcagtctaatattcaaagtacctttcaagaacaaccactactgatagctgtttttgcttgtgtcattggacctctggtagaagaattatttttccgtcaggtcttattgcattacttgcaggaacggttgccaggtttactaagcattattctggtaggacttgtttttgctctgactcatatgcacagtttggccctatcagagtggattggtgcagttggttacttaggtggaggccttgccttttctattatttatgtgaaagaaaaagagaatatctactatcccctacttgttcacatgttaagcaacagcctctccttaatcattttagctatcagtatagtaaaatga

SEQ ID NO: 2140 - DNA, 564 bp, Streptococcus pneumoniae
atgacaaaacgttgttcgtgggtcaagatgaccaacccgctctacatcgcctatcatgatgaggagtggggccagcccctccatgatgaccaagcattgtttgagttgttgtgtatggaaacctatcaggcaggcctgtcttgggaaacggtactcaacaaacgccaagctttccgagaagcatttcatagctatcaaattcactcagtcgcagagatgactgacactgaattggaagccatgctggagaatccagctatcattcgaaatagagccaagatttttgctacacgcgctaacgcccaagcttttctacagttacaggcagagtacggctcttttgatgcctatctttggtcttttgttgaggggaaaattgtcgttaacgatgttcctgattatcgccaagcgccagctaaaacacccttatctgagaaattagccaaagatctcaaaaaacgaggcttcaagttcacaggcccagtcgccgtattgtcttttctacaggctgcagggctagttgatgaccacgagaatgattgtgagtggaaaggtcttaaatga

SEQ ID NO: 2141 - DNA, 558 bp, Streptococcus pneumoniae
gtgaatttgatagctatgaaatgcttctcggaaagcttggcgtttgttgagtaccgtttcccaagacaggcctgcctgataggtttccatacacaacaactcaaacaatgcttggtcatcatggaggggctggccccactcctcatcatgataggcgatgtagagcgggttggtcatcttgacccacgaacaacgttttgtcattctctgctcctatttgaccaacattttaagggccgacttgatatagttctcagctgtatctgtcgttccttcaaagaatttcttgattttcttgagctctgttgccttgtagcccagagccaacatggcttccatagcttcttccaattcttggttttcagcacttgcttgcactgcgaccttggcaggaaggtcatctcctgcaactactaccttgccttccaagtccagcaccatctgctgggctgttttcttgccaattttagggaacttggtcaagtaggtgatgttcttggtttcaatggcttgaaccaagccagcattgtcatcagcagcgataatagcaagagctga

SEQ ID NO: 2142 - DNA, 594 bp, Streptococcus pneumoniae
atgtacgcatatttaaaaggaatcattaccaaaattactgccaaatacattgttcttgaaaccaatggtattggttatatcctgcatgtggccaatccttatgcctattcaggtcaggttaatcaggaggctcagatttatgtgcatcaggttgtgcgtgaggacgcccatttgctttatggatttcgctcagaggatgagaaaaagctctttcttagtctaatttcggtctctgggattggtcctgtatcagctcttgctattatcgctgctgatgacaatgctggcttggttcaagccattgaaaccaagaacatcacctacttgaccaagttccctaaaattggcaagaaaacagcccagcagatggtgctggacttggaaggcaaggtagtagttgcaggagatgaccttcctgccaaggtcgcagtgcaagcaagtgctgaaaaccaagaattggaagaagctatggaagccatgttggctctgggctacaaggcaacagagctcaagaaaatcaagaaattctttgaaggaacgacagatacagctgagaactatatcaagtcggcccttaaaatgttggtcaaatag

SEQ ID NO: 2143 - DNA, 210 bp, Streptococcus pneumoniae
atgacaagtaatcatttcagagcacgcaaaaagcacaaatatacttttatcttctttcatccagactatactgtcggctttggaatttcaccaaatcatgcctttcggctcgtgggctataccaccggtagggaattgcaccctgccctgaagatagttattcaattacagatgattatagtacttaattttgaatatgtcaacagataa

SEQ ID NO: 2144 - DNA, 1101 bp, Streptococcus pneumoniae
atgagcgattcaaaatatatgaaattagcaataaaactggcacaaaaaggggctggttacgtcaatcccaatcctatggttggcgcaattattgtaaaagataatcacattatcggacaaggttatcatgagttttttggtggcccacatgctgagagaaatgctcttaaaaactgtagaaaatcccctgtcggagcgacgctttatgtaacacttgaaccctgttgtcacttcgggaaaacacctccctgtatagatgctataatcgatagtggtattacaagagtagtcattggaagcctagactgtaatcctattgtatctggaaaaggagtaaagatacttgaggaaaataatcttcaagttactgttggaattttagaaaatgagtgtcttaacttaataaaaagttttagaaagtatattacccagcatgtaccctatgtttttatgaaatatgcaatgtcaatggatggaaaaatagccactaaaacaaatcaatccaaatggattactgaagaagaagcaagaaagcatgtgcatcagttacgacaccatgttagtgcaattatggtgggagtcaatactgttattcaagacgatcctttgctgacatgtagattggaggaagggaaaaatcctatccgtatcatatgcgatacacatttacgaactcctcttacctctaaaatcgtaaaaacagcaaatgatattaaaacttacattgccacttcctctgaagacaaaaataaaatgaagctatatcaaaatcatggctgtgaaatactttccataaagaaaaaaggcaatcatatagacttatcgagtttaatgcaacatctaggaaacatgcagattgatagcctagttctagaagggggcagtctaatgaattggagtgctttggaacaacaaattgttgatgagctgaaaatatatattgcaccaaaaatttttggaggcagtgccaagtttcctgtcggaggtgaaggcatttctttgccaaatgacgctattagattgaaaccttatgctttttctcaaataggaaatgactatctcatagaaagtgaagtgatttatccatgttcacaggaataa

SEQ ID NO: 2145 - DNA, 636 bp, Streptococcus pneumoniae
atgttcacaggaataattgaagaaatcggaaaagttgaaagaatacagaaagactctcgtaattgtaaactatcaattaaagcctcaaaaatattaacggatatccatttaggtgatagtatagcagtaaatggtatctgtcttacagttactcatttcaatcatcaatcctttacagttgatgtaatgaatgaaacatggagtcgaacagctcttactctattaaaacatggaagtgaggtgaatctagaaagagccttatctgtcaacggtcgacttgggggtcacgtcgttacaggacacattgatggtacaggaaaaatctcgtcaataaaaaaagatgataatgctgtatggtatcaaatcaacacacaaaaagaaattttagatttaatagttgaaaaaggatctattacaattgacggcattagtctgactgtcgctaaagtctccaaagtaaacttttcagtatctgttatccctcataccttggaacaaaccattcttaagagtaaacaagtcgggagtacagtaaatcttgaaaatgatatcttaggtaaatatgtgcaaaaactgatggataactctccaaaatcagaaatatctaaggaactattatatcaaaatggattttag

SEQ ID NO: 2146 - DNA, 1236 bp, Streptococcus pneumoniae
atggattttagcagaaaggataatcagtcaatggaatatcgaaaaatacaagaagcattagaagcattgcagaagggacgacttgttcttgttatagacgacaaggatagagaaaatgaaggagacttaatttgttctgcacaagcagctacaacagaaaatgttaattttatggctacttatgccaaaggattaatttgtatgcctatgagcgaaagtttagctaatcaattaatgctttcacctatggttgaaaacaatacagataatcataagactgcttttacagtttcaattgattataaagaaacgaccacaggtatttctgccgaggaaagaggactgaccgcacgtatgtgtgtagctgaagatataacaccctctgattttcgcaggccaggacacatgtttcctttaattgcaaaaaaaggtggtgtcctagaaagaaatggacacacagaagcaactgttgatttattaaaattagctggactaaaagagtgtggcctatgttgtgaaataatgaatcatgatggcaaaatgatgagaacagatgatttaattcagttctcgaagaaacacaacattccactaattaccatcaaagaattacaagaatatagaaaagtatatgatcagctgatagaacgagtttcaactgtcaatatgcctactagatacggtaatttcaaagcaattagctatatagataaactaaatggggaacatcatcttgctcttattatgggaaatatagaggatgaagccaatgtattatgtcgggtccactccgaatgtttaacaggagatgttttaggctctttacgttgcgattgtggacagcaattcgataaagctatgaaaatgattgttgagaatggttcgggtgtcttactttacttgcgacaggagggacgaggaattggacttatcaataaattaaaagcctatcatttacaagatcaaggcatggatacgcttgatgccaatcttgcattaggctttgaaggtgatttaagagaatatcatattggagcacaaatgcttaaagatctgggacttcagtcacttcatttactgacaaataatcctgacaaggttgaacagttagaaaaatatggaattaccatttccagtagaatatcaatcgaaatagaagccaatccttacgatagtttttatttagaaacaaagaaaaatcgaatggggcacattttaaatatggaggaaaaataa

SEQ ID NO: 2147 - DNA, 468 bp, Streptococcus pneumoniae
atgaacacttatgaaggtaatttagtagcaaacaatattaaaataggtattgttgtagcgagatttaatgaatttataacttcaaaattattatctggagcactagataatctcaaaagagagaatgtaaacgagaaagatatcgaggtagcctgggttccaggagcttttgaaataccactgattgcatcaaaaatggcaaaaagtaaaaaatatgatgcaattatctgcttgggagctgtcattagagggaatacaagtcattatgattatgtatgtagcgaggtatctaagggaatcgcccaaatcagtttaaatagcgaaattcctgttatgtttggtgtgctaacgacagatacaattgaacaagccatagaacgagctggtaccaaagcaggaaataagggttctgagtgtgcacaaggagctattgaaatggtcaacctaattcgtacattagacgcatag

SEQ ID NO: 2148 - DNA, 1950 bp, Streptococcus pneumoniae
atgtctcatattattgaattgccagagatgctggcaaaccaaatcgcagctggagaggtcattgaacgtcctgccagtgtggtcaaagagttggtagaaaatgccattgacgcgggctctagtcagattatcattgagattgaggaagctggtctcaagaaggttcaaatcacggataacggtcatggaattgcccacgatgaggtggagttggccctgcgtcgccatgcgaccagtaagataaaaaatcaagcagatctctttcggattcggacgcttggttttcgtggtgaagccttgccttctattgcgtctgttagtgtcttgactctgttaacggcggtggatggtgctagtcatggaaccaagttagtcgcgcgtgggggtgaagttgaggaagtcatcccagcgactagtcctgtgggaaccaaggtttgtgtggaggatctctttttcaacacgcctgcccgtctcaagtatatgaagagccagcaagcggagttgtctcatatcattgatattgtcaaccgtctgggcttggcccatcctgagatttcttttagcttgattagtgatggcaaggaaatgacgcggacagcagggactggtcaattgcgccaagcaatcgcagggatttacggtttggtcagtgccaagaagatgattgaaattgagaactctgacctagatttcgaaatttcaggttttgtgtccttgcctgagttgactcgggctaaccgcaattatatcagcctcttcatcaatggtcgttatatcaagaacttcctgctcaatcgtgctattttggatggtttcggaagcaagcttatggttggacgttttccactggctgtcattcacatccatatcgacccttatctagcggatgtcaatgtgcatccaactaagcaagaggtgcggatttccaaggaaaaagaactgatgactctggtttcagaagctattgcaaatagtctcaaggaacaaaccttgattccagatgccttggaaaatcttgccaaatcgaccgtgcgcaatcgtgagaaggtggagcaaactattctcccactcaaagaaaatacgctctactatgagaaaactgagccgtcaagacctagtcaaactgaagtagctgattatcaggtagaattgactgatgaagggcaggatttgaccctgtttgccaaggaaaccttggaccgattgaccaagccagcaaaactgcattttgcagagagaaagcctgctaactacgaccagctagaccatccagagttagatcttgctagcatcgataaggcttatgacaaactggagcgagaagaagcatccagcttcccagagttggagtttttcggacaaatgcacgggacttatctctttgcccaagggcgagatggactttacatcatagatcagcacgctgctcaggaacgggtcaagtacgaggagtaccgtgaaagcattggcaatgttgaccagagccagcagcaactcctagtgccctatatctttgaatttcctgcggatgatgccctgcgtctcaaggaaagaatgcctctcttagaggaagtgggcgtctttctagcagagtacggagaaaatcaatttattctacgtgaacatcctatttggatggcagaagaagagattgaatcaggcatctatgagatgtgcgacatgctccttttgaccaaggaagtttctatcaagaaataccgagcagagctggctatcatgatgtcttgcaagcgatctatcaaggccaatcatcgtattgatgatcattcagctagacaactcctctatcagctttctcaatgtgacaatccctataactgtcctcacggacgtcctgttttggtgcattttaccaagtcggatatggaaaagatgttccgacgtattcaggaaaatcacaccagtctccgtgagttggggaaatattaa

SEQ ID NO: 2149 - DNA, 252 bp, Streptococcus pneumoniae
ttggcgcaattgaccagtccctgctgtccgcgtcatttccttgccatcactaatcaagctaaaagaaatctcaggatgggccaagcccagacggttgacaatatcaatgatatgagacaactccgcttgctggctcttcatatacttgagacgggcaggcgtgttgaaaaagagatcctccacacaaaccttggttcccacaggactagtcgctgggatgacttcctcaacttcacccccacgcgcgactaa

SEQ ID NO: 2150 - DNA, 291 bp, Streptococcus pneumoniae
ttgattttttatcttactggtcgcatggcgacgcagggccaactccacctcatcgtgggcaattccatgaccgttatccgtgatttgaaccttcttgagaccagcttcctcaatctcaatgataatctgactagagcccgcgtcaatggcattttctaccaactctttgaccacactggcaggacgttcaatgacctctccagctgcgatttggtttgccagcatctctggcaattcaataatatgagacatctttcagcccctttctgtatctattttcctagaaattaa

SEQ ID NO: 2151 - DNA, 183 bp, Streptococcus pneumoniae
ttgttgactttgtcagttttatctacaacctcaaaacagtattttgaactgtctgcgcctagctttctagtttgctctttgatttttattgagtataccactattttactccctctggcaagggactttgtctatgtggagggattgggctcctatgtggtggagcttttctgttctttctga

SEQ ID NO: 2152 - DNA, 522 bp, Streptococcus pneumoniae
ttgaagagatttttgaagagtattaataaaggtgtacaagaagtgagattaattttgtatgaaaaacaaggagagaaatttatgaaagtagaactacagattagtgagacttacgaggaggaaaagctgattgtccaagcacctcagccgacagataaagtccagaaagtcatcgagttcgcagaaaatctggaccaaagagaaaaaatcaaagggaaaagcgatgatcaggtctatctagttgagattggcaagattcagcgcttctatatcgagaatcggaaggttctagcagaaaccgcgagtcagacctacagcattgatttgcgactctatcaggttcctaaactcttgccaagcaattttatccaaatttcccaatcagaaatcatcaatatcgattccatctctcacctcaagctcacgccaaacggtctggtagaaattttcttgaaaaacgaaagcttcacctactcttcacgccgttatctaaaaaccatcaaggagaaattagaactatga

SEQ ID NO: 2153 - DNA, 459 bp, Streptococcus pneumoniae
atgaaaaaacaagtatttcacgatgcagctaccggtgttcttatcggcctcatcctctctatcctcttttcactcatttatgcaccaaatacctacgcaccactaaatccctactctctcatcggccaagtgatggatcagcatcaggttcacggtgccctggtcttgctctactgcacacttatctgggcaaccatcggtatgctcttcaactttggcaaccgcttatttagccgtgactggagcatgcttcgtgccactctgactcatttcttccttatgctggctggctttgtcccactagcaactcttgctggttggttccctttccactggattttctacctccagctcattatcgagtttgcgattgtctatctcatcatctgggctattctctataaaagagaggctaaaaaagtagatcacatcaatcaactcttggagcatagaaaatag

SEQ ID NO: 2154 - DNA, 378 bp, Streptococcus pneumoniae; identical to SEQ ID NO: 512

SEQ ID NO: 2155 - DNA, 633 bp, Streptococcus pneumoniae; identical to SEQ ID NO: 513

SEQ ID NO: 2156 - DNA, 603 bp, Streptococcus pneumoniae
atgtcgcaagctatttccttaaatcaatcaacctgggcaagcaagctaaaagcaatgggacctggaatcctaatggcaactgccgctgttggaggttcccacattgtatcctcaactcaagctggcggttcttacggttggtctctacttctcttggtcatcttagccaatgtctttaaatatccatttttccgttttggtgctgaatacacagctgatactggaaagactttggttgaaggttatgccgaaaaaggaaaactctatctctggattttctttatcctcaatgtcttttcggctatggtcaacacggctggtgttgccattctgtgctcagctatcatcgccagtgccttcccaatgattggacttagcattactcagtggtccctcattctcgttgcaatcatttgggctatgctactctttggaggctacaaacttttagacggcatggtcaaatggattatgtctgccttaaccattgcgactgttcttgcagttatcattgcggcggtcaagcatccagaatacagttctgattttgtcgagaagacaccttggcaaatggcagctctgccttcatcgtctccctcctag

SEQ ID NO: 2157 - DNA, 192 bp, Streptococcus pneumoniae
gtgttaaagtcaaacagagcgtcttctgtgttaaagttgacggtctttctcttttcagctgaccaaagtgaattgatggctgaaatttcaataggagccggcatccatcctaggagggagacgatgaaggcagagctgccatttgccaaggtgtcttctcgacaaaatcagaactgtattctggatgcttga

SEQ ID NO: 2158 - DNA, 654 bp, Streptococcus pneumoniae
atgccggctcctattgaaatttcagccatcaattcactttggtcagctgaaaagagaaagaccgtcaactttaacacagaagacgctctgtttgactttaacactggttatattggaacagctatcctagccgtcttctttgtggcactgggagcactgattcagtatcctacagggcaggcggttgaagctgcttcagccaaatacatctctcaattcgtgggcatgtatgcctctgttcttggcgaatggtcccgttacttgattacctttattgccttcctctgtatctttggaacagttataactgttatcgatggctattctcgcgttaatcaggaatctctccgactgctaatcagtcaaaaagaggacaatcgtaaatctttgaacatctggatgaccatcactgctatcatcggtatcgtcattatcaagttcttcgctggtcaggtttcaaccatgctccgctttgccatgattggctctttcctgacaacacctttctttgctcttttgaattacgccttggtaacgcgtgaaaacaaaaatcttccttcttggctcaaacaccttgccattgcgggattgattttcctctttggcttcgccatcttctttatctacgcactcgcaatcggaaaagcagggtaa

SEQ ID NO: 2159 - DNA, 603 bp, Streptococcus pneumoniae
gtggcgacaacagaaagccttggcagaagaagaggaaacagaagagcttacctaagtattgacaaaaaagaactatcaagatacaatcttggtagttgttttttgattatagataaaatcatggaggtacatatgaagacaatttctttagtttatattagtttgagtggcaacactgaaagttttgtgacgcgcttgaaagactatctcttgtcccagtacaaagggattgaggttcaaaagattcatatcaaggatttggtcaaggaaggcaaaaatttctatgaaatggaccatccctatgtcgcttttttgccgacctatctcgaaggtgggaatggcgtggataacggagatgttgagattttgacgacaccggtgggagattttattgcctatggtaacaatgctagtaagtgttttggtgtggttgggtcaggaaatcgtaactttaataaccaatactgcctaacagccaagcaatacagtcaacgctttggcttccctgtattggctgactttgaaatgcgaggcatgctggaagatatcaaacatgtcgcagctattatcgcagatttgtatgagttggaaaaggagaattaa

SEQ ID NO: 2160 - DNA, 582 bp, Streptococcus pneumoniae
ttgtattcctttacaaaaggtgctataatattatcaggaggtcctatcatgaaaaagaaaccaatttatctatgggttttgctaatcttgtctgcccttatttcagttccgtctctgtttggaattgtgagtcccttgcctagtaaagaagcccttcgtgctgctcagaaacaagttgcaggggtcaatgctcagcaattagaagaccagcttaattatacctatagagtagcagaagcatctcattctatttttaatgttgctttgattgtgctatctactattttagtggtcgtagcgattgtcttccttgttcgtaaaaatttgcaatatgcaaactatacttacgttggctatgttttgttagctattattggttcgatttatggctatgttggtttacaagacgctgtgcagttggttcaagatgagagcatgcgtttgacagtgagtattggttcaaaagctgttagcattttctatatcgtcatcaatgttctcttcctagcccttgtcttctataagatgtggcgacaacagaaagccttggcagaagaagaggaaacagaagagcttacctaa

SEQ ID NO: 2161 - DNA, 1287 bp, Streptococcus pneumoniae
atgtataaagtattattagtagatgatgagtacatggtgacagaaggtctgaagcgtttgattccctttgataagtgggatatggaggttgtcgcaacagccagtcatgccgatgaagctctagaatatgttcaggaaaatcctgtcgatgtcatcatttccgatgtcaatatgccagacaaaacagggcttgatatgattcgggagatgaaagagatcttaccagatgctgcctatatcctgctctcaggttatcaggagtttgattatgtaaaaagagcaatgaaccttagtgtggtggactatttggtcaagcctgttgataaggtagagctgggaaatctgctggagaagattgcaggtcagctcggcgagagagggaagaaaagtcagactcttagtcaagaattagacgaggctggatttgttagttatttaggggataaggagaattggtggataggtctatccaaggaaaaacaaggttccttcaccattccctactatgtcttgggccaagactggcagattttcatttctggccaacctctagatggtttagtcgttacaccttttgaagctccttatcaagaacactttgaacgctggaagctgaatgctgagaaaaccctcttttacggttctgtaaatttgcagcagtctgagagtctctttgcctattacgaaccgatttatagggttatcattcagggaaatctcaatcaaatcgtagaagagttaaatctcttggagaaggtagttcttgaaaatacgccgcgtgttccgattactaaacagctttttattcagtttgtcatggatgttttccatttatttgaacatctcaaagctgatgacctgacagacatcgtcaaaaccattcatgctattcaatccttcgatgaattggtttcttatatcaaggaaactctgatcagctttttcggtcaataccgtatgaatgaaaatgtggtcagtgtgctggaagtcattggtcgtgattaccaaaaagagctttccctcaaggatatcagtaaggccctctttatcaatcctgtctatctagggcagttgattaagcgtgaaaccgattcgacctttgcagagttactaaataaacaacgtattaaggctgcccagcagctcttgctttcaactagtgacagcatcgaagatatttgttatgctgttggttacagtaaccttggatatttctataaagttttccgaaaattgtgcggaaaatcgccaaaagcctaccgaaaacaggtagaaactatactataa

SEQ ID NO: 2162 - DNA, 1704 bp, Streptococcus pneumoniae
gtgatatgttggaacctgtctatgaaatcatccatgaaaaattggcgacaaaatagaatgaagcagttttggctacatacgcttctaagaacctatagttcagtgatgatcattatcattgcgagttttgcaatcttactctcttacgctgactgggattcacgtgaaaaggaagcccagagagtagcccagcgtgtaactgctagaacagtgagtgaaattgaatattaccatagagagtcaacccagatagctcaggctttagttgaaaatcaagctcgtattgagggaatctataaatactttagccttagcatgccagactatttttactggcaattagagcggaaagcttcgccttatatatcagtctctctgtatgaaaatgttgatgacctctatgttcgaaatgattttgtaactggggtggccattgcttttcaagattacaaggaagtctatgtttctactaaagacaaacgtagtggagaaaaaatcagggctgaggatttcaaaccagcaggaaatagttttgccattccggtgtcagatccagtgtcagatcaagatttaggagtgatttacatctccttggatcctgctgttttataccatgccattgataatactagaggtcatactccgatggcagtaacagtgacctcaccttttgatacggagatttttcatattggtgagacagttgatagggagagtgaaaattggctagttggcttaacttctcatggatatcaggttcaggtggcagttcctaaaaactttgttttacaaggaacagtgactagctctgctttgattgtgggtttgagccttctctttattgtcattctttatctgactttgaggcagacttttgctaattaccaaaagcaggtagtggatttagtagaatccattcaagtcattgctcaaggcgaagaggggcgtcggattgacatttccgagaaagatcaggaattactcctaatcgcggagacgaccaatgatatgttggatcgattggaaaagaatatccatgatatttaccagttagagcttagtcaaaaagatgccaatatgcgagccttgcaggcgcaaatcaatcctcattttatgtataatacgctggagttcttgcgcatgtatgcagttatgcagagtcaagatgagttggcagatatcatttatgaattcagtagtctcttgcgtaacaatatttccgacgaaagagagaccctcctcaaacaggaattagaattttgccgtaaatacagctatctctgcatggttcgctatcccaagtccattgcctatggtttcaagatagatccagagttagagaatatgaagattcccaagtttaccttgcaaccgctggtagaaaactatttcgcgcatggtgttgaccacaggcggacagataatgtgattagcatcaaggctcttaaacaggatggttttgtggaaattttggtggtcgataatggtagaggaatgtcggctgaaaagttggcaaatatccgagaaaaattaagtcagagatattttgaacaccaagccagctacagtgatcaaaggcagtctatcgggattgtcaatgtacacgagcgttttgtgctctattttggagaccgctatgccattactatagagtctgcagagcaagccggtgttcagtatcgtattacaattcaagatgagtag

SEQ ID NO: 2163 - DNA, 615 bp, Streptococcus pneumoniae
atgggtagatttttagactttgtctttaatcgtttctttttagggatgattgcgacagccttcttttggctattaactttagcaggagggattatccttggtctagcgccggctagtgccaccttgatgagcttatatgcagaacatggttatagctttcgggaatacagtttgaaggaggcttggtctctttacaagcaaaattttgtctcaagcaacctgattttctatagctttttaggtgtgggtctagttttgacctatggtttgtatctattggtgcaattgcctcatcagaccattgttcatttgattgcgacccttttgaatgtcctagtagttgccctgatctttttggcttatacagtatctttaaaattacaagtttattttgccttgtcctatcgaaatagtctcaaattatccttgattggcatctttatgagtctagcagctgtggccaaggttctccttgggactgtgctacttgtagcaattggttactatatgcctgccctgctattttttgtaggaattgggatgtggcatttctttatcagtgatatgttggaacctgtctatgaaatcatccatgaaaaattggcgacaaaatag

SEQ ID NO: 2164 - DNA, 570 bp, Streptococcus pneumoniae
atgaaaaaatctatcttaactacactgctttttgcagttctttacttcctctgcatggggattggtgtccttttgggcaatctctttgaccaaactggaaacatgttttatgcgcctgcctttactgcccttgtcggcggtagcgtctatatgatcctagtcgcaaaagttccgcgctttggagccattaccactatcggccttgtcattgccttctttttcttgggaactaaacacggggctggttccttccttcctggaattatctgtggcctcctagcagatgaagtagctcatttaggaaaatacaaggacaaaacaaagaacttcctttctttcattattttcgcctttagtacaacaggaccaatcttgcttatgtggattgcgcccaaagcctatatggctactcttctggcaagaggaaaatcccaagaatatatcgaccgtatcatggtcactccaaaccctggaactgtccttctatttatcgcaagtattgtcatcggagccctagtgggtgccttgattggacaagccttgagtaaaaaatttgcccagaaaatctga

SEQ ID NO: 2165 - DNA, 693 bp, Streptococcus pneumoniae
atggaatcattgattcaaacctatttaccaaatgtctataagatgggttgggctggtcaggcaggctggggaacggctatctacttaactctttatatgacagttctttccttcattatcggaggcttcttggggctagtggcaggtctctttctcgtcttgacagcgccaggtggtgtcttggagaataaagtcgtattctggattttagacaaaattacctcaatttttcgtgcggttccctttatcatcctcttggcaatcttgtcaccactttctcacttgattgttaaaacaagtatcgggccaaatgcagcccttgtcccactttcttttgcagtctttgccttctttgcccgtcaggtgcaggttgtcttggctgaattggatggcggtgtcattgaggcggctcaagcgagcggagcgactttctgggacatcgtgggtgtttacctatcagaaggtcttccagatttgatccgtgtgacgactgtgaccttgatttcccttgttggggaaacagctatggccggtgcggttggagctggtggtatcggtaacgtagccatcgcttatggatttaaccgctacaatcacgatgtgaccatcttggcaaccatcattatcattttgattatctttgcaatccaattcttgggagatttcttgactaagaaattgagccataaataa

SEQ ID NO: 2166 - DNA, 1062 bp, Streptococcus pneumoniae
atgagtagagatattatcaagttagatcagatcgatgtgacttttcaccaaaagaagagaaccattacagcggttaaggatgtgaccattcacatccaagaaggggatatctacggaatcgttggatattctggagcagggaaatcaacccttgtacgggtgattaacctcttgcaaaaaccatctgcagggaaaattaccattgacgacgatgtgatttttgacggcaaggtgaccttgacggcagagcagttgcgtcgtaaacgtcaagatatcggaatgattttccagcattttaacctgatgagccaaaagacagcagaggagaatgtagcctttgcccttaaacactctgaactcagcaaggaagaaaagaaggctaaagtagctaagttgttggacttggttggtttggcagatcgtgctgaaaactacccttcacaactatctggagggcaaaaacagcgtgtggcaattgcgcgtgccttggccaatgatccaaaaatcttgatttcagacgagtcaacttctgcccttgatccgaagacaaccaagcatattttggccttgttgcaagattggaaccaaaaattaggcttgactgttgtcttgattacgcatgaaatgcagattgtcaaagacattgccaaccgtgttgcagttatgcaggatgggcatttgattgaagagggtagtgtgcttgaaatcttctcaaaccctaaacaacctttgactcaagactttatctcaacagctacaggtattgacgaagccatggtcaaaatcgagaagcaagaaatcgtggaacacttgtctgaaaacagtctcttggtgcaactcaagtacgctggagcttcaacagacgagccacttttgaatgaattgtacaagcattaccaagtaatggctaatattctctatgggaatatcgaaattctcgatggtactcctgttggagaattggtggtggttttgtcaggtgaaaaagcagcgttggcaggtgcccaagaagccattcgtcaagcaggtgtacaactaaaagtattgaagggagtacagtaa

SEQ ID NO: 2167 - DNA, 219 bp, Streptococcus pneumoniae
ttggcaatgtctttgacaatctgcatttcatgcgtaatcaagacaacagtcaagcctaatttttggttccaatcttgcaacaaggccaaaatatgcttggttgtcttcggatcaagggcagaagttgactcgtctgaaatcaagatttttggatcattggccaaggcacgcgcaattgccacacgctgtttttgccctccagatagttgtgaagggtag

SEQ ID NO: 2168 - DNA, 1374 bp, Streptococcus pneumoniae
atggtttttcctagcgaacaggaacagattgaaaaatttgaaaaggatcatgtagtccaacattattttgaggttttgcgtaccttgatttctaagaaatcagtctttgcccagcaggttggactcaaggaagtcgcaaattatctgggtgagattttcaagcgtgttggagctgaagtggagattgatgagagctatacagcgccctttgtcatggcacatttcaagagttcgcgtccagatgccaagaccttgattttctataaccactatgacactgtgccagcggatggggatcaggtctggacagaggatccttttacgctttcggtccgcaatggcttcatgtatgggcgtggggttgatgacgacaagggtcatatcacagctcgcttgagtgctttgagaaaatatatgcagcaccatgatgatttacctgtcaatatcagctttatcatggagggagcggaggaatcggcttcaacagacctagataagtatttggaaaagcatgcagacaaactccatggggcggatttgttggtctgggaacaagggaccaaaaatgccttggaacaactggaaatttctggtggcaataaggggattgtgacctttgatgccaaggtaaaaagcgctgatgtggatatccactcgagttatggtggcgttgtggaatcagctccttggtatctcctccaagccttacagtctcttcgtgctgcggatggccgtatcttggttgaaggcttgtacgaagaagtacatgagcccaatgaacgagaaatggccttgctagaaacttatggtcaacgaaacccagaggaagttagtcggatttatggattggagttgcctctcttacaggaggagcggatggcctttctaaaacgtttctttttcgagccagcgcttaatatcgaaggaatccagtctggttatcaaggtcagggtgttaagactattttgcctgcagaagccagtgccaagctagaggttcgtctggttccgggcctagaaccgcatgatgttctggaaaaaattcggaaacagctagacaaaaatggctttgataaggtagaattatactataccttgggagagatgagctatcgaagcgatatgagcgcaccagccattctcaatgtgatcgagttggccaagaaattctatccacagggcgtttcagtcttgccgacgacagcggggacaggacctatgcatacggtctttgatgccctagaggtaccaatggttgcattcggtctaggaaatgccaatagccgagaccacggtggagatgaaaatgtgcgaatcgctgattattacacccatatcgaattagtagaggagctgattagaagctatgagtag

SEQ ID NO: 2169 - DNA, 855 bp, Streptococcus pneumoniae
atgaaaatcaaaaaatggcttggtctagcagcccttgctacagtcgcaggtttggctcttgcagcttgcggaaactcagaaaagaaagcagacaatgcaacaactatcaaaatcgcaactgttaaccgtagcggttctgaagaaaaacgttgggacaaaatccaagaattggttaaaaaagacggaattaccttggaatttacagagttcacagactactcacaaccaaacaaagcaactgctgatggcgaagtagatttgaacgctttccaacactataacttcttgaacaactggaacaaagaaaacggaaaagaccttgtagcgattgcagatacttacatctctccaatccgcctttactcaggtttgaatggaagtgccaacaagtacactaaagtagaagacatcccagcaaacggagaaatcgctgtaccgaatgacgctacaaacgaaagccgtgcgctttatttgcttcaatcagctggcttgattaaattggatgtttctggaactgctcttgcaacagttgccaacatcaaagaaaatccaaagaacttgaaaatcactgaattggacgctagccaaacagctcgttcattgtcatcagttgacgctgccgttgtaaacaataccttcgttacagaagcaaaattggactacaagaaagcacttttcaaagaacaagctgataaaaactcaaaacaatggtacaacatcattgttgcaaaaaaagattgggaaacatcacctaaggctgatgctatcaagaaagtaatcgcagcttaccacacagatgacgtgaaaaaagttatcgaagaatcatcagatggtttggatcaaccagtttggtaa

SEQ ID NO: 2170 - DNA, 198 bp, Streptococcus pneumoniae
atggaactcttgaaaaattgtctaaacaattcttcggagacacttatctaccggcagaagctgatattaaataatttcttgaaatcatccattctgagtaaggtgggtgatttctcagtttttagggatatagttttaaactatatatctgattatctaataacaatttgtgaaatcaaacaaattgtgagatactag

SEQ ID NO: 2171 - DNA, 534 bp, Streptococcus pneumoniae
atggctgtcaacaatcttagctacactaaagaacgtgcggagaaatacctctatgccgcaccaattgcccaaaatcctaatgtccttgtcgtgaagaaagatgactctagtatcaagtctctcgatgatatcggtggaaaatcgacggaagtcgttcaagccactacatcagctaagcagttagaagcatacaatgctgaacacacggacaacccaactatccttaactatactaaggcagacttccaacaaatcatggtacgtttgagcgatggacaatttgactataagatttttgataaaatcggtgttgaaacagtgatcaagaaccaaggtttggataacttgaaagttatcgaacttccaagcgaccaacaaccgtacgtttacccacttcttgctcaaggtcaagatgagttgaaatcatttgtagacaaacgcatcaaagaactttataaagatggaactcttgaaaaattgtctaaacaattcttcggagacacttatctaccggcagaagctgatattaaataa

SEQ ID NO: 2172 - DNA, 186 bp, Streptococcus pneumoniae
  unsure (112): n at each above location is unknown.
ttgattggaggaaggttcccaaccttacctgtcactacacttgaaagaatcaaggcaaagataatggaaacaggcaaaaacttcaaaaaacgctcaacaatcgtaggcaggncccttatacttgaccaagatgaagggaatcatacggggaatccaggtctcaagaccagagaaaataaccgctaa

SEQ ID NO: 2173 - DNA, 675 bp, Streptococcus pneumoniae
  unsure (562): n at each above location is unknown.
gagggggcgcaggcagccatgccaacggctctgggctatgtcagtatcggcctggcctgtgggactatcggtgcgccctatgtgacacctgttgagatgggcttgatgagtctctttgtttatgctgggagtgcccagtttgccatgttggcactgattgtggttcaagctcctgtggcagctattgctatgacggtttttctaatcaacttgcgtctctttttgttgagtttacacgcatcgacttatttccgtcataccagtctttggtacaatatcggtatgtctagtatcttgacagatgagacctatggcgttttgatgggtgaattggcccatacagacaaggtaaatcctatgtggatgcacggaaacaatcttaacagctatgtggcttggtttgtggggacagtagtcggaacggctctgggtggcctgctaccaaatccagaaatctttggcttggattttgccctggttgggatgtttattggtatttttgcttcgcaatttcagatgatgcaaagacggattcctgttcgcaatctgctcattatcttancagttgttgcggtgtcctactttttacttttgacagtggtgtctcagtcactagctgttctgtttgcgatgctacttggttgtagcatgggggtggttttagatggtcagtaa

SEQ ID NO: 2174 - DNA, 411 bp, Streptococcus pneumoniae; identical to SEQ ID NO: 1407
  unsure (48),(49),(51): n at each above location is unknown.

SEQ ID NO: 2175 - DNA, 240 bp, Streptococcus pneumoniae
atgaaaatcaaagagcaaactaggaaactagccgcaggttgctcaaaacaccgttttgaggttgcagatagaactgatgaagtcagctcaaaacactgttttgaggttgtggatagaactgacgaagtcagctcaaaacaccgttttgaggttgtggatagaactgacgaagtcagtaaccatacctacggcaaggtgaagctgacgtggtttgaagagagtttcgaagagtataagtag

SEQ ID NO: 2176 - DNA, 225 bp, Streptococcus pneumoniae
tacgaaacaattgctaaaacatttatagaaattaattttactttcccaatcgatttgttctcatcttatttcaatctgctatataatagtccatgctgtggctggattcttttcagcctacttatactcttcgaaactctcttcaaaccacgtcagcttcaccttgccgtaggtatggttactgacttcgtcagttctatccacaacctcaaaacggtgttttga

SEQ ID NO: 2177 - DNA, 1230 bp, Streptococcus pneumoniae
gtgatgaaagtatttcttcaaaatagagattttaggcaattaactatcaaccagtggatttcaacgcttggggatacgattttttatctggcctttctgaattatgtggcagatgcgtcttttgcacctttggcgattttactcattacgatttcagaaaccctgccccaaattttacaaatctttctgggagttttggcagattttcaacatcatcgtgtcttgaaatacacagtcattagttttgcaaaatttttgctttactctatcgtttctttatcactttcagggcagtctttctccttgttgctagtagcatttatttgtctgcttaacctcttgtctgacacattgagttacttttcaggagccatgctcactccgattttcattagaattattgggcaagaccatctggcagaagctattggctttaaacagtcaactgttagtttagtgaaaacaatcagtaatatcctaggaggagtcttactaggcattctatccatccagtttatttccttactgaacgctcttacctttttaatcgcatttttaggtatcctcttcataaaaactgacctcttgaaagtagaaaaaacgattagctatcaagaaggactctctgtaaaatccttttgccagcatttgctccaatcatcaaaattgatatggaatatgaataaggtgctcttggttttgtttattatctctactagtcaagcagtgataaatgttacggttcctatttccactctatttttaaggaaccagccctttttgaatttacaaacaggtcaatctcttgccttgctatccacttttgaactgtcagccctgattgtcggaagccttgtaagtggctatctgcaacataccatttccataaaaacagctctctatgcctcacttgtcatccagttgcttcttctagtaggatttgccacagttcgttttgactggattctcatctttagtaccttggatgcctttttcgcaggtgttctctctcctagattgcaagaactcgtttttaaacaaatacctgaggagtcaatgggagcagttcaatcctctatcggtgccattacggttgttttacctagcttatttacaatagctttggtaaccattgctactagctttggaactctggcagttagctttgttttattgctatttcttctagttgcctttgttatgcttctgaatattcgtgaaagtatttag

SEQ ID NO: 2178 - DNA, 666 bp, Streptococcus pneumoniae
atgaaaaagataatctcacaccgctactttattatagtttttctactagttattgctgaccagaagttcagtgttttagttttacgcagtgaccttgttgctgggctatctgactttgcctattatctgtcggatatgatgttgaattttcttgtggttttatttgctcttattgctatgatttggtcggggaaatggcagaaaatcaatagtagaaagtttaaaggatcctatcttttctattccttcctagctctgcttgcttttgttgcttggaattttgtcaccttttttcttttcccacctactcgaaatgaaatttcttatcaacatgctgctcctacttttacaggagctacggcatttttgatgtattttttttatcctgtgattgcaggtcccatttttgaagacatgatttatcgtggattagtgatgactgctctggaaaaaggaaagaaatgggggctagatgtacttggttccgctgttttatttggggtctcgcacattagtaatcacggttgggtcttgacagactttgtcttctatatgggtggaggtcttatatttgcagtcttatttagaatgacaaagtcaatttattggcctattggactgcatatagtctacaatggcattggtcagcttttgatgttactgtaa

SEQ ID NO: 2179 - DNA, 198 bp, Streptococcus pneumoniae
atgttaaatttacaatttgcagaaacaatggaattgacagaagctgagttggagacagtttatggaggggaatttgggaataatgctgttatcccagccggtgcttggggaggtttaggaacgtcttggtcaatcactaatttctggaagaaatattttaaccatgattcttccactgttaatcgtcgccattattga

SEQ ID NO: 2180 - DNA, 888 bp, Streptococcus pneumoniae
atgcaaaagctaggaggtggtaggatgattgaaaaaatggaactgggggaattttacaaggaattacgtttggcgagaaagcttaagcagacagatgtggcttgtgagggtctaacagcttctcagttgtccaagtttgaactagggcagtctatgctgtctgcggataagttgattctagctatccaaggtataaatgtgacctttgatgagtttgggcacaagctcaacaactatcaagaatctccacatatgcgaatcggtcgaaaggttgtgaatcgctttgcccatcaggatatagctgctttagagcagctattggaggaagtcgatcaagaacagatggcgcagacctatcgtcgtttgaatgccatcgtgattaaagatgccatccattcactaaataaaagctacccactagcagaggaggatagcgagtttttgaccacctatctctatgatatcgagtcttggacctggtttgaactctatctcttttgcaataccatgcccttcttgagcaatcaagatctgatttttttatcaacctccttactcgaaaaatccaaagaatttaaagagttagtacacaatcgattgtatatgaagcaaggactcttaaatatcttatcagaactcatggagcgaaaacttttctcctacatcccaatcttcgaagccgagttggagaggatgttacgaccgtatgatgtttttgaaaaagtatcgtggcaatttttaaagaagatgagtgtctttcttcaaacaaagggaagcaatcaaaaagagattgaacgctttatccaatctctgcaggtattagaaaatccacaattaacatccctttttgaattgcgttttcagcaatataaagaacttatagattag

SEQ ID NO: 2181 - DNA, 207 bp, Streptococcus pneumoniae
gctttctcgccaaacgtaattccttgtaaaattcccccagttccattttttcaatcatcctaccacctcctagcttttgcatattatatcattatttgtgttcatttgtcaaaacattctgacactttggtgattgaaaaagccagccttaagctgactctaaaaggaccgagccttgtacaatacagaactcaatcctcgttctaa

SEQ ID NO: 2182 - DNA, 618 bp, Streptococcus pneumoniae
ttgagagaaggttgttctatatatgataatttatatccaagtcgcatagttgttggagatgagacagttgaaggaagaaaaattgcagagttgttcctttcgattagtactcatagtactgccaatattaaaaatgttatgttagtttctcctactgaagcagaagcaattaagcttttttctaacacattcttagctctccgtgttgctttttttaatgaactagattcttttgctgagaggagaagtttaaatgctgaagttgtaataaaaggtgtttgtttagatccaagaattggaaatttttataataatccttcttttggatttggaggatattgtcttcccaaagatactaaacaattaaaaaaagaatttatagaaataaatgccccagtgatagaagcgattgatatttcaaacacaaatagaaaacagttcatagttaaacaaatattggaacgaaagccaaagatagtaggaatatataaattggggatgaaatataattcagataattacaaagagtcagctattttaagtataattaatgaactattgattgtcggtataaaaattttagtatatgaaccaaatttaaacgttagttatagataa

SEQ ID NO: 2183 - DNA, 756 bp, Streptococcus pneumoniae
atggttatgagtaacaatactaagtatatctttttatctccacatttagatgacgcaattttttcctgtggtgattatatttcaaaattaacttcagaaggagaaattgtacttgttattactatattttctggttaccctttgagccaacagctacagccctctgctaagcaatttcataagttgtgtaaccttgggaaatatccgattgaagaaaggaagaaagaagacaggttagcttgtgaacgtctacagtgtgattttagacacttatcgtactatgaatgtctctataggaaagatagaaatggcaattttctataccgtcatatctatagtgaattaaaaaatgaggacacattaaagaatgatatcataaaagagctgttaatgcatttagacgacaaatgtgtcgtatattgtccgctttcacttggtgaccatattgatcatgtttttgtgaatagtattggaagggcgcttgaatttatgcgttataaagtaatatattatgaggacttcccatatgtaagtgatagtagtatggttagttatatgggaaaaactaaagaattaaaaatgtatcaagaggaacttgatgaaaaacattatattgatagaatatcatcaatattgtgctataaatctcagattttgataatctggaaatcagttgaaaaacttttaaacaatattaaagagttgtatttaaggaatggggcagcttattctattagattttggattaagaaataa

SEQ ID NO: 2184 - DNA, 222 bp, Streptococcus pneumoniae
aaatatttaattttagagataaagagcttatcttttttaagtaagattgtaaatgggctgatacaaaatattgaggagaatttagaggatgatattgaaaggatattgaaatatttatatatatgtttatttaacgaaatattcattattaagaataaggtgaatttttttgatgatgtggaatttaatcagacacttagtgaatttttagataaattgtag

SEQ ID NO: 2185 - DNA, 345 bp, Streptococcus pneumoniae
actgcaccccaaaagttagatttattctgtctaacttttggggtgcagttcattttgcatagttttggcattcatcctagatatccatataaaatgtctgagattgttgaaatgtctaaaaaaatatcagatctaaacgataaaaaagaatttcacaaaaagaactgtgagttgaggtttcaagatagtgttcttgataacataaatagtgtcccgggtacaactcatttatttagttgtttaaatattcaaacattagtaaaaattattttatatatttttcgatacaacagttgtatgaaaatatttaattttagagataaagagcttatcttttttaagtaa

SEQ ID NO: 2186 - DNA, 243 bp, Streptococcus pneumoniae
ttgttacccatgctccgcatccggaacttaaacaatattttactaagatatatcaatttccaaaggattttatttaagaatataggggagggaaacatgagattctattgtgaaacttatgaggtaattactgaagagaaaaaagtatcatttttttatgtagatgagaaacccttaaggtatctgttatttgactatatatttctactagttctagctaaaaaaaatatcccaatcttatga

SEQ ID NO: 2187 - DNA, 1617 bp, Streptococcus pneumoniae
gtgtatactattataaaatcaaatataaaaaaatttagtttattaacgatatttattgttgctggtcaattattgctaatttatgcagcaactattaatgctctggtgttgaatgaattaattgcgatgaatttagagcggtttttgaaattgtcaatctaccaaatgattgtctggtgtgggataatattccttgactgggtagtgaaaaattatcaggttgaagtgatccaagagtttaatctagagattcgaaatagagttgccacagacatctctaactctacctatcaagaatttcatagtaaatcatcaggaacatatctttcgtggctaaataatgatgttcagactttaaatgatcaggcttttaaacaactttttttagtaataaaaggaatttctggtactatatttgcagttgtgactcttaatcactatcattggtcattgactgtagccaccttgttttcattaatgattatgctacttgtaccaaaaatctttgcatcgaaaatgcgagaagttagtctaaatttaactaaccaaaatgaagcttttttaaaatctagtgagactatattgaatggatttgatgtgttagcgtccttgaatcttttatatgtattgcctaagaaaattaaagaagcaggaattttattaaagatggttatacaaagaaagacaactgtagaaacgttagcaggcgctattagcttctttctcaatattttttttcagatatctctcgtttttttaacaggctatcttgcaataaaaggaatagtgaaaattggtactattgaagcaataggagcactaacaggtgttatttttacagcgctaggtgaattaggaggtcaattatcctctattattggtacgaagcctatttttttaaaattgtattcaattaatccaattgagtcaaataaaatgaatgatatcgaaccaaatgaggtgaatagagattttccgttatatgaagcaaaaaatatttgctataagtatggagataaagaaatattaaaaaacttaaatttttgttttcaacgtaatgaaaagtatttaattttaggtgaaagtggaagcgggaaatctacattattaaaattattgaatggctttttgagagattatagtggagaattgcgattctgcggggatgatataaaaaaaacctcctatttaaatatggtttcgaatgttctatatgtagatcaaaaagcttatttgtttgaaggtacgattagagataatattttattggaagaaaattatactgatgaagaaatactacagtctttagagcaagttggtttgagtgtaaaagattttcctaataacattttagattattatgttggtgatgatgggagattactgtcaggagggcagaaacaaaaaattactttagctagagggctaattagaaataagaaaatagtattaattgacgagggaacttctgctatcgataggagaacttcgttagcgattgaacgtaagatattagatagagaggatttgactgtcattattgttacccatgctccgcatccggaacttaaacaatattttactaagatatatcaatttccaaaggattttatttaa

SEQ ID NO: 2188 - DNA, 954 bp, Streptococcus pneumoniae
atggataggaatatagatcaagaattagtaagtattataataccaacacataataggtatgaatctctgattagagctgtgaaaagttgtttacatcaaagttataaaaatatcgaagttataattattgatgataattatagtaatgtaaatttaagaaataaaattatccatcaatttggctataccaatcatagaattaagttaattttaagtaatgaagatttaggtgcaactaatgccagaaacataggtataaaaaattctagaggtaagtatatatcatttttagacgatgatgatgaatatatgccagatcgaattttaaagttgatggcttgttttaaaaagagtagaatgaagaatttagctttagtttatagttatggaataataatttatccaaatggtacacgagaagaggagaagaccgattttgttggaaatcccttgtttgttcaaatggttcacaatatagcaggtacgtcattttggttgtgtaaaaaagaggtgctagaattaattaatggttttgagaaaatagattcacatcaggacggtgttgttttattaaaactacttgctcaaggataccaaattgatatagtgcgagaattcttggtgaattactacgctcacagtaaagaaaacggtatcactggagtgacacaaaaaacaattaatgcagatgaagaatattataattactgtaggaaatattttaatttattgagtttcaacgagagaatattggttacaaagaaatattattctttaaacataaagcggttactattaataggagacaaatgcaaggctttaaaagtaatcaagaaggcaagagaagaaaaaatttttaacgaatttctttttttgaaatatatgttattatataattttggttttttctattgtatatatgacaactatgttcaattaaaatttagaaagtga

SEQ ID NO: 2189 - DNA, 525 bp, Streptococcus pneumoniae
ttggatccagaaaaaaggccggatagattccttgaatttgcagaaaaattatttttagtcagagaagatgtgatttttattatggctggaaatggtagtatgtgggctgctttgaaagaaaaaatttgccatttgaaatgtagagataatttcaggttacttggtgaaatctatccagctactatagtttaccaaatatcggatttattgtatattccttatgatacagaaggaatacctatgtgtgttttagagtcaatgtcacaaggaactccggttttagctagtaatgttggcgggttaagtgaaattattgaacatagggttgatggatttttatttgagaaggaagatgttgagggagtgtgtgcttgtgctaattttttactcaatgattctgagtatttgaaatatataggtgagaatagtaaatcaaaaataagaaaacatttttctgtgcaaaaaatgtttgtagaaaccatgagagtatatgatgaattattagagaagagtagtcatggatag

SEQ ID NO: 2190 - DNA, 564 bp, Streptococcus pneumoniae
atggttacaatgcaatatagttgtggaaaaataaatattaatatccctgatggatatggagacattaaggatatagtgttttcggctcatattatagttaggtataataatggacattgtggaggtatagatccgcatataattggactttgtaaaaagcagatcagaaggatgtctctatatcctattttgataatcgtatctagagattcaaaggttattgatgattataaaaatttagatattgcctatgttgattgtactcaatgttcaaataattttgaaactgccttacacgttaaaaatattttaaaattattaaaaatccgacttatacactgtcatggctactcaactaattattttttatatatgttaaaaaaacttgacaagaatggatttggaaaggttaagacagtgataacatgccatggatgggttgaatataacttaaaaaagaaattcttgacttattttgatttttggacatattctatgggagatgcttttatttgtgtatctgaaactatgaaaaaaagattggagagtataataaaaaaataa

SEQ ID NO: 2191 - DNA, 321 bp, Streptococcus pneumoniae
aaaattgatagagataaattaaaaatctatattgaaactcatcccgatgcttatttgactgaaatagctgctgaattcaactgtcctccaacaactattcattacgctctaaaggctatgggatatagtctaaaaaagagccgtacctactgcgaacaagacccagaaaaagtaaatcggttccttaaagaattgaatcacttaagctacctgactcctatttatatttatgagacaggggttgagacctatttttatctcgaatatgatcgagccttgagcaggcagttagtctctctgaaagaagatataattatttga

SEQ ID NO: 2192 - DNA, 264 bp, Streptococcus pneumoniae
atggctccgatgacctataaagatacgatgacgagtgactttttcgaagcttgcttccaaaaattcttactacctactttagatacaccatcccttatcattatggacaatgcaaggtttcacagaatgaacatgtgtaaggagcagggcatagactgttaccacttcctacctattcacctgagtataatcccattgagaaaatatgggcttacatcaaaaacatctcagaataatattgtcaaattacgatgcttttcttga

SEQ ID NO: 2193 - DNA, 1065 bp, Streptococcus pneumoniae
ttggaatgttttggctctataatttctgtagtgggtaatcccaccccaggaattatagggtcgtttcttgtagaaaaaaagccccatatgacctataatgaaaagcgtctaaccaactcattagaaagggttcatatggaacaacttaagaataccacagatttgctcggattggaagacaaaaatatcaaaatcttgtctgttctgaaataccaaacccatctagtcgttcagccaaagttggattcccccgctcctccttgtcctcattgtcaagggaagatgatcaaatacgacttccagaaagcctctaaaattccgcttctcgactgtcagggtttacccacggtactgcatctcaaaaagcgccgctttcagtgcaagaattgccttaaggtggtcgtttctcaaacatccattgtcaagaaaaattgccagatttccaacatggtgagacaaaaaatcgctcagctcctccttgaaaagcagtctatgactgagattgcccacagattggcggtctcaacttccaccgtcatccgaaaactgagggaatttaagtttgaaaccgattggaccaagttgccaaaagttatgagttgggatgagtatagcttcaaaaagagcaaaatgagcttcattgcccaagattttgagtccaaatccatcctcgcaattttagacgggcgaactcatgcggtgattcgaaaccatttccaacgctatcagagagaggttcgggagctggtcgaggtcatcaccatggacatgtacagcccttattatcggctcgctaagcaactctttccaaaggcgaagattgttcttgaccgcttccacattgtccaacatctgagccgagctatgaaccgagtacgaatccaaatcatgaaccaatttgaccgaaaatccttggagtatcgggcgctcaagcgcttttggaaccctcgctttttcgtttctaggctcgggctaaatcagtccactggactgatttactacaccaggatagcttcaagctctgtcagaaacgattctatcagcccacgtttcgaatgcacttaa

SEQ ID NO: 2194 - DNA, 387 bp, Streptococcus pneumoniae
atgcacttaacccatcgggaagtacgagataaactgctttcttactctgagggattacaggttcactacgaactctatcaactcctgctctttcattttcaagagaagaatgccgaccatttctttggattgattgagcaagaactgccaacggttcatccgctttttcaaacggtcttttggacttttttaagggatagagataagattatcaacgcacttaagctgccttattccaacgctaaacttgaagcgaccaataatttgattaaggttatcaagtgcaaagcctttggtttccggaactttaacaattttaaaaaacggattttgatgactttgaacatcaaaaaagagagtacgaatttcgtactctccagattgtaa

SEQ ID NO: 2195 - DNA, 213 bp, Streptococcus pneumoniae
tgggtaggcgaaaagttacaatctggagagtacgaaattcgtactctcttttttgatgttcaaagtcatcaaaatccgttttttaaaattgttaaagttccggaaaccaaaggctttgcacttgataaccttaatcaaattattggtcgcttcaagtttagcgttggaataaggcagcttaagtgcgttgataatcttatctctatcccttaa

SEQ ID NO: 2196 - DNA, 1011 bp, Streptococcus pneumoniae
atgaaggatagatatattttagcatttgagacatcctgtgatgagaccagtgtcgccgtcttgaaaaacgacgatgagctcttgtccaatgtcattgctagtcaaattgagagtcacaaacgttttggtggcgtagtgcccgaagtagccagtcgtcaccatgtcgaggtcattacagcctgtatcgaggaggcattggcagaagcagggattaccgaagaggacgtgacagctgttgcggttacctacggaccaggcttggtcggagccttgctagttggtttgtcagctgccaaggcctttgcttgggctcacggacttccactgattcctgttaatcacatggctgggcacctcatggcagctcagagtgtggagcctttggagtttcccttgctagccctcttggtcagcggcggacacacagagttggtctatgtttctgaggctggcgattacaagattgttggggagacacgagatgacgcggttggcgaggcctatgataaggtcggccgtgtcatgggcttgacctatcctgcaggtcgtgagattgacgagctggctcatcaggggcaggatatttatgatttcccccgtgccatgattaaggaagataatctggagttttcattctctggtttgaagtcagcctttatcaatcttcatcacaatgccgagcaaaagggagaaagcctgtctacagaagatttgtgtgcttccttccaagcagcagttatggacattctcatggcaaaaaccaagaaggctttggaggaatatcctgttaaaaccctagttgtggcaggtggtgtggcagccaataaaggtctcagagaacgcttagcagccgaaatcacagatgtcaaggttatcatcccccctctgcgactctgcggagacaatgcaggtatgattgcctatgccagcgtcagcgagtggaacaaagaaaacttcgcaggctgggacctcaatgccaaaccaagtcttgcctttgataccatggaataa

SEQ ID NO: 2197 - DNA, 438 bp, Streptococcus pneumoniae
atgatagaaatcaagcgaattcaacaacagcctgacctagctcaagccatctacgctgttatggcagctgtttacctagtcagtccttggactctggagcaaatccaagcagatctgtcccaagaccagacttggtatgcattggcttatgatggggcagaagtgattggatttctagctgtgcaggagaatctttttgaagcagaagtcctgcaaatcgctgtcaaaggagcttatcagggtcagggaattgcgtcagccttgtttgctcaattgccgacagataaggagattttcctcgaagtcagaaagtcaaatcaacgagcgcaagcattttacaagaaagaaaaaatggcggtcatcgctgatcgaaaggcctactaccatgacccagtcgaggacgccattatcatgaagagagaaatagatgaaggatag

SEQ ID NO: 2198 - DNA, 684 bp, Streptococcus pneumoniae
atgaaagtattagcttttgatacgtccagcaaggctctttctctggctattttagaggacaagcaggttcttgctgagacgacgattaatatcaagaaaaatcacagtattaccctcatgccagccattgattttttgatggagagtttggactggacgcccaaggatttggaccgaatcgtggtggcggaagggccaggtagctacacaggcttgcgaatcgcggtagccactgccaagaccttgactcatactctgaacattgagttagttggtatgtctagcctcttggctctggtgccatatcaacaagaaggcttgttcgttcctttgatggatgcgcgtcgcaacaatgtttatgcaggattttatgaaaatgctaaacctgtcatgccagaagcgcacctatcttttgaagaggtgctagaaaaagtcaagggtgctagtcaggtaacctttgtcggagaagttgccccctttgtggagcagattcaagaacacttgccaaggactaattataaagaaaccttgcctaatgcagccaatcttgctcttttagcttgggacaaggaagcagactccttgcatgattttgtgccgaactacctcaagcgtgtcgaagctgaggaaaattggctcaagaatcacaccgagtctggtgagtcctacattaaacgcctatga

SEQ ID NO: 2199 - DNA, 186 bp, Streptococcus pneumoniae
atgacaaattttgacattcttgacaatcaatttttatccttatctgaaaatgaattatcagatattgatggcggtctcgctcccttggttatctttggagtagcagtatcttggaaggctattgcaggtggaacagcacttataggttctggtttggcagctggttattttttaggaggagattaa

SEQ ID NO: 2200 - DNA, 231 bp, Streptococcus pneumoniae
ttggaaggctattgcaggtggaacagcacttataggttctggtttggcagctggttattttttaggaggagattaactatgatgaaagatttgaacaactatcgtgaaatttctaataaggaattgcaagaaatcaagggtggctttggtgtaggtgttggtatcgctttatttatggcaggttataccattggaaaagaccttcgtaaaaagtttggtaagtcatgctag

SEQ ID NO: 2201 - DNA, 234 bp, Streptococcus pneumoniae
atgatttacaaagttttttatcaagaaacaaaagaacgtagcccacgccgtgaaacaacacgcgcgctttacctagacatcgataccagctcagaacttgagggccgtatcactgctcgccaacttgtcgaagaaaatcgcccagagtacaatatcgaatatatcgaactcttgtctgacaaattgctcgattacgaaaaagaaactggcgccttcgaaattacggagttctaa

SEQ ID NO: 2202 - DNA, 1680 bp, Streptococcus pneumoniae
atggcctacactcttaaacctgaagaagttggtgtttttgccatcggtggtctaggagaaatcgggaaaaacacttacggaattgaataccaagacgagattatcatcgtcgatgctgggattaaattcccagaagatgacttgcttggtatcgactatgtcattcctgactactcttacatcgtagacaatatcgaccgcgtcaaggctgttttaatcacacacggacacgaggaccacattggtgggattccgttcctactcaagcaagcaaatgtccctatttatgctggaccgcttgccttggctttgatccgtgggaaactcgaagaacacggcctcttgcgcaacgccaaactttacgaaatcaaccacaacaccgagttgacctttaaaaatctcaaggcaactttctttagaacgactcactctattccagagcctttggggattgtcattcatactcctcaagggaaaatcgtctgtacgggtgactttaagttcgactttactccagttggagaacctgcggacttgcatcgtatggctgcgcttggtgaagaaggcgtgctctgtctcctgtctgactcgacaaatgcggaagtaccaacctttaccaactctgaaaaagtcgttggtcagtccattatgaagattatccaaggtattgaaggacgtatcatctttgcatcctttgcctcaaatatcttccgtctccagcaggcaacagaagctgctgttaagactggacgcaagattgcggtctttggtcgttctatggaaaaggccattgtcaacggaatcgatcttggctacatcaaagctcctaagggaacctttatcgagccaaatgaaatcaaagattatcctgcaggagaagttcttatcctctgtacaggtagtcagggtgagcctatggcagccctctctcgtatcgccaacggaacccaccgtcaagtacaattacaaccaggtgataccgttatcttctcttctagtcccatccctggaaacactactagcgtcaacaagctgattaacatcatttctgaagctggtgtcgaagttatccacggtaaagtgaacaatatccatacatctggacacggtggtcagcaagagcaaaaactcatgctctgcttgattaagccaaaatacttcatgcctgtccacggtgaataccgcatgcaaaaagtccacgctggactagcagtggatactggtgttgagaaggacaatatctttatcatgagcaatggcgatgtgcttgcccttactgctgactcagctcgtatcgcaggtcatttcaacgcccaagatatctatgtcgatggaaatcgtatcggtgaaattggcgcagctgtcctcaaagatcgtcgcgatctatctgaagacggtgtcgttctggcagtcgcaactgttgacttcaaatcgcagatgattctgtctggcccagatatcctcagccgaggctttgtctacatgagagagtctggagacttgattcgccaaagccagcgtatcctcttcaatgccattcgtatcgcactgaaaaataaggatgctagcgtgcaatctgtcaatggtgccattgtcaacgctattcgccccttcctctatgaaaataccgaacgtgaaccgatcatcatcccgatgatcctcacaccagatgaagaataa

SEQ ID NO: 2203 - DNA, 363 bp, Streptococcus pneumoniae
ttgagttttaatctcaaaagaaagcatagagaaaaacagctccgaagacggggctgttttgttgctttattcttcatctggtgtgaggatcatcgggatgatgatcggttcacgttcggtattttcatagaggaaggggcgaatagcgttgacaatggcaccattgacagattgcacgctagcatccttatttttcagtgcgatacgaatggcattgaagaggatacgctggctttggcgaatcaagtctccagactctctcatgtagacaaagcctcggctgaggatatctgggccagacagaatcatctgcgatttgaagtcaacagttgcgactgccagaacgacaccgtcttcagatag

SEQ ID NO: 2204 - DNA, 1914 bp, Streptococcus pneumoniae
atgatttatcattttactgaagaatacgatattattgtaattggtgcgggacacgctggggttgaggcttccttggccgctagccgtatgggctgtaaggtcctgcttgcgaccatcaatattgaaatgctggctttcatgccttgtaatccctctatcggtggttctgccaaggggattgtcgtacgtgaagtcgatgccctcggtggcgagatggccaagactattgacaagacttacatccagatgaagatgctcaacacagggaaggggccagctgtccgtgctcttcgtgcgcaggctgacaaggaactttactctaaggagatgcgcaagacagttgaaaatcaagaaaatctgacccttcgtcaaaccatgattgatgagattttggtggaagatggcaaggctgtcggtgtgcgtacagccacccatcaagaatatgctgctaaggctgttattgtgacgacagggactgctctccgtggggaaattatcatcggagacctcaagtactcatcaggtcctaaccacagcttggcttctattaacctagctgacaatctcaaggaactgggtctcgaaatcggtcgtttcaagacaggaacccctccacgtgtcaaggcttcttctatcaattacgatgtgacagaaattcagccaggagacgaagtgcctaatcatttctcatacacttcacgtgatgaggattatgtcaaggaccaagtaccatgctggttgacctataccaatggtaccagtcatgagattatccaaaacaacctccaccgtgcgcctatgtttacaggtgtggtcaagggagtgggacctcgttactgtccatcgattgaggacaagattgtgcgctttgcggacaaggaacgtcaccaactcttccttgagccagaaggacgcaatacagaggaagtctatgttcaaggactttcaaccagtctgcctgaggatgtccaacgtgacttggttcattccatcaaaggtctggaaaatgcagagatgatgcgaacaggttatgctattgagtatgatatggtcttgcctcatcagttgcgtgcgactttggaaaccaagaaaatctcaggtctcttcactgctggtcagacaaatggaacgtcaggttacgaagaggcagcaggccaagggattatcgcgggtatcaatgcggctctgaaaatccaaggcaagcctgaattgattctaaaacgaagtgacggttacattggggtcatgatcgacgacttggtgaccaagggaaccattgaaccttaccgtctcttgaccagtcgtgctgaatatcgtctcattcttcgccatgacaatgctgatatgcgcttgactgagatgggccgtgagattggccttgtggacgatgaacgctgggctcgttttgaaatcaagaaaaatcaatttgataatgagatgaagcgtctagacagtatcaaactcaagccagtcaaggaaaccaatgctaaggttgaggaaatgggcttcaagccgttgacagatgcggtgacagccaaggaattccttcgccgtccagaagtttcttaccaagatgtggtggccttcatcggaccagctgcagaggaattagatgacaagattatcgaattgattgaaacagaaatcaagtacgaaggttacatctcaaaagccatggatcaggttgctaagatgaagcgcatggaagaaaaacgtattccagccaatatcgactgggatgacattgattctatcgcaaccgaagcccgtcagaagttcaaactcatcaatccagaaaccatcggccaagccagccgtatttcgggagtaaacccagcagatatttctattttgatggtgtatctggaaggtaaaaatcgtagtatttctaaaactcttcaaaaatcaaaatga

SEQ ID NO: 2205 - DNA, 474 bp, Streptococcus pneumoniae
ttgatgggtggctgtacgcacaccgacagccttgccatcttccaccaaaatctcatcaatcatggtttgacgaagggtcagattttcttgattttcaactgtcttgcgcatctccttagagtaaagttccttgtcagcctgcgcacgaagagcacggacagctggccccttccctgtgttgagcatcttcatctggatgtaagtcttgtcaatagtcttggccatctcgccaccgagggcatcgacttcacgtacgacaatccccttggcagaaccaccgatagagggattacaaggcatgaaagccagcatttcaatattgatggtcgcaagcaggaccttacagcccatacggctagcggccaaggaagcctcaaccccagcgtgtcccgcaccaattacaataatatcgtattcttcagtaaaatgataaatcatgtttctctcctattcctcaagatgaatgtgtcttag

SEQ ID NO: 2206 - DNA, 483 bp, Streptococcus pneumoniae
ttgtgtcgtttaagggaaaggacaagaatgactcaacaagactttcggacaaaagtagacaatacggtttttggtgttcgggcgacagctttgattcttcaaaatcgcaagcttctagtcaccaaagacaagggcaagtattacattatcggcggtgcgattcaagttaacgaaaaaacggaagacgcggtagtccgtgaagtgaaggaagaactgggtgttaaatctcaagctgggcagctagcttttgtggttgaaaatcgttttgaagtggacggcgtttcctatcacaatatcgagtttcattatctggtggatttgcttgaagatgccccgttgaccatgcaggaagatgagaaaaggcagccctgtgagtggattgacttggataagctccagaatatccagctagttccagcctttttaaaaacagccctaccagattgggaaggccaactaagacacattcatcttgaggaatag

SEQ ID NO: 2207 - DNA, 1176 bp, Streptococcus pneumoniae
gtgaagcacacacgaccttcaatcgtgaataaacgaatagatgggagacttaccatgagtgataactctaaaacacgtgttgtcgtggggatgagtggtggtgttgattcgtcggtgacggctcttttgctcaaggagcagggctacgatgtgatcggtatcttcatgaagaactgggatgacacagatgaaaacggcgtctgtacggcgaccgaagattacaaggatgtggttgcggtggcagaccagattggcattccctactactctgtcaattttgaaaaagagtactgggaccgcgtttttgagtatttcctagcggaataccgtgcagggcgcacgccaaatccggacgttatgtgcaacaaggaaatcaagttcaaggcctttttggactatgccatgaccttgggggcagactatgtagcgactgggcactatgctcgagtggcgcgtgatgaggatggcactgttcacatgcttcgtggcgtggacaatggcaaggaccagacctatttcctcagccaactttcgcaagaacaacttcaaaaaaccatgttcccactaggacatttggaaaagcctgaagttcgaaaactagcagaagaagcaggcctttcgactgctaagaagaaagactcgacagggatttgctttatcggagaaaagaactttaaaaacttcctcagcaactacctgccagctcagcctggtcgcatgatgactgtggatggtcgcgatatgggcgagcatgcaggtcttatgtactatacaatcggtcagcgtggcggactcggtatcggtgggcaacacggcggtgacaatgccccttggttcgttgtcggaaaagatctaagcaagaatattctctatgtaggacaaggattctaccatgattcgctcatgtcaactagcctagaagccagtcaagtccactttactcgtgaaatgccagaagagtttacgctagaatgtacggctaaattccgttaccgtcagcctgactctaaggtgaccgtccatgtcaaaggagacaaggcagaggtcatctttgcggaaccacaacgcgcgattacaccaggacaggcagttgtcttttacgatggcgaagagtgtctaggtggtggtttgattgacaatgcttaccgcgatggacaagtttgtcagtacatttag

SEQ ID NO: 2208 - DNA, 180 bp, Streptococcus pneumoniae
ttgagcaaaagagccgtcaccgacgaatcaacaccaccactcatccccacgacaacacgtgttttagagttatcactcatggtaagtctcccatctattcgtttattcacgattgaaggtcgtgtgtgcttcacgattgaaggtcgcttaagcagtattcattataacacgcttggttag

SEQ ID NO: 2209 - DNA, 198 bp, Streptococcus pneumoniae
atagatttatgttcgtattctttaggtacctatcttatgatttcaggaaatgtcattaaaaaacgactccttttctctaacttgaaaaatagattagagaaaatgggttgttttatttattatagttatttgaatgaagataagaataaggtatactcacatcattcacataatctgtatattgactataagttttaa

SEQ ID NO: 2210 - DNA, 1653 bp, Streptococcus pneumoniae
ggagaaagcgaaagaagtaaaaaaagcttcggaagagaacaagctgcaaatctgaaatatcaacaagagttggttaaatatattaaatatacacgtgaaaataattcaacaaaaagaactgaagctgagaaagtaatgactgcagctaagaaagagcatgagaaaaaacaaacagaacttgctaaagttctcgcaaaggtaattcctagcgcggaagaattagaaaatactagacaaaaagcagagaaagctaaagaaaaagaaccagagcttactaaaaaactagaagaagctaaagcaaaatcagaagaagctgagaaaaaagctactgaagccaaacaaaaagtggatgcagaacatgctgaagaagtcgttcctcaagctaaaatcgctgagttggaaaatgaagttcagaaactagaaaaagatctcaaagagattgatgaatctgactcagaagattatgttaaagaaggtctccgtgctcctcttcaatctgaattggatgccaaacaagctaaactatcaaaacttgaagagttgagtgataagattgatgagttagacgctgaaattgcaaaacttgaaaaaaatgtagaagatttcaaaaactcaaacggtgagcaagctgaacaataccgtgctgcagctgaagaagacttagctgctaaacaagctgaattagaaaaaactgaagctgaccttaagaaagcagttaatgagccagaaaaaccagctccagctccagaaactccagccccagaagcaccagctgaacaaccaaaaccagcgccggctcctcaaccagctcccgcaccaaaaccagagaagccagctgaacaaccaaaagcagaaaaaccagctgatcaacaagctgaagaagactatgatcgtagatcagaagaagaatataaccgcttgacccaacagcaaccgccaaaagcagaaaaaccagctcctgcaccacaaccagagcaaccagctcctgcaccaaaaacaggctggaaacaagaaaacggtatgtggtacttctacaatactgatggttcaatggcgacaggatggctccaaaacaacggttcatggtactacctcaacagcaatggtgctatggcaacaggttggctccaaaacaatggatcatggtattacctaaatgctaacggtgctatggcaacaggttggctccaaaacaatggttcatggtactacctcaacagcaatggcgctatggcgacaggatggctccaatacaatggctcatggtactatctaaacgctagcggcgctatggcaacaggttgggctaaagtcaacggttcatggtactacctcaacgctaacggttcaatggcaacaggatggctccaatacaacggttcatggtactacctcaacgctaacggtgctatggcaacaggttgggctaaagtcaacggatcatggtactacctcaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctatgaagtcaatgccaatggtgaatgggtttaa

SEQ ID NO: 2211 - DNA, 237 bp, Streptococcus pneumoniae
aaaaaactgaagctgaccttaagaaagcagttaatgagccagaaaaaccagctccagctccagaaactccagccccagaagcaccagctgaacaaccaaaaccagcgccggctcctcaaccagctcccgcaccaaaaccagagaagccagctgaacaaccaaaagcagaaaaaccagctgatcaacaagctgaagaagactatgatcgtagatcagaagaagaatataaccgcttga

SEQ ID NO: 2212 - DNA, 192 bp, Streptococcus pneumoniae
ttgttgatcagctggtttttctgcttttggttgttcagctggcttctctggttttggtgcgggagctggttgaggagccggcgctggttttggttgttcagctggtgcttctggggctggagtttctggagctggagctggtttttctggctcattaactgctttcttaaggtcagcttcagttttttctaa

SEQ ID NO: 2213 - DNA, 309 bp, Streptococcus pneumoniae
ggagccggcgctggttttggttgttcagctggtgcttctggggctggagtttctggagctggagctggtttttctggctcattaactgctttcttaaggtcagcttcagttttttctaattcagcttgtttagcagctaagtcttcttcagctgcagcacggtattgttcagcttgctcaccgtttgagtttttgaaatcttctacatttttttcaagttttgcaatttcagcgtctaactcatcaatcttatcactcaactcttcaagttttgatagtttagcttgtttggcatccaattcagattga

SEQ ID NO: 2214 - DNA, 318 bp, Streptococcus pneumoniae
ggaacgacttcttcagcatgttctgcatccactttttgtttggcttcagtagcttttttctcagcttcttctgattttgctttagcttcttctagttttttagtaagctctggttctttttctttagctttctctgctttttgtctagtattttctaattcttccgcgctaggaattacctttgcgagaactttagcaagttctgtttgttttttctcatgctctttcttagctgcagtcattactttctcagcttcagttctttttgttgaattattttcacgtgtatatttaatatatttaaccaactcttgttga

SEQ ID NO: 2215 - DNA, 309 bp, Streptococcus pneumoniae
atgaataagaaaaaaatgattttaacaagtctagccagcgtcgctatcttaggggctggttttgttacgtctcagcctactgttgtaagagcagaagaatctcccgtagccagtcagtctaaagctgagaaagactatgatgcagcagtgaaaaatgctacagctgcaaaaaaagcagcagaagacgctcaaagagctttagatgaagcaaaagctgcgcagaaaaaatatgacgaggatcaaaagaaaactgaggagaaagcgaaagaagtaaaaaaagcttcggaagagaacaagctgcaaatctga

SEQ ID NO: 2216 - DNA, 279 bp, Streptococcus pneumoniae
atgtacaatgatgtaatcgaaaggatatctttatatgagtttatcggtgatattttctattctaaaataataagttgttgcatcgtagctagcgatttatctaaaaatactatgaaattggacgtcatattttttgaggataaaaataaaagatccgcagttttaggtttacgaagagacaaaagcggagtatttaaaccagttactctacattttacaagcgctaagaaatatgctaaagttcgtaaaacagatgtgaaagaaatgaaatggctataa

SEQ ID NO: 2217 - DNA, 300 bp, Streptococcus pneumoniae
ttgggcaatagtgagaactgccccgtgcttttttattttgagaaaatatggagtttgtcgttgaaattacttgattgtattttggactatcaagaaagattcaatggaaaaacatgtcaagtatcaacgaattataagtatttagagattttcaaagtgaatttttgtttgactgatttacatcatttatttgacttatacaaaatcacacgagattatgctagtcaaacaaaacctgctattcaagctggtgtttttattttagaagattttagaaatatcctatgtacaatgatgtaa

SEQ ID NO: 2218 - DNA, 213 bp, Streptococcus pneumoniae
atggagaatcgtcacatgaaacatttttttgcaggaattggtgagataaaacttgttggctacttattgtatatatgtgtaggactagcccctctttttcatatatatgtcataggttcggaactgagttttgtgaaaatagtgttatctattttgggagttatatttgtaagtatgttaactattgctcgaatttatcggacttttctataa

SEQ ID NO: 2219 - DNA, 759 bp, Streptococcus pneumoniae
ttgggatggattcatatctgcgacagtaagatgagtaatgtagataagattcgaaaaatacatattatcgtatgttggatgtatatatttttatcattcagggcgattataaatgacacggagtattttttgcttatttttttagcttttatctactcaatagtatcactacctctatattctgtgaaaaataaaatagtatctatctgtctagccataaattcgattctgttaatgagtttccccattttaatcaataagtttttcccagaaagttttttgacttataccgtattaataagtgtttttatcctagagttagcaatctttcatttaattggggaagattttgctactaaattgactaacgaatataagaaaattagtcagtttagaagcaaggtgtctcaatctccttggataaaatatttagagatttctagttttatattaactatatttccatctattctttatggtacagttgataatcatgtactgactcttatctttttgataaaaatttgtgcagataccacgataaaatttttattcatcagattatttgacacaagtactttaatgaagaggagaatattttttcttttcgcattggatgttatagtttacttatttttaggatatcttttagtgattcaaaaagcaggctatttgttttcggttttacttcttttttctaatttttcagttccatttatcaaagaaaaggaatacgaattatttaaaaatagcaagtaa

SEQ ID NO: 2220 - DNA, 387 bp, Streptococcus pneumoniae
atgaaacaatttcaactaaggaggagaaaacaaatggaacttgtattaccaaataattatgttgtgattgatgaagaagaaatgatgtatcttgatgggggagcttatttaagcaagcgtgcttgtcaaggaatttgcgtagctttagctatgagttcaggaacttttatagcattagctggagctgcagttttaaccaaaaaactaataaactatattaaggttggaagctttggaggctggcttattggtgcagcagcaggtgtattggctggggcggcaggaagaatagcttactgtattggatatggtactcttaatagagattgtgatattagcgggaacccttatccttgggatggattcatatctgcgacagtaagatga

SEQ ID NO: 2221 - DNA, 903 bp, Streptococcus pneumoniae
atgatacgtaaactaattgttttcttactaatgctccctctttttgtcttgtggctagagttgcatgtcctagtgaataacttactattgaatctagaatctccccttgattttgtgattagtatgagtcttgctttctgtagtttgattttatcaaaaatagttttagacatactatacgcattgaaagatttgtacaagaaagaagctcttattacgatttttccttttatttttataggcaggaagaaagtaaatgtgaggttctcgccctatttttcattccatcgtaaaagtttgtcgcctgatgatttaagatctaggattatatggagttttattcttgaaattgctattatcctagtatttattttaaaaattccttttgcaatcatcatgcttactacaatatttttctggactataatggatatcaatcatctcgtttttaataagacggaatttctttttaatcaaaataaatgggaaaaagaagattcgtttgaaagcgatttgacgaaaacgttaaaggataaaatacaaaaatcagagctaagttattctgacttaatgtcccttcttctctatgatgcgatgaaccaatccacctttttaacggatagtgaactttttgaggatattttgaaaaaaatcgaagattctcataacacccttctgtgtacaggttttgtcgagttactgctgtatgaaatgtctattagtaacaataacaactggtccaacaaggttgataaaattagaatacacctcatcagaataaatcaattagattttttctattatacaagttggttaaggcaaaattttgatttctgtatgaatagagagtatcataaaatgaaatctcggaaattattactgagtaataaaaagatagtttaa

SEQ ID NO: 2222 - DNA, 183 bp, Streptococcus pneumoniae
atgggtattaaaatggaaaaaatttttgttattattttttttgtatgtctatttatatcatccataacttttttagcctatgattttgttagcgaagaaataaaaaaattgattatttggatcaatgtcgtttttttgattttaatcatagcaatgatgatttatccaaaattaagaaaatga

SEQ ID NO: 2223 - DNA, 375 bp, Streptococcus pneumoniae
atggaactcgtattaccaaataattatgttgttcttgagcaagaagagatgatgtatcttgatgggggattttctattccgagatggcctgttgcaacagccattaatatagcttttaatggtgttttaggtggaggagcaatcagtctagttagaaattatattcgtaattatggtttgcggcgagttacaagcgcaattgctggagcagctgcaagatatgttggggtacgagttgcaaatagagtggcaggatttgcactgtctgctattaatggatttgcagcttggatgtcaattggcgatgctattacaacaatctgggccaacaatgatgtaaataggagagacccaaatttaaacgccttgtggtaa

SEQ ID NO: 2224 - DNA, 186 bp, Streptococcus pneumoniae
ataagatatcctttctctaccttatttgtttttataggttacctaaggtttaaaatcaattattgtttgaaacttaacagttctaaaccactagcaataaatgattgcgaactcactaatactatttcaaaatttattttttttgacttagtaacgcaattccaattagcaatacacctaatataa

SEQ ID NO: 2225 - DNA, 681 bp, Streptococcus pneumoniae
atgggatttagtccaggaatagcagtgttttataaggagagtcaaacaactaagaatctgtttaaattttactacttcttgtactttacaacactaatttcatactattttttctttacttttgtgtatgacaaaccgttgcttttgcctcttattccattttctattatcatagcattagtacaaaaactttatagaattgagaatcaacaattatttctgttaaaatcaaaggtactaacaatactggaatctaagaagaattgtgagtttaatcttcaggattatcatgaaatttggaaattgcaatcaaaatctgagttgccatgcgtggctttatcttatatcagtttgatcaagccatatctttcagagagcgtgcgtgaacaaattgatttattagaagttaagcgatttaaaaaaataaatcatccaatatcactttatggtatgttggatgttataaaattaaatctatatttacggcattataatgaaaaaaataaatatgaatcaatgttaaagaaaattttagaggtaagaccagactttgttttaatcgagcagaatattgatgatagtttaaatagctcgcaaccattatctttatctttagccatttcagaaatccaacttttgcttgaagtgtatatggggatcaaacatgtttcaaccaagtga

SEQ ID NO: 2226 - DNA, 228 bp, Streptococcus pneumoniae
atgtttttacatcattttacagagatttacgacacttttgccccttttttgccccttttgagcaaacaaaaaaaccgcaagcctgagcctgcggtgaaagaacaatttagaaagtttcctttctatttatttaactgtaatcaagccatctggctctactgtgaactctggcttgtctgccatgctaccgtctggtttgaggtagtaccagcctgttccgtccgctga

SEQ ID NO: 2227 - DNA, 957 bp, Streptococcus pneumoniae
atggatatcgatagaaacagactacgtacaggcttgccacaggttggggtgcagccttatcgacaagtacatgctcactcaacaggtaaccgcaactcaaccgtacagaatgaagcggattatcactggcggaaagacccagaattaggttttttctcgcacgttgtcggaaacggtcgcatcatgcaggtaggacctgtgaacaacggaagttgggatgttgggggcggttggaatgctgagacctatgcagcggttgaactgattgaaagccattcaactaaggaagagtttatggctgactatcgcctctatatcgaattgctacgcaatctagcggacgaagcaggcttgccgaagactcttgatacagacgacttggcaggtatcaagacgcatgaatactgtaccaataaccaaccaaacaaccactcagaccacgttgacccttatccatatcttgcaagttggggcattagccgtgaacagtttaagcaagacatcgaaaacggcttgagcgctgcaacaggctggcagaaaaatggcactggctactggtacgtacactcagacggcttttatccaaaagataagtttgagaaaatcaacggtacctggtattatttcgatggctcaggctatatgctttcagaccgctggaagaagcacacagacggtaattggtactggttcgacaactcaggcgaaatggccacaggctggaagaaaatcgctgagaagtggtactattttgatgtagaaggtgccatgaagacaggctgggtcaagtacaaggacacctggtactacttagacgctaaagaaggcgccatggtatcaaatgcctttatccagtcagcggacggaacaggctggtactacctcaaaccagacggtagcatggcagacaagccagagttcacagtagagccagatggcttgattacagttaaataa

SEQ ID NO: 2228 - DNA, 333 bp, Streptococcus pneumoniae
atgcagcaaattactgaaatcatcattgcttttgcgacaagctttttaacagtagcagtaggcggtattgtaaaagcagtaaaagattatcttttgcgtaaaggcggagagaaagcggtgatcatcgctgaaattctagctaaaaatgcagtaaatgccgtggagcaggtagctgctgaaactggctacaagggagatgaaaaactggcacaggctcgcgctaaagtccgtgctgagcttacaaaatacaatattagcatgactgacaaagacttagacaccttcgtagagtcagcagtgaagcagatgaatgacgcatggaaaggacgatag

SEQ ID NO: 2229 - DNA, 417 bp, Streptococcus pneumoniae
atgcaaattgaatttttcaattttctaagaagtgtcgtacagactgaagatggtttggttttgtacgctctagcactgattgtctcaatggaaatcattgattttgtgacagggacgattgcggcgattatcaatcctgacatcgagtacaagagcaaaatcggcattaacgggctccttcgtaagatttcaggggttctcttactgatgatcctcattccggcgtccgttttgttgcctgaaaagacaggttttgtattcttgcactcaatctatctcgggtacatcgcatttacttttcaatctctcattgaaaattatcgcaaattaaaaggaaatgttactctttttcagccgattgtaaaagtatttcagcgattacttgaaaaagatgatgacacgaaaaaaggagaataa

SEQ ID NO: 2230 - DNA, 351 bp, Streptococcus pneumoniae
atggcagaaacaaatcaaaacacagataacttactagaccttacaaaaatcacagaaccatttgagcttgcgagcgctttgcgctacatgaaagaaaatggagagttcattcgttgcaagaatgtaagcgatgacttctatatgtatcgtgacgttcaaaaacgtcctgtgatcgtaaatggccgtcgccaattcaaggatgttgaaaccgtttgggcgttcaaccagtggggtggtacaatcgcaacaatcaacgtagccgttctgttgaatcatgaattctatatcatgaaatttgatgcagagggcaatcctgactggacggttccaacggtagaacctaaagaatag

SEQ ID NO: 2231 - DNA, 204 bp, Streptococcus pneumoniae
atgaacacagaacagcttaaccaagccttacaaatgacaattagtgaaatgtcaacaacttcaacaaattcgatgattacaagtaatatcttgagtattcagttgaatgagcaaagggaagagaatcaaagacttcaagcacgagtggatgagctggaagctctgcttgatgaacaaactaaaccagcagacaaaggagaatag

SEQ ID NO: 2232 - DNA, 6360 bp, Streptococcus pneumoniae
atggacgctttaactagacgacaatttgacagagccatgtttgccaaggaaaggacgctggctattcgtgttggtgaatatgcttcacgggatatcaaagaggctagttttgagtatggctacatcaagggcgatacttataagcctggtggaacctgcgctggtagcggtaaaattacctttaccagtatcattaccacgttcaataagctggataccctgcaccctgagattggtctactggttggggatacctaccagtgggtcaagatgggggaatacttcatcaacgatattgagattgaccgaaaccgcaacacaaccacacttgaacttatggacggtatgtttaagctcaatcgtgagtacgtgacggatttgcatttcccagctgaagtacgagaggttattcaggaaatctgcctgaaaacaggcattgagttagcgaatgactatttcggaatcagcgctatgcgttaccatatcgagcaagttcctgaaggtaagaaactttcgttcagggatatgctgagcgctatgactcagatgattgggatgtcttgcttcttcaaccgagaaggaaagatggaaatccgtgatttgaccgagtccaacatcacgattaacgctgacagttacttcttgcatggattgaccaagagtgaaatcgagtatcagatagctggtatcacttgtaagacggataagaagtctctgacggtcggtatgacaacaggtcggtctttggaacttgataatgtcttcataacccagagcgctttaaatgacttgtattacaaactgaaaaacctaacttactatccgtataatctcaactaccaaggacatttgttacttgaggttgggcagtgggtaaccattcagaccaacaagaaagagacttttaaagttcctgtcttaagtcagagctttatctttaaaggtggtctgagaggtcgtatcagtgcagatagtaaggctggaaacgatacccagtattcttacgagggtacgattaccaagcagattaagcaacaagatggctttgaagcgaaaatccaagcgcagattgaagcagcagataaagattttgaccaaaaggtcgacaaaatcaaaaaagactttaacgatcaagtagaactggccaaagccagagctgaagaagtcaagagagaactgtctgacactatcaatcagcgctttaatagctttgacaacgggccattgaaagaagctaagcgcaaggctgaggaagctttgcgaaatgctggcgcaagtagttctcttgctcaggaatccaagcggattgggctggattctgttgctagacttgaagcgtttaagtcgcagactacgagcgcacaaacggctctgtcgggtgacttggatgttctaaaacgaactatcgcaaacgatattcgaccgaagcaagcacaggctgaagctgagattgccaagcaagttgaagcacttagccggactaaaaatgaactggatggcgcaagtaccctgcttgcacaggaagctaagcggattgagctggattctgttgctagacttgaagcgtttaagtcgcagactacgagcgcacaaacggctctgtcaggtgacttggatgttctaaaacgaactatcgcaaacgatattcgaccgaagcaagcacaggctgaagctgagattgccaagcaagttgaagcacttagccggactaaaaatgaactggctggcgtgaagtcagcgcaagcgacgtatgaggagacgacgactcgtagactgtcagaactgaccaacttggccaatggtaaagccagcaagtcagaactcacgcaaacagctgaggagctggctagtcggattgcgagtgtgcaggcaggtagttcacggaattacttcagaaattcacgttcaagaacgttcacaacaggaggtcaagcggtatacgactatcgaacattcatagttcctgatttctggaagaacagtgacaggttcaagcgtgattatgttcgcatatcttttgatgtgactttccctgtcgccctagtaaatgacatgcctgctatggtgcattttagtgctcatccatggtatgcctacagaaacttaatttttaaaggtggaactgtcgaacgccaacattttgagtttacgattgacttgtctagttcttctgagacctatcagactaataatgtgttcattcgttttggcactaattatggatttcctgctggtctgcaggtcgtcattgagaacgctatgttatcggttggtaattattttccagcctatcaaccagcgtacgaagaccaagacgaacgtgtctcagcggtcgaatccaactttaaacagcgtgctgattcacttgacgctggtgtaagccgtctgactgaaggccttagaaccaaagtggatatcagctcactcaatgtgactgctgaaaatatccggcaatctgtgaagagtcttgagacagacacgcagaacaaactaaatcagaagttgagtcaggctgaatttgaggtgcgagctggctctatccgtcaggaaatcctgaacgcaaccaaagataaagccagcaagtcagaactcacgcagacagctgaggagctagctagtaagatagcgagtgtgcacttagggcgcagaaatctgctgaaaggcacaaaagagcttgcgagatacaagccggttagtgaatataatggttttaaagttatcagaacagtcgcaggagcaactagatatcaggatagctatgtggaaagaaccgttataccaacggctgggacagagtatatagctatcttttatgcacgagccagtgaaaatgactatcctgtgcgctgtcatttttacaatcctaacacggttgtatcatcagaaaacagcagcggatataagtcaaggtcgtcagatggcttgtctattatccgtctctcgacagactggcagttgtgctgggttaaatggacccaaaccgcaacagatcaagccaagacggtcatcattggccgccatggccctcaagtaggcggtaaagagggggtatgggttgaaatctgcgcccctgccatttttgagggaaatcttgcaggtgactggtcaccagcatacgaagaccaagacgaacgtgtctcagtagtcgaatccaactttaagcagcgtgctgattcacttgacgctggtgtaagccgtctgactgaaggccttagaaccaaagccgatatcagctcactcaatgtgactgctgaaaatatccggcaatctgtgaagagtcttgagacagacacgcagaacaaactaaatcagaagttgagtcaggctgaatttgaggtgcgagctggctctatccgtcaggaaatcctgaacgcaaccaaggataaagcagataagactcttgtcgtgactgaagctgggaaattgcgagaagaattttcaaaaatgaaggtgggaggccggaatctatggataaaatccaagacggttggagctgtaattgaaaaattacctgaaaaccacgtcacaggtcaaaaagaatgctataggctagagaacaactctactttaacgttcaaccttgaaccagatttcagctcaaggttgtaccaaaaagttacttttagcgcttggatcaagtacgaaaatgtagtccaaggtcgaaatttttggaatgtatttaattgcttcaaacattatctttttagaaaaaatagtgagaccggagtacagagtggtccagattatgctacgcttggtatgtataaaggttcggcagattggaaatatattacattcacttatgactactctgaaaaaacaaattttgatcaattgaagacatcattgcgattcaatcttgaaggtgctacaagcggtacagcttgggtaacaggaatcaaggttgaaatcggtagtgtggcgacggactggaatcctgcgcctgaggacgctgatggtctcatcactgaggctaaggctacctttgagcggacagctcagggcttgcgaaccgacttatcagctattcaggaatatgtaaataaagacggtcagcgacaggaagccctacagcgctatactcgtgaggagagcgcgagacaagcgacagcagtccgtgagctggtcaatcgtgatttcgttggtaaggctacttatcaagaagatgttaagggtatcaatcagaggattgaagctgttaaaactagtgcgaataaagacatcgctagtcaaatcgctagctatcgtcaatctgtagatggtaagttcacggatatttcaagtcagataactacttataagcaagatgtgggcggtcaaatcagtggtctatcaaatagacttacaagcagtgagcaaggaaccactactcagatttcaaatctttcaaatcggataaacagtaataaacaaggcacagataatcagatttcaaatttaaagactcaggtcgctacaaacaaggataatgctgaacgacaaatgggtagaatatctgatcaggtttctgcaaacaaagcgaatgctgatagtcaatttgcgaatgtgaccaatcaactagcgcgaaaagtagagactactgacttccagcgtgttaaggaaaccagtaaactttacgagcggattttgggcaatactgaaaatggaattgcggataaggttgctcgcatggctctgactaatcaactgtttcaggttgaggttgggaaatatagtgtaagcggccctaacctcattaagaatagtgattttaaaaatgctacgaatgaatggggctcaactcaaaatttaggaagattggttaagcatagcttttatcacaacgggcagaaagaccttatgcgtttaagtaatgcaactaaaaacgaaaactttttgtatagtcaccgttttaatcttgaacgaaatactgactatgtactgaattttagaggatttaacaacagtgctctcgcaagctatgatgtttatattttgggacgaagagcaggcgagagcgatggattcacaatcgttaagaaagttgttagcagcaagaaactatctacctctagatgcgaagatgtctcagtaacttttaattccggagaaatggataatgcttacattcgttttgataacaatggctcatcatcaggaacagctgatttgtatattacagaagttgacttgtacaaaggttataaacctagaacatggcaaccacatccagaagatgcagtcgcagatgcgaataagaagcttgaagcaacgcaaacaaaaatgactcaactagctggctcatgggtagttgaaaacatcaactcggctggagatatcatctctggaatcaatcttggcgccaatggacataaccgcttagttgggaaattgacccacatcactggagagaccctgattgacagagcagtcatcaagtctgccatggttgataagctcaaaacggccaattttgaagctggttcggtcacgactacgatattagaagctgaagcggtaactgctgagaagttgaaagttgacaatgcgcttattaaaaaattaactgcaactgatgcttttattgaccaactgatatctaaacgtatcttctctactaaggttgagtccgtcatttctagctcaaccttcctagaagcctatcaaggccgaatcggtggattcacacttggtcaatttgaccagggtggcggtcgctggatttcaggtgtcaatcagttctctgttggtatggggaatggtgccgggtatggagtccggacagccttctgggcgaactggggaaataattggaactatgccggacctaaagcatggaacgtcaatactgatgggaaaatgtactgtaggaatgaagtcggtttttatgatcaagtggatttttcgaattcatcgagagcaaacttctatgggaatactactttttctcgttctcctgtgttttcaaatggtatcgaacttggaagtaaagatgtgcttggtgatggttggaatcccaaaggcggaaggaatgcggttgtttggtggaatcaggtcggtagcggtagcttgaagtattggatggaacaaaaatcagatagacgcttaaaagagaacatcacagatacagctgtgaaagccttggacaaaatcaacagattaagaatggttgcatttgatttcatcgaaaataagaaacatgaggagattggtctaatagctcaagaggctgaaaccatcgttccaaaaattgtctcacgagatcctgagaatccagatggctatctgcatatcgactataccgctttagttccttacttaatcaaggctattcaagaattaaatcaaaaaatagaaaaaatggagaaaacaatagcatga

SEQ ID NO: 2233 - DNA, 237 bp, Streptococcus pneumoniae
ttgatcaaaatttgttttttcagagtagtcataagtgaatgtaatatatttccaatctgccgaacctttatacataccaagcgtagcataatctggaccactctgtactccggtctcactattttttctaaaaagataatgtttgaagcaattaaatacattccaaaaatttcgaccttggactacattttcgtacttgatccaagcgctaaaagtaactttttggtacaaccttga

SEQ ID NO: 2234 - DNA, 351 bp, Streptococcus pneumoniae
atggcacaattgacaatcaatggggtggctgtgaagcctcccaaatcttttcaagtcggtattcaagatatcgatggagagacagggcgtaatgccaatggcgacatggtgcgtgaccgtatcacgaccaaacgcaaactagactgtgaatggggtatgatgactcagggagaaataagtcagcttttacatgctgtatcatctaaattttttgaggtatcttatccagaccccatggatggccaagtcacaaagactttctatgtcggtgataggacagctcctagctatacctttactgagaagcttaaaccttggtctggcgctaaatttaatctggtagagaggtaa

SEQ ID NO: 2235 - DNA, 3654 bp, Streptococcus pneumoniae
atggcaactcttgatgaattgaaagtcatgattgacgctgagatagcgcctttcaggaagaagatgaaagaagtcgagaatcaggtcaaaggaacatctgaccaagtgaaaaatgctactgccaaagttcgtgaacagtcgagctcaatcggtagtgcgtttggcaagctggctaagttcgctggttttgcaatccttggtaagaaattacttgatgttgggatgtattcaacgcagacggctcttgaagtatcagcgtctatgaaccaaatcaagcgacagatgggcgagagttcgcaatctttcttaaaatgggttaacgataatgccaacgctatgaatatgggtgtgggtgaggctaccaactacggtgcagtctactcaaacttattttctggatttatcaaagataccaacaagctaagcgcctataccgctaagatgttgcagacatcggcagttgttgctgaaggttcagggcgcacgattacagacgttatggagcggattcgctcaggtttactagggaacaccgaagcgattgaggacctaggaatcaacgtcaacgtggctatgattgagtccactgaagcctttaagaagttcgcaaacggacagagctggcaacagttggattaccaaacccagcaacaaatccgccttatggctattctggaacaggctacagccaagtatggggataccttgtctaattctgtaaatggtcgtatcagcctatttaagtcgctgatgaaggacgcagcattgaaccttggtaactctatgttaccgattatcaatgccattatgcctgtcttgaactcttttgctatggtcttaaagaacgttactgctaaactcgctgagtttatcgctttgatgttcaacaagaaagcaacagtgaaagatggtgttggtggagcagttggagacatgggtaacgccatgaaggatgctgcaggcggagcaggagaccttgctgacgcagtagacgacgctggagattcagcaggaggacttgctgacaatcttggagactccgccaaaaacgctaagaaggccgctaaagagttgctaggtcttttgggatttgatgagattaacatcttgcaaaaaccaaaagatgacgacgcaggcgggtctggaggcggtggcaaaggtggtaaaggaaagggaggcggtggcggacctttcaaagacatcttgccagaagtcgagttgaccgacatggacaacaaattcaagagcatttttgatggtcttggagataagctcaaagggttgtttgacctcttcaagaaaggttttgatgcagcatttagaccagaaggtatagaacgcattaagactgccttagaccaaatagctaagacaatgggagaaatcgccactgacccaagggttgtgaatgcctttaaccgaatggctgagaaaattgcttatgctttagggcaagtgacaggctcaataacaactatcgggctaggtatcggtgttttccttgccgaaagtattgcaaatggccttggaaggcaaaaagaacgcattaccagggcgctagtcgctttgtttgataatattggtaacatttccgaggcagtaggaaacatcgctcaggacttttctagtactttctacgacgtcattacctcaactggtgcggttcgtatcggtagcgctattgtgtcaactctgttgagtttgacatctaccattgttgaagttggtagtaaattagcaggaagtttgtttaaaggttttgaaaaagtcgttgtgacaagcgctcctaaaatttcatcagtcttccaaagtttattagatactgttgcgcctgtatttgagagcattgaaaggtctgttaacaaatttggcgatggcttaagtcgtgtttatgatgaacatgtagcccctgctattaactctattgctaatgcttttaacggactgattgatatcatacaaatcctctgggagaattcttggcaaccttttgctgagtttttatcaggagtattcggtgttagtattgaaggaatttcagatttattaggaggtggccttttagccactttgggactattggcggatgctattaagttagtggcagatggtttcaccgttttttctgactggtgtaaagaaaacaaagaacctatcttggctttgataacaacttggcaaacgattaatttcttatcatgggctgaacaagccgggggacttgcaggagcattcagcttgttaggtagtaaggtctctttgattgttggagggattaagaatctaggtcttgctattaaagcattgacatttgataagttggtcagttttggtgaaacaatctatttgaacaccttatatgcaaaagattttgtggtcaattcaggtaaaacaattgcacagctaggaaaaactgctttagaacttggtaaatcagctctagcatggactgctcatgcagcgaaaatgggattagcaaccgcggcggaatttgcacattctgttgcagcaggagtcgctacagctgcaacatgggcttttaatgcagcgttagcagttttgacaagtccaataacatggattattgcagcaatcgcagctttgattgctatcggtgtcttgctctaccaaaactgggacactgttgttgagtttgctaaaactgcatggcaaggactatgtgattttattagtggtatttgtcgagctattggcgaatttttcagtggtctatggacaaaactacaagaaatctttgagccgataggtcaatggtttggcgagaagttccagcaagcatgggatgccattgtcaacatcttctctggtatcggagagtggttctctggtgtattccaaggtgcatgggacgctatcgttaatatcttcactccaatcggctcatggtttggacaacgttgggcagatgtgactagtgctttggctaatatcggggcatggtttactgacatattccaaaaagcatggactggtctaacaaacatctttagcaaactaggtttatggtttggcgagagatgggcagatgttacaagtgttcttgcgaatgtatcttcttggtttgggaatatgtttactagtgcttataatgcagtcaagaacgcgtttagttcaattggtggcttcttcagcggtgtatggtcaacggttcaaagcatatttgtcaatgctggacaaaaggttggtagcgctgtaggtggagcgtttaagagtgcggtcaatgcggttcttggaacgattgaaaatgtagtcaatgacttcatcggaatgattaatggagttttaggcgttgtcagaaacttacctggtctaggatgggttggtagtgtaagcacagttagcctccctcgtcttgcccgtggtggtatcgtcgatagtccaacaatcgccatgattggtgaagctggtaaagaggcggtcgtaccacttgaaaatacaggatttatccaaacacttggacgagtagtcagcagtgcggtagtaaatgccatggctggtattagtccacaaggtggtttttctagcgacggcgacatcgttattcaaatcgcaggccatgagttcggacgggtagctatccaagaaatcaacaaggaacatgaacgagcaggtcaaaccttgctcaagatttag

SEQ ID NO: 2236 - DNA, 561 bp, Streptococcus pneumoniae
ttgaaaggtccgccaccgcctccctttcctttaccacctttgccaccgcctccagacccgcctgcgtcgtcatcttttggtttttgcaagatgttaatctcatcaaatcccaaaagacctagcaactctttagcggccttcttagcgtttttggcggagtctccaagattgtcagcaagtcctcctgctgaatctccagcgtcgtctactgcgtcagcaaggtctcctgctccgcctgcagcatccttcatggcgttacccatgtctccaactgctccaccaacaccatctttcactgttgctttcttgttgaacatcaaagcgataaactcagcgagtttagcagtaacgttctttaagaccatagcaaaagagttcaagacaggcataatggcattgataatcggtaacatagagttaccaaggttcaatgctgcgtccttcatcagcgacttaaataggctgatacgaccatttacagaattagacaaggtatccccatacttggctgtagcctgttccagaatagccataaggcggatttgttgctgggtttggtaa

SEQ ID NO: 2237 - DNA, 210 bp, Streptococcus pneumoniae
atgatatccaaccacgtgtctttattgttatccaaagatgccaaggcctttgagttctgggaatatgcgcctgagttgtttgtagaagaacaacaagcagtagaacaggaacgacagaaacaagcacttttgttgcataaggaacggatgcgtgaatttgcagagagacataatcgaaaaaggaaggaggaagtaaatggcaactcttga

SEQ ID NO: 2238 - DNA, 219 bp, Streptococcus pneumoniae
agtatcgggttttactccacgaggaagcaaggacaagaaaacttccaagaagaaaatgacagtagacaagtaatcttaacggtaactcagattattgagaggctttatcctatgtttttggacatcgagggcaagcctcttgatttttgggatttgacggtacttgaaatcagagaaatgattgaaagctataaccgtgtcaaaatccaagagcggtaa

SEQ ID NO: 2239 - DNA, 381 bp, Streptococcus pneumoniae
atggcgttaaaatacacaacttggaaagttactgacgaaaaagagttgaagctacgtttgacatctcatcaaactgcaactgtggaagaaaaaatcggcatgaacttgctgaagattttcatgcctgaagctggcgaagagttcactttaccgcctttgaaagttatgttgttgttagttcacggagccttgcagcagtatgaacatgggtattctcttgaggatgtctatgatttatacgatgaatacgtggacaatggcggagaccaaacaaccttcatgacagaggtgttgatgccactctttgaagtatcgggttttactccacgaggaagcaaggacaagaaaacttccaagaagaaaatgacagtagacaagtaa

SEQ ID NO: 2240 - DNA, 414 bp, Streptococcus pneumoniae
atgttagcaaatggaattacgctttcttatggcgaaacaaaagatagctatactaaacttgttggattgaaagaagtaccagagtttggtattgaactcgaaaaagtagaaaatactactcttgaagatacggtgaagaagtacgagtttggtattggggacataggagaacttgagtacaagttctcttataataattcaagcgcaactgctccttatcgtgtattgcgtaaggcagcagacgacaagaagaaactctactttgaacaagcttatccagacggtactaaggtcatttttgaaggccaagtatctgttaagcttggcggtggcggtgtcaatgccgttatcgatttcacacttaagattgccttgcagtctaatcttacatttactgatggtattggaggttaa

SEQ ID NO: 2241 - DNA, 369 bp, Streptococcus pneumoniae
atgattaatatcaagcctgttatttataaagaattgcaaaaggttgcagataatgtgaccgatacttatcctagcgattgggagactttcccagtcgttatttttttggaagaacaaaacaagccgggtgattggtttgatgaccaggaacaaaaatcctctatccgctacaaggtggatatctttgatgatactagcactagtgagttagctgttaaaatcaatcagatttttgagtctttaggtttgcgaagaactgactgccaagacgtgccagacccgtctcatttgagacataaggtcatgcgttttgaaggtatcgtcgacttacactcagagcttgtttttcaatttagaatggagaattaa

SEQ ID NO: 2242 - DNA, 516 bp, Streptococcus pneumoniae
gtgtcagggctactaggggcagataggcttatagctaaatgtagacgattggctagtaaaaaaactggcgaggatatcgtcttacgtgcggtgcacaatgctactataaaggttgtccaagcagatgcaagaagactcgcaccagcgagagatggagagcttataactagtatcaaaactagggcaaaaatggacggagataaggctataggcgaagtttacaccaaccttaaatacgctccttatgttgagtttggaacgggaccaataggacaagctagccattctggtatttctccagaggtcagcgtgacttacaagtctagtccgtggtatgtacatgaagaccaaatcaatgtaggaccgtaccactttcaaaaaatcggggagttctacaagatgtatggtcaacctgcccagccttatctttatccagctttgagagacaatcaagagcgtgtgtctaagaatatttcgaattatgtccgtagaaagataagagaacaaataaaatga

SEQ ID NO: 2243 - DNA, 183 bp, Streptococcus pneumoniae
ttgatactagttataagctctccatctctcgctggtgcgagtcttcttgcatctgcttggacaacctttatagtagcattgtgcaccgcacgtaagacgatatcctcgccagtttttttactagccaatcgtctacatttagctataagcctatctgcccctagtagccctgacacgctctaa

SEQ ID NO: 2244 - DNA, 339 bp, Streptococcus pneumoniae
atgtttttgaagcagagtagactgaaaccttatccaatgcgacggtttgaaaagactgtcactgaggaaggtgtcgcgaaagaagggtatgccaaggaagctgagacagtccgccttgaattgtggccagctagtagcaagctacaatctgaattgtatggcgagcgtgtcaatgatattttgaacgcaaatgccaacaagtcagctactatcaaagtaaaagatggtgtgtgtatcgatagtcagacggaagtgactcatagggttatttctaaaaaggtctacacacatcatcaagttttggagttagagcgtgtcagggctactaggggcagatag

SEQ ID NO: 2245 - DNA, 312 bp, Streptococcus pneumoniae
atgtctatagagttgctgaagaaattaacaggcgaagaagatactcagcttctcatgttgctccaaacgagggctacaaatcttatcttgtcagagactaatcgcacatctttgacacctgctttaagtcttttaatacctgaggttgctatcgaactccacaaccgctcaggagcggaaggagagcattctagaaccgagggtggtatagcagtagtctacggagaaaacggcctgtctacggatcttctacagcgaatacgcatgcacaggctagcaagggtggcaggtcatgtttttgaagcagagtag

SEQ ID NO: 2246 - DNA, 189 bp, Streptococcus pneumoniae
gtgaaatttaaaatcaaacaagatttctatgattgggaatcaaatgtgaaacgactggcaggagaggaacttgagattactgaggagcgctatgctgagctggctgacaatattgccagcaacggtgtcactatctcagacgttcttgagaaaatcctccctgaacctgagttcttagaagaggattga

SEQ ID NO: 2247 - DNA, 183 bp, Streptococcus pneumoniae
atgagtttattgctacgacgtcattatattcaagaagagcaggttaaccagtattctgatttagagaataaaactctagaagagttgaaggatctagcgaaagaagcaggtgtagcaggcgcttataagttgacaaaagccgaaattgtagaagttttggaggaactaaaaagtgaaatttaa

SEQ ID NO: 2248 - DNA, 846 bp, Streptococcus pneumoniae
atgacagcaggacaaactaaattagccactatggttaatccagaagtaatggcggatatggtagccgctaaattacctaaattgattaaatttacaccgctagcgtatgtagagacaaagcttgaaggtcaaccaggtagcactttaacagtgccagcatgggagtatgcaggagacgctactgaaattgaagaaggccaagcaattacgccagaccaattgactactaaaaagactactatgaccatcaaaaaagcaggtaaaggttatgaaattaccgatgagtctcttttgtcaggtcttggtgacccactaggtcaagcgacttaccagcttggtttagctattgccaacaagatcgataatgatttggtagcggtagctaaaactgcaacacaacatattacagaaactccaacaactcttgaggcaatcgataaagctctagatatctttgaggacgaagaagatgcacagtatgttgctatcatcaaccctaaagatgctactaagctaaaaactgcagtagcaaaagaatggattaaaggttcagagcttggagcaaatatggttgtttctggaaccttcggtgaagttgatggtgtgcaaatcgtgcgctctaaaaaagttgatgaaggtaaaggcttccttgttaaagtgtcaccaagtcaaactcagacagacgacgctaacaaatatggagcttttgttatcttgcttaaacgtgatgtggctatcgaaacagaccgcgatatcttgaagaagactaccgtaatcacaggtgatgaacactacggcgtttacctttacgaccctacacgagttgtaaaattcggtggcgcgtaa

SEQ ID NO: 2249 - DNA, 585 bp, Streptococcus pneumoniae
atgtcagaagaaatcaatgcaactgtatctactgaatcaactgagactgtcgacactcaaggaaatgttgattcagtgcaggaagaaaagcacgaacgaactttcactcgtgctgaaatcggtaagatgctatctgccgaacgctctaaatgggaagctgagcaagaagccaaggaaaacgaagctaagaaacttgccaagatgaacgctgacgagaaacaaaaatatcagttggatcagcgtgagcaagaactagctgaccgtgagaaggctattgctcgcaaggaattgaccgcagaagctaaagcaatgctaagtgaacgtgacttacctgttgagttagtaaatgtagttgatttgacaagcgcagagacggtatcgcagtctgtcgctgtattgcagaaatcatgggagcaagccgtgcaaaaaggcgttcaagaaaaactaaaaggcggagctccaatgaaacaagcgccagtcgatagtgacggtatcacaaaagaagaatttgctcgtatgggttatcagagtcgaaatgagctctatcaaaagaacccagagctttataagaaattgaaaggataa

SEQ ID NO: 2250 - DNA, 258 bp, Streptococcus pneumoniae
ttgcgatactatccttatagaagcctaaaagaaaggaacagaaaaatggaagaatggaaagaaagatttaaaaaagaatactacgaattgaaagaacgattccagaagttagatatgatgattgggaaatacgaaaaagggcaactagagtttgaatctaaatgtccgattgattcgttaaaaggtcagcgttcaaccatgtggaattatttaagaattctagaacaacgtgcaaaaattgaagaaattaaactataa

SEQ ID NO: 2251 - DNA, 228 bp, Streptococcus pneumoniae
atggcgatattagatgatttacaagcgttatatgataatggatgggacgcttcttttaattataatggtcaagtatgtggcattttccctaattctatttatgatgttgttgttattattgcggacgacgaatatagagcatcttcttttgacgatttgatttctttacagattgaagggaaaactttaccggaaatcatgaacgaagttgaagtacaatatggctaa

SEQ ID NO: 2252 - DNA, 1404 bp, Streptococcus pneumoniae
atgaagaatcaggagtattgggcgaagaggaaagccaatctgatttaccagcagatggacaaggccgaaaagcaggcagaccagttcgataaggtctatcaggaagctaagacttacttggataaggaaatcaataagattttcgataaattccaacgtgattatggtctaagtcaggtagaagctagacaagtcttgaagaacatgaaagacaagaaaaatctgaatgaacttcgtaaagtacttgaagcgagaccgaatgacccgaacatccaaagattactagctgacttagacagcccagcttattctttccgcatgaagcgcctagagcgtttgagcgacgatttagatcgtatgcgtgaatctatctatcattcggagaagacaggctcagatgccttttatagcgacctgatgaaggatagttactacaaggctacctttgacctacaacagcagacaggactagcatatggcttttctgggcttcctgagaacgagattaaacatctacagtcttttagttgggtaggagatggaagtacgtactcaacagacatctggaagaatacaggaaaacttacttccagcataaaagatgaactcctcattagcctcatgacaggcagagatacacgagaaactgcacaagcaattgctgagaggttcaatgtaggtcagaacgatgcaaggcgtttggttcgaacagaatccgccttttttcataaccagatggagctactcagctatgaagaagcagacatagaaaagtatatctttgtggccgtcttagacaagcgtacatcacgcatttgtcaggagcatgacaatcaggtctatgatagggataaggctgtccctggtgtcaattgtccgcctatgcacccttggtgtaggtctactactgtcggatacgatgaggacgcagactacagcaagttgaagcgcagagcaaggaatccagagacaggtaaagttgagtacgtgcctgccgatatgacttataaagagtggtatagcaagtatgtggatggtaatagagagtctataaaacgtaaagcgtttgataaaactattaaagatggtataatagtaagtgtatcagggactacaattggacacactccgcctggcaaaataggtttgcctaatagtgtagttcagcataatgctacaaacggagatgtccttggtagaacttactatgatgctagaggttttaaaacgaaagatgttcattttacaaaccataaacaaccggcacgtcatccttatggaaaaatcggagaacatgctcatgattttgtatttgatgatgaaggtaagttcgttagtaggagtactagggaattaacagacgatgaaagaaaggagaatcaagatatattatggcgatattag

SEQ ID NO: 2253 - DNA, 1470 bp, Streptococcus pneumoniae
atgtaccaatatttaacctatccacgggatggatatgatgagggttctttgaagaaagacctgatttacaaattgataacgatacataacactgaaagctcacgcttgaagaatttaaaaagctactacatgggtgatcatgctattttaaatcacaagagacgcaacgtgaacgcacccaattacaagacggtagctaatcatgccaaggatatcgcagacacggctacgggctattttatgggcaatcctatcaagtataacaatactgctgacggtgatattgatgaactacttacagcctttgatggtgctgagattgaccaagtggatgcgcagaacgcactaaatatggctatctacggccgtgcttacgagtacatctatgctaaagagggtatgactgagttggattcaactagtattgatccggagaatactttcatggtctacgatgatagtattgagcggaagcctttgtttgcggtctattactatgaagtaaaagacgatacgaaagacactaccaagcaccaggctgaggtctttaccgaaaatctgcactatcacatggtgctgagaagtacagattcaggaacaactcagagcgaggaggcaacacctcacaaccttggtcaaatcccaattatcgagtatcgcaataatcactttgcgattggcgactacgagcaacaaattagcttgatagacgcttataattccttgatggggaatcgtgtcaatgataaggaacaggctgtagagtctatccttgtcttgtatggcacgcagttagcagacactccagaagacgctaaggtagcaatgaagattctttctgaagaaggtcttttggaattgccgggcgatagtgcaagggctgagttcttgaagaatacgctggacgaaagtgctactgaaatcttgcgtacagctcttaaagaggacatctacacatttagccatgtgcctaatttgactgatgagaatttcgcagggaatacatcaggcgtagccatggaatttaagctgatgggccttgagatgattactaagaccaaggaagcgaactataagcgaggattgcgtcagcgtattgcgatttttgctcattacttaggcatgaagcagattgctttagagtctcattcaatcgttccacaattcagtcgtggtttgcctaagaacttattagaaatctctcagattgtgaacaatttggaaggcaaagtgaccaatagacagcttatttctctcttgccgtttgtggaagaccctgacgctgagctggaagccttggaagaagagaaaaagaagaacatggaagacatgccgatgttcaacaaagacaacacgaaacccgaagacgaggtagaggatgaagaatcaggagtattgggcgaagaggaaagccaatctgatttaccagcagatggacaaggccgaaaagcaggcagaccagttcgataa

SEQ ID NO: 2254 - DNA, 1299 bp, Streptococcus pneumoniae
atgagtcagacatatcagattaaacaaaacgatattgtcgttgacttacctaagacagtaggagctggatacggacagttctggcgctcaagaagtctttatcgtgtagtcaaagggtcccgtggttcgaagaagtccaagacaaccgctttgaattatgttatccgtcttttgaagtatccctgggccaacttgcttgttattcgtagatactcgaataccaacaagcaatcaacttatacggattttaaatgggcgtgtaatgtgttgggtgtgactcatttgtttaaatttaacgagtctttgcctgaaataaccataaaagcgactggtcaaaaaatcctattccgtggtttggatgatgaactcaaaattacatctattacagtcgatatcggtagtctgtgttgggcatggttcgaggaagcatatcaaattgagactgaagacaagttcagcacggttgttgagtctatccgtggtagcttagatgtacctgatttctttaaacaaatcacagtcacatttaacccgtggaatgagaggcattggctcaagcgtgtattcttcgatgaagagacgagacgggctgacacattcgctactacaaccacttataaatgcaatgagtggcttgatgaagtcgatatcaaacgctatgaggatttgtatcatacgaaccccagacgtgctagaatcgtttgtgatggcgaatggggagttgctgaaggtttaatctacgaaaacgtgactgtcaaggatttcaataaagatgaattactacaagattcagctaataaattatgtatcggtcttgactttggttttactcatgatccaactgctttgtgttgttcgttgataaatgacacgacgaaagagatttatgtctttgatgaggcgtataaagtcggattgataaccaaagaagttgcgaagatgataaaagacaaaggttatcatcgctcacaaatcattgctgatagcgcagagtcacggctgattgaagagctcaggtcagaacatggcatatctagaataaaagagagtcggaaaggtaaggatagtattatggcaggcgtatccaaattgcaaggatacgctatttatgtgcatccagattgtaaaaacatcatggatgaattttatagttactgctaccagcgagataaagaaggcaactggttgaataaaccagaggataaaaacaaccacttgatggacgctttgcgttacagccttcaatgtatcgaaggtggaaaagcaaccgtccgcagacgttctgattatggtctatag

SEQ ID NO: 2255 - DNA, 480 bp, Streptococcus pneumoniae
gtggctttttttgattattcgaagggtggtgatggaaaattgagtggattgagaataaaacaaaagagatttgcagatgagtacatcatctcaggtaatgcgacggaagcctataagaaagcaggttatcgtgtttctagtgatagagtggcaggcgttgaaggacataagttactaaagaatcctaagattaaaagctatatagatgaacgactgaaacagcttgattctgaaaagattgcggatcagcaagaggtcttaggttatctaacttcagtcatgcgaggagagacgcaagaacagaccttgataagcattggagaactagggcagacgattacggatatagatgtaggagctaaagatagaatcaaggcggctgaacttcttggtaaacggcataggctttggacggataaggtagaggcggatgtttctggaacggtggtgtttgcaaatgagtcagacatatcagattaa

SEQ ID NO: 2256 - DNA, 405 bp, Streptococcus pneumoniae
gtgaacaaggctaaagagctcttgaaagagttgcaggatctggacatggacatccaaagccgtatagacgaaattaacgagcttgaggcaggtttgctctcaagccctaaatggtccgaggttaaagtccaaggtggacagactagaaaagttgatgatgtctatactcagttggtagtgatgaaagaggctatagagcaggatactaaagaggtcattaacagaaaacttgaattaggtagaatgatcaataggcttaaaaatccaaagtacagggcagtattaagaatgacttacatcaacaaaggcaccgctgatagcgtttgttatgatttgaatatgagtcgtacaacctactacaggttaaaaaatgaggcggtcttagctttggaagaagttatctaa

SEQ ID NO: 2257 - DNA, 372 bp, Streptococcus pneumoniae
atgagaccttgtaaatatccatattcaggaagaagaaaaaaacaagaaacgccgtcgccaatattttctgcacgaccaatttttgacgaagttccaattgtagaagaagttaaggttgagttcggagttgaagctagtatggggcgcatatatccagaaacgttaatacatttagatatttctggatacggaaatagagtgcattcagtacatcgcttccccggtattttactgagtgttggtgagtcaatccaactaaagatgcttttctataaaagacttagaaattttactacagatcgtttcttgacgtttagagaatctgattggaagttctttatccgggacctggtcaacgaatttaagcattaa

SEQ ID NO: 2258 - DNA, 438 bp, Streptococcus pneumoniae
atgataccgaaatttagagtgtgggtaaaaataggaaaacgtatggttttttcagatgacattcttgctattgactacgaaaacaaagaaatagtgacacaacaagtttattttgagaatggtttaccagacgatagagatatctattgttatgattttgacgaaatcgaactcatgcaatcaacaggactcaaagacaagaacggcaaggaaatctttgaaggcgatattgtacgaactactagatttttgggtagagctgacgaaattggcggtttctatgagtatgacaaggaatttatagggattgttaagcagcttgagggttcttgggtaattgatacgggcagtgacgcagtatgtttatggactgaaattgaagaaaatgaaatcatcggcaacatctatgaaaataaggagtttggaggacgcaaatga

SEQ ID NO: 2259 - DNA, 459 bp, Streptococcus pneumoniae
atggatgatattttacaagctttagcaaaaatgctaaatatgactgttgatgaagtaagttctttgcttacaacatttaaagggaatgcaccacagatttatgaaatgttcgttaaagaaaagatgttttatgatctcttcagtctttttcaaatcatgtcaattgtaatatttagtatttctgcagtagttttagcagttttaactctcatatattttacatacgatggtggttttgtttattcctatgatatacgtacaggaaaaaccgaggaagaaattaaattagaacgcattgaacggaaaagaaaggacttaaaaataccactaaaaattagttgcatttcatcaagcgcaagtttgataacattagttattgcaattgttttaaaagcaactcttgcacctaattatatattcatcgtgaatgagattttaccaaaattaacgaagagatag

SEQ ID NO: 2260 - DNA, 261 bp, Streptococcus pneumoniae
ttgaaacgattcatagctatctggattctgctatctgctggattgaatatctggcagagtatctacattaaaaagttagaagaaaagcgccctattgtcgtctataaagctgataacgcaggcgctgagatattcggtaaagtcgtcgagaaaggacggcatggcaagctatacacgcttaccattcgtgactacggggtgttcgtggttacgaaggacgtgtatgagaaagtgaaagtaggggatgaggtgttactctaa

SEQ ID NO: 2261 - DNA, 696 bp, Streptococcus pneumoniae
atgaataagcaggaactgattaaacgtatcgaggatttgccttatacagaggggcctatcgcagatacaatcgaaattaatagaaattggatattgaaatcaattgaacagctagccgaatccgaaataggtcacgcagatgaagctccacgctacgtaaagaacatactagcacgattgcgagaattgccattgcatgatagagagttttggttaaaggctatcatgagcgaatttgaacaggattttagccatgcaaaatggcgagagggctacgagcaaggtaaaattgagggtatggttgaacgtgaaaaagtcatagttccgcagtgtgtggcggaatatatagaatttaaaaagaaaaacaattttcatgtttacggtgcaatgagagtaattgaagatcattatgataagaaagttcctgattggttttacgaaaataacatcgaaaaattctgtcttgcttggcttgacggctacgaggttgaaaaagagaagcggtattttgttaagattaaagggaatattaaagaaaatatgttggtttatggagaacttttgaaaaggtatttctttacaaaaagctttagtttagacgatgttatatattcccacacccgtaaagaactagaaaatgcaaaaatcggctgggtgtttgattgtgaagggtttgagattgaggaggtggagtga

SEQ ID NO: 2262 - DNA, 1350 bp, Streptococcus pneumoniae
gtgattgtgattggtaatgtagtaagtattgactcacaacctaagatgataacgactgccaagggagacatcaaggccaacagtccaagtaatgtgttgatgtctttcaaagctgatgatcagttgagtatttacctaaagcacaacgatttttcccaagagcatgaactccttaaagatatcaagatcggcaacactctttttaaaaaaggtgagctcccttctaactttgattcagtcgtaaaagtttactttgaaagtgtgttaggtgttgctttctctagccaggcgatgctggacggcatggaaacttttttctcagaacgttcttacaatccagtcattgagtatatggaaaaggctgctgaaaaatgggatggtcgtaaacgaattgaccgaatgcttcaggtttacctgggggctgaagatatccctttagtttctaaaatcgctcaaatgtggctagttggtgcagttgctaaagtttatgatccatacgttaagtttgactatgttctggatctagtcggtggacaaggagttgggaaaacatccctccttcaaaaattgggtggcgaatggtatacggatgccgtaacagatttctctaataaagataattacgacattatgttaaagagtctaatcgtcaacgacgacgaaatggtggccagtaatcggatgagctttgcagaaactaaggcctttatttctaaaactagcctacgttatcgtaaaccatacatgaaacgcacagaagagtttgccaaaaacttcattttagctagaactactaaccaaacagaatacctcaaggacaaaaccggtgaacgtcgttttctaccagttatggcagatagtaaacggcaaaaaaaacatccaatggaaatcgagccagagacaattgaacaaatctggggcgaagccgttacaatctatcgtgctggtgctgatttgatgtttgatgaaaatacagaggatgaactgaatatctaccgtgaacagttcatgtatcgtgatgaagttgaattacaagtgcttgaatatcttgatatgcccgtccctgaaaattggcaaaactggtctattcagcaacaacatcaatacacaagtaaatatttcgataatagtagcgactttgatcctggaagcaaaaaactagataaggtctcaactcgtgaaatgatgtacaacttatttatgagaaattcgaatgacaggaagctgtcaacgaagattaacatgatcatggataatcatcctgattggaaaaaaagtgttttccgggcaggaggtaaaagtacaaaagggttcgtaagagtgaaagattcggaaaaaactaatcggtag

SEQ ID NO: 2263 - DNA, 822 bp, Streptococcus pneumoniae
atgccgtcgatgaaagaatacgcattacagtaccaaaagttagggttctcagtcattccaatcaatcctaaaaacaagatgcctttaatcgaatttgctgataaaccagccatgactccatctgagattgaaaacttttgggacggctaccctaatgcaaacattgccctaaagactaccaacttctttgtcattgatattgacaaacacggcaaatcgaacggttttgaatcgctaaaaaaatggaaacatctaaatttaatcgaaccgacactgcaagctaagacggctagtggcggtaaacatctattctacttcaaacgagaagatgagccgatcactcagatgattggattcttgcctggtgttgatattaaggctcacgaaaataattatgtgttagtcgcaccctctgccacagataaagggcagtatgagtgggatctggaaaagtctaaggaaggtggcacgatggtcactccttcaaaatatttaatccagtctataaaaaaacagtatggcgaaactcacggttataagtatgatggtaaggacggtcttagggatttagttagacgttcacatactagagaccgaacacagactacagatctctttgaaaccatcgcccttggttttggtgatgaaggtggacgaaatgacaaactagcaaaattcgtaggtggtctcttatatcgtgcggtcgacgatggtgtagttgttcaacttgcaagattagcaaatgcaaatagtccaacccctttgcctgaaaaggaaatgatgcgtactattgaaagtatgattaaaaaagataggaggtga

SEQ ID NO: 2264 - DNA, 234 bp, Streptococcus pneumoniae
atggctggtttatcagcaaattcgattaaaggcatcttgtttttaggattgattggaatgactgagaaccctaacttttggtactgtaatgcgtattctttcatcgacggcatggttttttctcctctttgtaaatataaacaagttcctgggccgtatagtttgactgatattcatcttcagtcatttttaaataaaataacaacgattgataagcctcttcaaatgtattga

SEQ ID NO: 2265 - DNA, 198 bp, Streptococcus pneumoniae
cctccctttctaaaaaatagcaagttttgggtcattgatgaaactgatgaaagattaggaccattcaatacatttgaagaggcttatcaatcgttgttattttatttaaaaatgactgaagatgaatatcagtcaaactatacggcccaggaacttgtttatatttacaaagaggagaaaaaaccatgccgtcgatga

SEQ ID NO: 2266 - DNA, 507 bp, Streptococcus pneumoniae
atgagcttactagatatcgcaaaatcaatcaaaaaagagggctttgacccacgcaaagacagcgccaacggtcctgcaccaatcccagctggtacttatccagtagtcctgaagaaagcaaccttcaacgtatcggacaaaggctgggaaagccttggttatcaatttgaaatccgtggcggtgattacagtggacgctctgaatttgcaacatttggcacactgactgaatggaacggtaagaaccttgactgggcagttgaacgcactatgaaattctttatcaaagccttggtccttgctggcgacagtatgcaaggaaatgaagaagacggtaaagccttggaagaggctctacaacgtaaggcagttggctcttactacaaccttgttatctctgtgactaaggggaaagatggccgtgagttccgaaactatgaccttgaagaagaagaagcacaaccgctgactgaagctgatatcgatgaagatgacctccctttctaa

SEQ ID NO: 2267 - DNA, 828 bp, Streptococcus pneumoniae
atggcatttacacttccagcaaataaaccacaagttcctaaagataccccacgaaattttttcatctacggcgaaaccatgagcggaaagtcttatcttgcaaatgaattcccaaatccaatcgttttgaacacagacgggaatgcagaagctaacactgttccaagcattcagctgatcaatgaaaaagatgacaagggacgaattaccaattcagtaattaagcagcttggagatatcttgcttgctctccagacacagaagcactcttatgaaacagtcgttattgatgtaattgacgatgttattgaaatgattaagattgcagtttgtgatgaattaaccccagttggtaaacctcgcttgaaatccttgtcggaaattccatacggcaaaggatacgacttctttaaccaagctatcacagaattagtcattgacctcaaagcattgccaatgaatgttatttacatcagccgtcaggtatctgaatatgatgacaatggcaatgccaccaaagacaagccaagcttgaaagataagtatgtcaatcttatcaatggaaactctgatttgatgatccacactgaaaaactcggcaacaactacaaccgtgaggttgaccgcaagcgtaagacctattatgcggaccaggttgatgacaaggccatcttgaaaatcttggcaactatccgtggggctgttgagcctgcaaagggcaagctagcccctaaaaaagaagcagctaagacaactaaaccagctaagaccgaaaaaacaaaagaggcacctaagaaagaagttgactctgatgatgaactattttaa

SEQ ID NO: 2268 - DNA, 318 bp, Streptococcus pneumoniae
atgaataaaacaactgaaatgatcgtatttcgtagccgtaaaactggagaatttcttaattcttacaaggacagaagttctttagcatttgcagctgacttttgcagcttggaatattgtttgaagcttcctcgtaaaaaatacgaagacaacaaaaagacttacaaggctcttgctgcagcttttgactgtgaaattgtcgcagttgaagcggaatacaaattgacctatccgaatggatcagaagttgaacctatcaagcgtgaccgttcatcaattgaggacatgattaaggatattattggaggggttctctaa

SEQ ID NO: 2269 - DNA, 1194 bp, Streptococcus pneumoniae
gtgagtatcacaataacgctaagaaagtggcaagctgaagcgattaaaagaagtgaacatttatctaatggaatctttttagaggctcttgggggcagaggcaaaactatctgtgcacttgctattgcaaaacataaaaaagctaaaaaaatcatcatcacaaacaatcgactagctattctgaatggttggatagatgcagtcaagtttatgaattttgataaaggtgttgagattatcattcagacagatagatatcttcaaaatcaagtcaaaaaggggcataaattagattgtgatgtgctgatagtagacgaatggcagaatatgtcttctgacaaacaagtggccttatatcgcaaaataaagcgaaaatacacgataggtctttcagcgacaccaattcggaaaaaaggacaaaatttctatccgcttgaaaaaacggtatttggttgggcaaccccaaataataaatttgactggcaaaagactcatggaaaaatggtctatgatccatttagctattcaaaagagaagtgggaagattttcaaaattatgaaagttatatctcgagcttgcctaatttcttccgctgggaagagattgaaggaattgagaatgcagttgagaataacggttttgagattaagttttaccaaaagagagtcgcctctggcaatccagaaaaacttgcagaatttagaaaactaaatcttgtaacagtggacggcaaaactgcaatggccaagcaatcgtttggaagaaagacctttgaacgctaccttaatcaaacaggcgtagcagtcgattttccaaaattaaagccagtaaatgcggatacgccattgatgttacaacttgacggtttaatcgaacgagcaccacacgatatgttgattgtcagtaaatctaagcagattgtcaacgtcattagcgagcgccatcctgaaattggaatctggacgggcgatattcaagaaggactttataagaaattcgtggttgctactagtcaagtgttaggtgtcggagtagacggcttgcaacacaaataccaaactattgtcgtattggatccagtagaagaaggttctggagaatatgatgattatcgacaattgctctggcgcataacaggaagtcgtcagcagcatgatgtaaatgtaattgaattttattataaagaaagttaa

SEQ ID NO: 2270 - DNA, 489 bp, Streptococcus pneumoniae
ttgatgaaaattttagctattgatccaagtagtaataaaattgaaaccagcacaacaggagttgtcttgttggataatgcaagattagttgatagctgggttgtctcttatggtatgagaggtttcgctgattggtttcacgaaatcggaacaaatcttgaattcgatgtagttattgttgaagaatttaaggcgagggataacgacaagtcgaaagataatagcgtggcagaaaccatcgcctatatccaactttgctatccaggtgccattcttcaattcaatgcaggttacaagtcggatattccaaacgatcttttgaaaatcttagacctttggaaatttgaaaaaagtcatcatcaagatattcgagcagcagcaagacttggattattttgggcaatgagaaatgatattgaagaagtggttcatgatatcggaaaggtggtgagtgagtatcacaataacgctaagaaagtggcaagctga

SEQ ID NO: 2271 - DNA, 360 bp, Streptococcus pneumoniae
atggaattgatgaataaaacacgagtaacagattcactagcagttgtgattggaccagaatcgattgaagtacttgttactgaaggttttctatttgatgttgcgattcgttttgtaaaagtagacgaaacaaatcttgatcaaggaaatgaaaagccagtattcactccggaatacaagctggtcacagttgctaaatacaaggaaaaacctatctttgaatcggaggaagatattcgaaaatttgagaagcaagcaaaagaagttaaatcgctatttgcctttgcaaaggtaaataaacaaaattggtttaacactgccctttatccaggagtgctgactgagaaagttggtgtttga

SEQ ID NO: 2272 - DNA, 483 bp, Streptococcus pneumoniae
atggctagtttatacgaactaacaggtcagttcctgacaatttaccaattggatatcgatgacgaaacaaaagcagacacgcttgaggccatcgattggcaagaacaatttgaacagaaagcagaaggatatgcccatgttatcaagaatctagaagccgacgtggcaatgtacaaggctgaggaagagagcttcaaagccaagaaacaggtggcacagaaaaagctggattatgtcaaggataacattatggcagctatgaatgtcacggggcaaaccgaagttaagagtggtgccctgattataaaaattgctaagaatccagaatcagtcaaggtcaacgaagacgaccttccgaaaaaatattttacaaaaaaagtgacgcttgcgccggacaaaaaaacactcaaagagttgcttaaatctggcaagaaagtcaaaggtgcggagcttgtccggacagaaaagttggtgattaagtaa

SEQ ID NO: 2273 - DNA, 774 bp, Streptococcus pneumoniae
gtgaagtcaatgccccgatcgctttgctggaaggatgagtacacggagtacatgcatgaaatatgccctggtcgtttaactcctgaagtaaccaggttgctgaatgaaaaatttggtacgaattataacaagagtcaaatcggtggcgtacgcaaacgtctagggttagcagttggaaaagtctatcaaggtcgattgctgacaaaggagcaacatgattatcttgtattgatccaaaaaaataagatttctcgtaatgtcgcaaatgaaatgaaccaaaaatttggcttatcgctaactgagaaacagattaagagttatcggagaaataataatctacatagtggtttgacaggaagattcgagaaaggtcagactcctcacaataaggggaagaagtaccccaatatgccaaaaaacggcgggcagttcaaaaaaggtaatcgacctccgaattatgtacctgtcggtactatcaactacacaacaaacggttatccaaaagaaaagattggagaacctaatcaatgggttttgaaacaccgcaaggtttgggaggaccatcacgggctgataccaaaagggtactcaatcgtttttctggacggtgataaaacaaactatgatatttcaaatctggcatgtttatctaagaacgaaattgctagaatgaatcaaaatcatttattcacgtccaacgctgatttgactaaatcaggtattggactaacaaaacttacaaataaaatcagagaggtagaaaaaaatggctag

SEQ ID NO: 2274 - DNA, 231 bp, Streptococcus pneumoniae
atggtacgaaataaaataggtgatttaactaacacgctcttcgctcaattagagactctggatgatagggatcttacagcagatgaattaaaagtagaattacagcgctcgaaacaaatggtcgcaatctcaggtcaaatcttacaagcaggtcaattggcgctagatgctgaaaaattcaaagacaaggtaggtgaagtcaatgccccgatcgctttgctggaaggatga

SEQ ID NO: 2275 - DNA, 342 bp, Streptococcus pneumoniae
atgactcaagctgaacgaattagggaatattatagagagcaccctgctgcctcatatgatgaagtggctgaggtcgttggtacaacaaatagtaatgtgagagcgaacctggccaaagacatcaaggcaggcagatgcgttcgcttggaagataagtcatacgattactcgccttactataaccatacacaggcactcactgagttggttgactggaagaatgacaacagacgtgagtgggtggatatgctgacaagagcagcagagaaagaaacggatagcaacgttatgcgtttgttaatcaaagaagcaaataaattgatgaaagaggtgactaagtag

SEQ ID NO: 2276 - DNA, 189 bp, Streptococcus pneumoniae
atggaatatatttacctggtaacaatcgtaggaattggactatggtcgctagtaaataaactagatgaccacgctgaaatgaaacaaaaagagcgccagctgatggcaaacaatgtcgcacggatgaatctgagaaattcagataagcaatttacttatgatgtagaaccgcctgaagggttgaaataa

SEQ ID NO: 2277 - DNA, 261 bp, Streptococcus pneumoniae
ttggaaaaaagaaatggaaacaagcaagaaaatgaggtcagcaggatgaacctactatcaagaatcaaaaactatttttcggaagaggtcaaagaaactaatctcgactggaaagaggtcgctttagacctcaatcaatcactaattgaaacacaggaaaaacttcaagaagcgaatcaagaaatcgcagacttgaagaaaatcgtagcaatctataaagaaaaggagaaagaaaaacgatggaatatatttacctggtaa

SEQ ID NO: 2278 - DNA, 273 bp, Streptococcus pneumoniae
atggaagcagttgaaattgtaagaattaaagatgtgattattgaaaaagtctctgctaatgatgaagagttaaaacgtatctttggatgttcaaaacgacaagcaggagagcgaagaagagaaatgcaaaaactccctagtcagcaaaaacatcttttggatagtggacaacttgtaacgattaaaggtttctatgaatacttgcaatatcgtggaactaaagcttggaaaaaagaaatggaaacaagcaagaaaatgaggtcagcaggatga

SEQ ID NO: 2279 - DNA, 240 bp, Streptococcus pneumoniae
atgactgaaattcacgcatgtctttgcggaaattgggtgaacctatcagccgacgacgattgtgtaatgggaccaaatatggctagtccttacatttggtgggaagaaaatgcagaactctactcaccaatttctaaacctgaagcaaactcgatgtaccatcaggattatatctacattcactatcgtggcgctgactatcgtatccatccaatgttcattcaaatcgtttctagataa

SEQ ID NO: 2280 - DNA, 192 bp, Streptococcus pneumoniae
atgaaatcctttaaagattttcgagaatctttaacagctgaagatatgcaagctatctctgctaaagctaatgaagctactaaacagattgaccatacagacggattgcaactggggaaggtcagtggtttgacttctgtaataactactattgagttacttgagaagtatcatgaatggcttcatagctaa

SEQ ID NO: 2281 - DNA, 204 bp, Streptococcus pneumoniae
atgagaccaagacgatatccgtatagtgggaaaaaagagtccacctttgtaaaggcagaccctgagttagttgaaaaacttttaagaaacactagttttcttgagcgtttacaaaaaaagcctatcaattttcagatagactcagaagaatttaagcgtcttagctatgaagccattcatgatacttctcaagtaactcaatag

SEQ ID NO: 2282 - DNA, 201 bp, Streptococcus pneumoniae
atggaaagcgttcttgaaagcttgaaacaagaaaaagaccacctcgaaaaaatcattaaggtagttacctctggtggtaaatttctgagattgccgtatcaaaaaaagtcacgctcgattagtgagaatctgaaattgatttctcaaaatcttgataaattgagcgagcaagttcaacaaaccacgaatcagcattcatga

SEQ ID NO: 2283 - DNA, 216 bp, Streptococcus pneumoniae
gtgcagtggactttagaagctatgagaatcaacaaaggacttactcaagcagagttggcagaaaaatttgaagtttcaagtcaaacaattgctagattagaaaaagatagctctgatatcggttatcagctattgaaaaaatacatgttttttttcaatgtgaaattcgatgatatttttttagggaaaaaatacgaaaatttcgtaaataactag

SEQ ID NO: 2284 - DNA, 204 bp, Streptococcus pneumoniae; identical to SEQ ID NO: 2281

SEQ ID NO: 2285 - DNA, 690 bp, Streptococcus pneumoniae
atgatatttcgagtgaaagtaaattcttctgtttctaggcctgtaaccgttgaagacatttgcccaaattgtaaaaaaccaaccaatccagatcttgtgaactcttcttatttttctcttggagaaaataaaacaagcttagtattaacatgtagatgcttaggttgtaagcacttttggacagaggagtttatagctacaagatttttaatcaatgactataccgaaaaatacgaaattgaacatatcaaagtaatccctaatcttccgagcgatatacctatatctgacgatgtagagatagtttctccaattggtaagcaaatctatgtccaagcactgaaagctgaacacgaacaactagaccacattgcaggtattggataccgtaaggcgcttgagttctttgttaaagatttctccattgttacaaatcctgatgatgaagataaaatcattaaaatgtcattaaaacaagttattgaaaaatatatcaaggatgaagaccttaaaacatttgcgcttgcatctgcttatatcggtaacgacgaaggtcattactatagaaataatcctgataaaggttttacagacctaaagaactacctacacggagttattcactacatggaaatgaaactcaatttccttgatgctcaagagcttgtgaatcgttcaaagaaatcttag

SEQ ID NO: 2286 - DNA, 792 bp, Streptococcus pneumoniae
atggacgaaaaaaaacgaatgcaaattattgctgaaaatattacacactttagaaagcaacgtggcatcacccaaaaagagttggctaaagaagttggaattacagcaagtactatgacagactatatgaagttaagaagcgctccttcttttggtgttatccaaaaactggctgattatttcggtgttaaaaaatcagatatagatactacttttaaagaagaatccaccaactcactgccagacgctccagattcgctcacacagcagataatggataaggtagtgcaattaaccccacccaatcaaaaaatcgtgctacggacctctgaggagcttctggagagccaaaacgaagaagaaacgaagataaacgaagtatcggaagttatcagcttgtaccaagttgaggttgtatctgagacggcagcagcttctggatttaactatggatttgggtacgacgatacagacagagagactatagaggttgacgagcgaccaccacgccacgatattgcgaccaaggtcagtggagactccatgcaacccgactaccaagacggagacattctctatttagtagacaaaggactgactacctacaacggagatttagcaattatcgcatatggagaccgttcttacttcaagaagatatataccgaaaacggacgcttacgcctagtgtcactcaatgacaagtacgaagacatcatcctagacttcccaccagccgaagacacacacatcaagatttatgcagtagtcggggtgtatagaggggaataa

SEQ ID NO: 2287 - DNA, 951 bp, Streptococcus pneumoniae
ttgaagccatttaaaacaatcgaggaacaaatcgcaacactaaaaatcagagggttatccattacagatgaatctaaagcagctaagtacctgctaagtaacaattactacaatattatcaatggatacagtaagttttttcaacaccctggtactgacacttatattgacggcgtcacatttgacgaagtttcaagtctctatacatttgacaaagatgtaaaacgagccattttgcaagctattcttgaagctgaacaccatatcaagtcaatcactgctcacagattcgccgaagcttaccccagtcaaaaatacgcttatttaaacaccaattcttatgcagataataaaatattagacgtgggatttattgtatcaaaactatccaaaatcataaacacaaacaagcgatacagaggaaattcaattcaccactacgcacatactcattcagatgtcccaatctgggtactaactgattatctagagtttggagatttacgcacgattattgaaaacctgcctaattcactccaaaatgaaatcgcacgggatttagtaagttttataagcacaaacatacctgactttaacgatgttttcccaccagaaaccttgatatcttttctaaaaaatattaacgaggtacgaaacaaatgcgctcacaataatcgcttattaaacttcagatgccgttctaatagtacgttttgggaaacgattcataacaaagagatcttgatgggagatgacagtagaaaaactgtatattcaacaattattagccttcaatgctttattagtaaagcagcattcaacattttgtggaatactcttagaaaaaaagttatcaaactagagaaaaagctgccttctatagacatcaatgtaatcaaccagtctttaggttttcctaatgattggcaccgtaatgaaccaaaagtataa

SEQ ID NO: 2288 - DNA, 174 bp, Streptococcus pneumoniae
ttgtttcgtacctcgttaatattttttagaaaagatatcaaggtttctggtgggaaaacatcgttaaagtcaggtatgtttgtgcttataaaacttactaaatcccgtgcgatttcattttggagtgaattaggcaggttttcaataatcgtgcgtaaatctccaaactctaga

SEQ ID NO: 2289 - DNA, 1128 bp, Streptococcus pneumoniae
atgtggatggaagaattgccaaatggcaaatttaaatattttgagcgatataaagatccatatactgagaaattaaaaaaagtttcagtaaccatggagaagaaaactccccaggcaagaaatcaagctgctatcttgttacaagagaagataaataaaaaactcagcacaaaacaagtagaaagcattacatttgaagaaatctataaccttttctataaatcatgggcgcaaacagtaaaggaatcaacaaaacataattgtaaatcagttgataagaagatgaaggaagtcataccatccgataccatacttgctaatcttgacaggcgttttcttcaagaggctattgaaaaaattattgaaagcaacggatatattacagctaaaaaagtacggcataggctcagaggtatctttaattacgctgttcaatactcttacattgaaaacaacgaggtcgattatactacgattcctcaaaaaccaaagactttagaagaactggaaaaaaagcgtaacaactttctcaccatgcaagaaataaaagcacttgtcgatgtccttaatcgtcgagaatatcaccaaaagtacgctgatatggttcttgtgctgacattaactggtatgagatatggtgagttaactgccttacaactgaagaatatagacttcgaaaacaacaaaattgagatcacaggtaattttgattcagtaaacaaaatcaagacgctaccaaagactacaaattcaatacggacaatcaaagtatcagagagtgtcatagaagctattcaaagacaaatagtacgacttagcgaacgtttccagccattgtcaagcgatgattatattttctgttttgaaaaatggaatcaacctacaacaatagcttgcttcatacagatattaaaaaaatatggaaaacaggccaaaatagaaaaaaacttatctagccatatttttaggcattctcatatttcgtttttagcagagtctggcctcccaataaaatcaataatggatcgagttgggcactcaaatgcaaaaatgactttggaaatctattctcatactactgaggatatggaggataaactggtcaataaattagatactattttttaa

SEQ ID NO: 2290 - DNA, 186 bp, Streptococcus pneumoniae
cacaattttaataattttactgcttataagcacgatattttgtgtcagcccagtatttataaaattggacatcttaggaactccctctcatgccatcttaacctttgtattggcgataccgttattctatattttgtctcaatgcttacatactttgctattactagtttcctcaatcttttgtaa

SEQ ID NO: 2291 - DNA, 1059 bp, Streptococcus pneumoniae
atgaaagatgatcagaaatatttattagcgggactttattcgcttctagttgcaatattttattttccattgattgagtccaaggggatttttgtaagtatattgatggcggttttacttttatatttaatatacttcattgcaacagtcattcatattgtgataattaagtttataagaaaaaaatcttttaagtatttggttctatatccatttacttacgatgggagctggagatttcaacctataaacttactctactttccagaaatggtgagagatgtcattccgattaatttagttcaagaatattgccaaggacaaccttacggactgttaaaaaagatgctgaaaagaattcgattgtcacgagagatatctttactcctggctaccattatcgtctatttttttacgcatagaattctacctctttcagtatttacgttcatattttcttacatattgctatttgtacaatcttatttgggtagcaataccgcttggattggaaatagaagattaataatagatgatgaatttgaaaaaatcttgctttcaaaaagttatataaaagaaatatcatctgcacgatactcagaatacttgacatgtgaatacaaaaaccttacaccaatcatattgatagctatttttgaaaatttgcttgactcctacttgcttcagaatcagagtgaggttgacttagatattttttataaagttttacctttgctttataaagaaaaatatactatgggattcaattactttgtaagtttaaattatttactatataaggttggatttttgggaatcatttacgataatgaagcattaagagatttgtcaaaacaatatttaaacaaaaatatttcggaattacaagatggttctttcgagggcggtatacaagatgctgttgcctctaaacaaatagtagttataaatgaatttatagcttgtttaaattccagatgcgtgccatcccaatatgatagatttttttataaagatagaccttatattttttccagaaagagtcctattaaggggtga

SEQ ID NO: 2292 - DNA, 192 bp, Streptococcus pneumoniae
agtatattaaatataaaagtaaaaccgccatcaatatacttacaaaaatccccttggactcaatcaatggaaaataaaatattgcaactagaagcgaataaagtcccgctaataaatatttctgatcatctttcattcaaaacaccatattatttactaagaatacatcaatacaatagagcaactctgtaa

SEQ ID NO: 2293 - DNA, 213 bp, Streptococcus pneumoniae
atgatgattgttttaatttcagttattgttgcattcctgtatcataaaattacagagtatgtcaacaacaggaaaattgatattgttatttttctatcattgctgatttctcattttatttggaattactattttttaccaattgaaatattgatagcaatcagtggagcaaatttactattaagttttttaaaaaaattacagactaaataa

SEQ ID NO: 2294 - DNA, 243 bp, Streptococcus pneumoniae
ctctatttccaaaatttaatttttgggggacttagtaatgaaattacaattaacaacacacctaaaataaataaaaatatctcccaaactttattctcagttttaataaagctaccatatctatctcatttcttatttttaaataattcatactctttttctctgataaagggaactgaaaaattagaaaaaattatcagaattgaaaacagatatacgtctttttgtatcactaaaacataa

SEQ ID NO: 2295 - DNA, 447 bp, Streptococcus pneumoniae
atgatgtatcttgatggggggggttatttaagcaagagtgcttgtcaaggaatttgcgcagctttagctatgagtccaggaacttttatagcattgactggagctgcagttttaacaaaaaaactaataaactatattaaggttggaggccttggaggttggcttattggtgcagcagcaggtgtattggctcttatctttttgataaaaatttgtgtagatactacgataaaggttctattaaacagaatctttaaggcaagtaaggtaatgaaaaggaggatattttctctttttgtactagatttgatggtctatatatttttaggttatgttttagtgatacaaaaagacgtatatctgttttcaattctgataattttttctaatttttcagttccctttatcagagaaaaagagtatgaattatttaaaaataagaaatga

SEQ ID NO: 2296 - DNA, 180 bp, Streptococcus pneumoniae
accatcaaatctagtacaaaaagagaaaatatcctccttttcattaccttacttgccttaaagattctgtttaatagaacctttatcgtagtatctacacaaatttttatcaaaaagataagagccaatacacctgctgctgcaccaataagccaacctccaaggcctccaaccttaata

SEQ ID NO: 2297 - DNA, 351 bp, Streptococcus pneumoniae
ttgagtatttctatgttaaaaaaatatccttgtacgatgcaacatgaccagtcagattgtgctgcggcagttgtttcaacagttcttttatcttacaaaaaggaactatcaatcatgaagattcgggaaattattggtacagacatgtatggaacgactgtcagtggtattgtttcaggtctgaataagttgaattttacagtaaaagctgttcgagtagcactggaagatttgactccaaaattaacatttcctgcgattcttcaagttaagaatgatttaggtcaaaatcattttgtggtattacatagtataaaggagaaaataaagggaactcgtattaccaaataa

SEQ ID NO: 2298 - DNA, 864 bp, Streptococcus pneumoniae
atgcgttatgatttcggaaaggtctataaagaaatacgtgagtcaaaggggctgacccaagaagaggtctgtgggggtgttctctcaagaaccagcttatcaaaaatcgaaagtggcaagacaaccccaaaatatgaaaatatggaatttcttctccgtcaaatcaatatgagttttgaagagtttgaatatatctgtcaactttatcaaccaagtcaacgcacagagattatgcaaacctatctcaatatgcgttccattatcgggaccagcgatcttgtcaatttatttcaaaaatgccaagactacctcaagacccaccacgatctccctatagaagaaatcagagatatgcttgaagttgttatttatctccgtcaacacggggcaggggaactatcaaaacacgcagaacaggttgtcaaaaaactttggaaaaaaattgaaaaacaagatacatggtatgagagtgatctaaaaatcctcaataccattcttttcagttttcccattgaatacctccatctcatcactggaaaaatattgcaacgcctagaagtctataaaaactatcaacatttatatgacttgcgaatgacaattctattaaacctttccacactctatctatacaatcaagataaaaacatgtgtaagcaaatctgctacactttactagaggacgccaagaataagaaaagctacgataggctggctatctgctatgtccgtattgggatttgtacagacgattctaaacttatccaaaaagggttctcccttctggagctaaccgaggaaacttctatgctgtctcatctcaaaaaagaagtagagatctattaccaagcgaaggaaagataa

SEQ ID NO: 2299 - DNA, 375 bp, Streptococcus pneumoniae
gtgtttactactatgtgtccatgtcaccatgaatcgccgaacgatttaacgagaaagtatgacttttacgtttatcccaactcaattatgacatttttttcaaaagtcaatatatctcactttttcaacgacaagaaagaggctaccaatcgaccaacctcttattctgaacccatcactccatcactttttagcttcattcgctttcttagcgactgcaatctggtattcgacttggtcattccccttaccggtacaaccatgagcaattgtagtcgctcctatctgatgcgctatttcaaccaattttttagaaatcagagggcggctcaaggcagataccaagggatacttttgttcataataggcatgtga

SEQ ID NO: 2300 - DNA, 228 bp, Streptococcus pneumoniae
atggttatatttttgcttaaaatgaaacatttttttgcaggaattggtgaaataaactttgtaagttatttattgtatatatgtgtaggaatagcccctttttttcacgtatatataataggttctgaaatgaattttgtgaaaatagtgttatctattttgggaattatatttgtttgtattttaactattgctcgaatttataggacttttttctataaagaatag

SEQ ID NO: 2301 - DNA, 381 bp, Streptococcus pneumoniae
atggaacttgtattaccaaataattatgttgtgattgatgaagaagagatgatgtaccttgatgggggtggtgttggttgtaactggtggaatagtagaggtagttttgcaacagttctggatgtaggtttggccatctatagtggtggtgcaacaatttattctgcttatgcgataaaaaaagctatctcagctaatagaggggctattacgagaacattacgtagtttaataattaaacatgtaggtagtgcagctggccatttagtcaatactgcactaaacgttgcactaactgttactggattttcactaggtggagcaatcgcatatggggctgattgggctgacggtagcttagatggttatatttttgcttaa

SEQ ID NO: 2302 - DNA, 225 bp, Streptococcus pneumoniae
tctttccatggggctggtcgatataatgtaagggagcttgagttgttagtggaggataaaatgttaagagtaatagtagttattcaatctttagtaataatactgcttgctgttgctttattattatctcggaaaaactttgattcgttaaatgttgttcttataatgatgatcgtatcacaattgttgttattagtatatttgataaaatcagggaatcagtga

SEQ ID NO: 2303 - DNA, 210 bp, Streptococcus pneumoniae
ctactattactcttaacattttatcctccactaacaactcaagctcccttacattatatcgaccagccccatggaaagattatagctagactaatcaatgatataatacatactagaatacaaaatatttttttattcatactttttctcctatctttattttctacctacatagtacctcttattaagctcatttcaaaattacgttaa

SEQ ID NO: 2304 - DNA, 204 bp, Streptococcus pneumoniae
gctcatttcaaaattacgttaacttttttcacgaaaaggagaaaattatgcgttatgattatggatagcgctttcaaatttttaaactctatcccatccttttatctatattatgagcgaaaatataataactgtcaagtaactaaagtgaattttataaaaaaattacaagccaaatttgtaaagtttacactaagccgctag

SEQ ID NO: 2305 - DNA, 864 bp, Streptococcus pneumoniae; identical to SEQ ID NO: 2298

SEQ ID NO: 2306 - DNA, 519 bp, Streptococcus pneumoniae; identical to SEQ ID NO: 295

SEQ ID NO: 2307 - DNA, 366 bp, Streptococcus pneumoniae
gtgaaacagtctgggagactgtttcagcctgagcctagaaatttgaaagcgaagctgtttagccaagtcatagtaagggctaaacatatccatagtaatgattttgacgcgacatcggacggctctatcatatttaagaaagtgatctcggatgacagcttgtgttctaccttcaagaacagtgatgatatcgagcttttcaaaatcttgcgcaataaagctcatctccatctcccgattgaaacagtcactccccggactgtttcaacgtcccaagacataatcttaggcagatttctaaaattacactcaaagtggaagtcattgagctttcgaatgacagttgaagttgagatggaaagctga

SEQ ID NO: 2308 - DNA, 288 bp, Streptococcus pneumoniae
atgagctttattgcgcaagattttgaaaagctcgatatcatcactgttcttgaaggtagaacacaagctgtcatccgagatcactttcttaaatatgatagagccgtccgatgtcgcgtcaaaatcattactatggatatgtttagcccttactatgacttggctaaacagcttcgctttcaaatttctaggctcaggctgaaacagtctcccagactgtttcactcccgaatgctaaaatcgttcttgatcgctttcacattgtgcaacatcttagccgtgctatga

SEQ ID NO: 2309 - DNA, 768 bp, Streptococcus pneumoniae; identical to SEQ ID NO: 2039

SEQ ID NO: 2310 - DNA, 471 bp, Streptococcus pneumoniae
ttgaggatgcctttaaagcgtccattgaaaaatagaaagaaggaaaagaacatgagtaaagaaaaagtaattttggcctattctggcggtttagacacatcagttgctattacctggctgaagaaagactatgatgttgttgcagtttgtatggatgtgggtgaagggaaagacttagatttcatccatgataaggctcttaaggttggggcagtcgaatcttatgtcattgatgttaaggacgaatttgctacagattatgtgctagtggctcatcagtcacatgcctattatgaacaaaagtatcccttggtatctgccttgagccgccctctgatttctaaaaaattggttgaaatagcgcatcagataggagcgactacaattgctcatggttgtaccggtaaggggaatgaccaagtcgaataccagattgcagtcgctaagaaagcgaatgaagctaaaaagtga

SEQ ID NO: 2311 - DNA, 798 bp, Streptococcus pneumoniae
atgaagaaggtgttgatgacgatgtttggtttagtgatgctccccctactatttgcttgtagtaacaatcaatcggctggaattgaagccatcaagtccaaaggaaaattggttgtagccctcaatccagattttgctccatttgaatatcaaaaagtggttgatgggaaaaatcagattgtgggttcagatatcgaattagccaaggctatcgcaacagaactaggtgtcgaattggaactatctcctatgagttttgacaatgtactggctagcgttcaatcaggaaaagctgaccttgccatatcaggtgtttctaagacagatgaacggagcaaggtgtttgatttttcaactccctactatactgcaaaaaataaactcattgtcaaaaaatctgatttagccacttatcagtctgtcaacgatttggcgcagaaaaaggtcggagcgcagaaaggttcgattcaagagacgatggcgaaagatttgctacaaaattcttccctcgtatctctgcctaaaaatgggaatttaatcacagatttaaaatcagggcaagtggatgccgttatttttgaagaacccgttgccaagggatttgtggaaaataatcctgatttagcaatcgcagacctcaattttgaaaaagagcaagatgattcctatgcggtagccatgaaaaaagatagcaaggaattgaaagaggcagtcgataaaaccattcaaaagttgaaggagtctggggaattagacaaactcattgaggatgcctttaaagcgtccattgaaaaatag

SEQ ID NO: 2312 - DNA, 642 bp, Streptococcus pneumoniae
atgattgagttgaaaaatattaccaaaaccattgggggaaaagtgattttggataacttatctctcaggattgatcagggggatttggtagctattgttggtaagagtggtagtgggaagtcgaccttgttaaatttattgggtttgatagatggtgattatagcggacggtatgagatttttggtcagacaaatctagcggttaattctgctaagtcgcaaacaataatccgtgaacatatctcttatctgtttcaaaattttgccctgattgatgatgaaacggtcgagtacaatctcatgctggcgctgaaatatgtgaaattgcctaagaaagacaagctcaaaaaggtggaagagattttagagagagtaggtttgtcagctactttgcatcaaagggtctccgagttgtctgggggcgaacaacaacgaattgcagttgctagagccatcttaaaacccagccagctgattttagccgatgaacctacaggttcgctggatcctgaaaatagagatttggtcttgaagtttctcttagagatgaatcgagaagggaaaacagtcattattgtgacccacgatgcttatgtagcccaacaatgtcatcgtgtcattgaattgggcgagggaaaatga

SEQ ID NO: 2313 - DNA, 177 bp, Streptococcus pneumoniae
atgactgttttcccttctcgattcatctctaagagaaacttcaagaccaaatctctattttcaggatccagcgaacctgtaggttcatcggctaaaatcagctggctgggttttaagatggctctagcaactgcaattcgttgttgttcgcccccagacaactcggagaccctttga

SEQ ID NO: 2314 - DNA, 1317 bp, Streptococcus pneumoniae
ttgattataaacccaaaagatttgtttcctatactgtggttgtctcattttttgctgttgcagctttatctctttatcagttggttgacttacctcttaatccaaaaaatgacaatcagctctctgctgaaaggtttttcatctttcaaatttggtcttatcttcaattatgtgatgaaaatagggacaactattttactgacggccttactgattggggtgggcagaagtttagaacaagaaaacaaagaacttgcttatcagcaacagtgggtaagtcaaggtaattacctgaccttagaaaccttcaaactcaatgataatctgtggcaagaagagctagcagggtcagggaaatctacagattatttctatcgattttatcaggatttggtagaaaaaacgcaggcgggctatgtgcagagtagcagtcttcctgtaaaaaattttgtccaatcagaacagattcagcaatatcagttaacagatacggtggatgtttactatgccaatcgcaattttctaaagagcaagggattcaagctaccagataccggtattaaaaaagttattttgatgccagcaagtacgaaaggtgaagaagataaaaatcagctcttggggaagttaattgcctttcattcgatgaagtatgaagagcagcaaaaacgaacgatagaggagatggatgtcgagattgcctattatgaaggagattggtcatttttcccatatagtgataagcgaaaggaaaatctctccaatccaattattagcttggtcaatgattctgatatgatgtgggatgagaaagcctccctgtcaacaactggcttaaataatccgattaaaattgaaaatacggttcaacatcaaaaagagattacagagttagttgagaaattgtcagatggaaattatttaaaattttcatctattcaagccattcaacaagagaaagtggattcttatcgagatgctgttcggaattttaacctactctttgctttgtttggtctccttagcatgatgatttcctacttcttactagtaacaactttcttattgaagcgcagggatatcattaccaagaagtttatggggtggaaactggtcgatcgctaccgtcctctcctcgttctgctcttgctgggctatagtttccctcttctagtcttgattttctttgcccatgcgttcttaccacttctactgtttgcaggttttacatgtctggatatactatttgtgctaggcttagcttctaggatggagaaaagaagtctagtagagttattgaaagggggcatcttatga

SEQ ID NO: 2315 - DNA, 1113 bp, Streptococcus pneumoniae
ttggagagggaaaactgtagtggaggcacttttatgaaaaaaatcagtaatttctgtatgttactcctgcttctgtgtaccactttttttgtttttaatgtaaactatacacgagaagtggttcggattcaagaaatgggaaagactgtagattctttggatttgtatttgaaagatattaacgaacctgcagcgtctgttcttcgattttttgaggatgtatcaaaggagtataaagtctccatcatcaaaacagacagtggtgatgaggtggtcaagtctggtgtttttgataaagataccttcccctaccaagagtttgggatttcttctcttgattttaccacagatggtgaaggagtctatagtaataaagaaatttccaataaacttggtacgattccgacctttctaaaagccaaacctattcagcttatgacttttcaaacctatatcaaggatacatctcgtagtttaaatggtcgctatacgataacttctacacaagagatggacaaggataggattgtacagaaatggagcgattttttcaagatagaccaggctaccttgctagagccgacctacaaaagtgcagtggaagtcataaatcgagatttgcttttatctgccattgtttttgtcttggctattttgcttcttgtgttagtgacagtgtatcaaccgatgatggagatgaaaagagttggggtacaaaaattacttggttttcaagatagggctgttttagctgatgttgtaaaaggcaacctttacctcctcctaggtggggctcttgtgatcaatctaggcgtgtttttcttgcttgattataaacccaaaagatttgtttcctatactgtggttgtctcattttttgctgttgcagctttatctctttatcagttggttgacttacctcttaatccaaaaaatgacaatcagctctctgctgaaaggtttttcatctttcaaatttggtcttatcttcaattatgtgatgaaaatagggacaactattttactgacggccttactgattggggtgggcagaagtttagaacaagaaaacaaagaacttgcttatcagcaacagtgggtaagtcaaggtaa

SEQ ID NO: 2316 - DNA, 216 bp, Streptococcus pneumoniae
ttgaatattctgattacttacattctactcgatatcatacagcaactgttagacatgggggtagaacctctaaggattatgcaaaacctgaggcatgggctagagcttccctcaccaagattccgccaacaggaatggaatatttctatggatttgagtaaaattcttccctctcctatttggagagggaaaactgtagtggaggcacttttatga

SEQ ID NO: 2317 - DNA, 252 bp, Streptococcus pneumoniae
atggaatgtggtatacttgaaaacacaaatgctttaacagtatgggttgagggtggtcaatggaactatggagtaggttggacaggaacttttgaatattctgattacttacattctactcgatatcatacagcaactgttagacatgggggtagaacctctaaggattatgcaaaacctgaggcatgggctagagcttccctcaccaagattccgccaacaggaatggaatatttctatggatttgagtaa

SEQ ID NO: 2318 - DNA, 864 bp, Streptococcus pneumoniae; identical to SEQ ID NO: 2298

SEQ ID NO: 2319 - DNA, 588 bp, Streptococcus pneumoniae
atgaaatcaataactaaaaagattaaagcaactcttgcaggagttgctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtggcagaaactccagtagtaagtgaaacagttgtttcaactgtaagcggatctgaagcagaagccaaagaatggatcgctcaaaaagaatcaggtggtagctatacagctacaaatggacgttatatcggacgttaccaattaacagattcatacctgaacggtgactactcagctgaaaaccaagaacgtgtagcagatgcctacgttgcaggacgttacggttcatggacagctgctaaaaacttctggcttaacaatggctggtattaa

SEQ ID NO: 2320 - DNA, 291 bp, Streptococcus pneumoniae
gcagatacaaatgatggagcaaatactgcaaacaaggcagcaactcctgcaagagttgctttaatctttttagttattgatttcatattcgaaaattctccttctttctatagttctatcataccctttaaatattaccgtttcttgacacttttatgtagaaatattacaaaattattttttatttccctaaataaggtgttttttgtcataaaagatactatttttatgctatttgaggtattagaaaggttttcatccacaattaaagccaagcccctcattctttga

SEQ ID NO: 2321 - DNA, 672 bp, Streptococcus pneumoniae
atgaaatcacttcgttttcaatctgtctttgatatcatcggaccagttatgattggcccatctagtagccataccgctggtgctgttcgtattgggaagattgtctcttccatttttgatgatactccgacagaagttgaattccaactttttaactcatttgccaagacctatcgtggtcacggaacagacctagcccttgttgcaggtattttaggaatggatacagatgatcctgaaattccaaatagtctggaaattgcccacaagcgtggtatcaagattgtctggaccattcagaaagacagcaatgcccctcaccctaacaccactaaaattactgttaaaaatgcccacaagaccatcagcgtgactggtatttctatcggtggaggaaatattcaggtaaccgaactcaatggttttgccgtctctctcaatatgaatacaccgactatcatcatcgttcatcaagatattccaggtatgattgcccttgttacagaggcgctttcccgctatggtatcaatatcgcccagatgaatgtcactcgtgaaaaagctggtgaaaaagccattatgattatcgaagttgacagtcgcaactgtgatgaggctatcgaagaaattcgaaaaatccctcatctccacaatgtcaatttctttaaatag

SEQ ID NO: 2322 - DNA, 873 bp, Streptococcus pneumoniae
atgttttattctatcaaagaattggtcgagcaagcagatctggactttcaaggaaatgtcgcagaactcatgattacaacagagtttgaattgaccggtcgcgaacgtgaagaagtcttccttctcatggaacgcaatctggaagttatgaaagcctctgtccaacttggcctcaatgaaaataaatctcgtagtggcctgacaggtggagatgctgccaaattggatcactacatcaaaaacgaaaaaactttatcagattacacgattctctctgctgcccgaaatgctatcgcagtcaatgaacacaatgccaaaatgggcttggtctgtgccactccaaccgctggaagtgctggctgtctcccttccgttctcactgctgctattgaaaaattagacctcagccacgagcaacaattggatttcctctttgctgctggtgcctttggactagtcatcgcaaacaatgcctccatctcaggtgctgagggtgggtgtcaagctgaagttggttcagcctctgctatgagtgctgccgccttgactctggctgcaggtggaacaccttatcaggccagtcaagctattgcctttgtcattaaaaatatgctaggcctcatctgtgaccctgttgcaggtttggtcgaagttccctgtgtcaaacgtaatgccatgggagctagctttgctttcatcgcagcagacatggccttggcaggtatcgaatctaaaatccctgtggatgaagtgatcgatgccatgtaccaagtaggagcaagcatgccaactgcctttcgtgaaacagctgaaggtggactcgctaccacccctactggtcgtcgcctccaaaaagaaattttcggagaataa

SEQ ID NO: 2323 - DNA, 534 bp, Streptococcus pneumoniae
ttgagcttcatagatgccttttgccttatagtaagaacgatatatctgcacggcttcagaaatttggtctttggacaggcaggtcgcaaaactactttcgagaggtggtcccataaaaccacgaatagttttggcatcagggctaggcacccccagctctttaaaggtataggtaaaggcattgtgaatcccgatagaactatcaacgagggttccatccaaatcgaaaaaaatcgctgtgatagaggtcatggtttctcctatttgataagcttattctccgaaaatttctttttggaggcgacgaccagtaggggtggtagcgagtccaccttcagctgtttcacgaaaggcagttggcatgcttgctcctacttggtacatggcatcgatcacttcatccacagggattttagattcgatacctgccaaggccatgtctgctgcgatgaaagcaaagctagctcccatggcattacgtttgacacagggaacttcgaccaaacctgcaacagggtcacagatgaggcctag

SEQ ID NO: 2324 - DNA, 633 bp, Streptococcus pneumoniae
atgacctctatcacagcgatttttttcgatttggatggaaccctcgttgatagttctatcgggattcacaatgcctttacctatacctttaaagagctgggggtgcctagccctgatgccaaaactattcgtggttttatgggaccacctctcgaaagtagttttgcgacctgcctgtccaaagaccaaatttctgaagccgtgcagatatatcgttcttactataaggcaaaaggcatctatgaagctcaactctttcctcagattatagacttgcttgaggagttatcgagcagttatccactctacatcaccacgacaaaggatacatctactgctcaagacatggcaaaaaacttggaaatccatcatttctttgatggcatttatggttctagccctgaagcaccccataaggcagatgtcattcaccaagccttgcagacacatcaactagcaccagaacaagccatcatcatcggagataccaagtttgatatgctgggagctcgagaaacaggtattcagaaattggccatcacttggggatttggagagcaagcagatctactaaactatcaacctgattatatcgctcacaaacccttagaggttttggcgtattttcaatag

SEQ ID NO: 2325 - DNA, 216 bp, Streptococcus pneumoniae
caaactaggaaactagctgcgggctgctctaaacactgttttaaggttgtagatggaactgacgaagtcagctcaaaacactgttttgaggttgtggatagaactgacgaagtcagtaaccatacctacggcaaggcgacgttgacgtggtttgaagagattttcgaagagtataagtctctacataataaaacgcatattaccaaggttgtgtaa

SEQ ID NO: 2326 - DNA, 1851 bp, Streptococcus pneumoniae
atgaataaaaaactaacagattatgtgattgatctggtggaaattttaaataaacaacaaaagcaggttttctggggaatatttgatattttcagtatggtggtttccatcattgtatcttatattttattttatgggctgattaatccagcacctgttgactacattatctatacgagtttggccttcttgttctatcaattgatgattggtttttgggggttgaacgcgagcattagtcgttacagcaagattacggatttcatgaaaatcttttttggtgtgactgctagcagtgtcttgtcatatagtatctgttatgccttcttgccactcttctccatccgtttcatcattctctttatcttgttgagtaccttcttgattttattgccacggattacttggcagttaatctactccagacgcaaaaaaggtagtggtgatggagaacaccgtcggaccttcttgattggtgccggtgatggtggggctctctttatggatagttaccaacatccaaccagtgaattagaactggtcggtattttggataaggattctaagaaaaagggtcaaaaacttggtggtattcctgttttgggctcttatgacaatctgcctgaattagccaaacgccatcaaatcgagcgtgtcatcgttgcgattccgtcgctggatccgtcagaatatgagcgtatcttgcagatgtgtaataagctgggtgtcaaatgttacaagatgcctaaggttgaaactgttgttcagggccttcaccaagcaggtactggcttccaaaaaattgatattacggaccttttgggtcgtcaggaaatccgtcttgacgaatcgcgtctgggtgcagaactgacaggtaagaccatcttagtcacaggagctggaggttcaatcggttctgaaatctgtcgtcaagttagtcgcttcaatcctgaacgcattgtcttgctcggtcatggggaaaactcaatctaccttgtttatcatgaattgattcgtaagttccaagggattgattatgtacctgtgattgcggacattcaagactatgatcgtttgttgcaagtctttgagcagtacaaacctgctattgtttatcatgcggcagcccacaagcatgttcctatgatggagcgcaatccaaaagaagccttcaaaaacaatatccgtggaacttacaatgttgctagagccgttgatgaagctaaagtgtctaagatggttatgatttcgacagataaggcagtcaatccaccaaatgttatgggagcaaccaagcgcgtggcggagttgattgtcactggctttaaccaacgtagccaatcaacctactgtgcagttcgttttgggaatgttcttggtagccgtggtagtgtcattccagtctttgaacgtcagattgctgaaggtgggcctgtaacggtgacagacttccgcatgacccgttactttatgaccattccagaagctagtcgtctggttatccatgctggtgcttatgccaaagatggggaagtctttatccttgatatgggcaaaccagtcaagatttatgacttggccaagaagatggtgcttctaagtggccacactgaaagtgaaattccaatcgttgaagttggaatccgcccaggtgaaaaactctacgaagaactcttggtatcaaccgaactcgttgataatcaagttatggataagattttcgttggtaaggttaatgtcatgcctttagaatccatcaatcaaaagattggagagttccgcactctcagtggagatgagttgaagcaagctattatcgcctttgctaatcaaacaacccacattgaataa

SEQ ID NO: 2327 - DNA, 252 bp, Streptococcus pneumoniae
caccatcttcttggccaagtcataaatcttgactggtttgcccatatcaaggataaagacttccccatctttggcataagcaccagcatggataaccagacgactagcttctggaatggtcataaagtaacgggtcatgcggaagtctgtcaccgttacaggcccaccttcagcaatctgacgttcaaagactggaatgacactaccacggctaccaagaacattcccaaaacgaactgcacagtaggttga

SEQ ID NO: 2328 - DNA, 1176 bp, Streptococcus pneumoniae
ggctttttcactataatgtcaagtaaggtttctggctttcaagataaaaatgggaaagtcttgaaaattatgatagaatggtggaaggaaaaattcaggagagtagtagtgactcaaaatgttgaaagtcttctcgtatccattgtaatcagtgcatgcaatgaagaaaaatatctgcctggtctaattgaagacttaaaaaatcaaacctatcctaaagagaatattgaaattctatttataaatgctatgtccacagatgggaccacagctatcattcagcaatttataaaggaagatacagagtttaactcaattagattgtataacaatcctaagaaaaatcaagctagtggttttaacctgggagttaaacattctgtaggggaccttattttaaaaattgatgctcattcaaaagttactgagagttttgtaatgaacaatgtggctattattcaacaaggtgaatttgtctgtggggggcctagaccgacgattgtcgaaggaaaaggaaaatgggcagagaccttgcatcttgttgaggaaaatatgtttggaagtagtattgccaattatcgaaatagttccgaggatagatatgtttcttctatttttcatgggatgtataaacgagaggttttccagaaggttggtttagtaaatgagcaacttggccgaactgaagataatgatattcattatagaattcgagaacatggttataaaatccgctatagcccaagtattctatcttatcagtatattcgaccaacattcaagaaaatgctgcatcaaaagtattcaaatggtttgtggattggcttgacaagtcatgttcagtttaagtgtttatcattatttcactatgttccttgtttatttgttttgagtcttgtgtttagtctagcattgttaccgatcacattcgtattcataactttactattaggtgcctattttctacttttgtcattactcactttgctgactttattaaaacataaaaatggatttctaattgtgatgccctttcttttattttccattcactttgcttatggccttgggacgattgtaggtttaattagaggatttaaatggaagaaggagtacaagagaacaataatttatttggataaaataagccaaataaatcaaaatatgctacaataa

SEQ ID NO: 2329 - DNA, 306 bp, Streptococcus pneumoniae
ttgggggtttctttcgaactcccttttctggtttaccccttttttttgggaaatatttcgcaagttctggaggtaaaagttagttcgcttggtggttttgaccagcttgcctctccttatgtttaccctcttttcaccattttctacccaactggctcagaaaatcggcttggagcatctcttcacttacagcctcttcttcttgaccatcggctcacttattcgactaatcaatctgcccctgctctatctaggaaccttgatggttggggcaagtgtcgcagtcatcaatgtcctgcttcctag

SEQ ID NO: 2330 - DNA, 747 bp, Streptococcus pneumoniae
ttggtggttttgaccagcttgcctctccttatgtttaccctcttttcaccattttctacccaactggctcagaaaatcggcttggagcatctcttcacttacagcctcttcttcttgaccatcggctcacttattcgactaatcaatctgcccctgctctatctaggaaccttgatggttggggcaagtgtcgcagtcatcaatgtcctgcttcctagtcttatccaagccaatcaaccaaagaaaattggttttctgaccaccttatatgtaacgtctatggggattgcaacggctctggcttcctatctagctgtgcccattacacaagccagttcttggaaaggacttatccttctcctcacgttactctgtctagcaacttttttggtctggctcccaaatcaccgctataatcatagactagctccacaaaccaaacaaaaaagtcaaataaaggtcatgcgtaataaacaggtgtgggcaactattatcttagcaggttttcaatcgttgatgttttacaccgtcatgacgtggttacctcccatgtctatccatgcaggtttatccagtgtcgaagttggctcgatgacttcaattttatctaatgataagcattccttttacaatgaccatcccaagcctggcaaccagtttatcgactcgcaaccgtcagctcatgctcactctggtttcactagctggtgtggtcggcatttgcatgctctttttcccaatcaataa

SEQ ID NO: 2331 - DNA, 429 bp, Streptococcus pneumoniae
atgataagcattccttttacaatgaccatcccaagcctggcaaccagtttatcgactcgcaaccgtcagctcatgctcactctggtttcactagctggtgtggtcggcatttgcatgctctttttcccaatcaataatttcatttactggcttgccatccatctcctcatgggaaccgcaaccagtgccctcttcccttatctcatggtcaacttttcactcaagacaagcgcccctgaaaagacagcccaattgtccggcctatctcaaacaggaggctatatcctagcagcctttgggccaaccctctttggttacagttttgacctgttccactcttgggtaccagctgtagctgccctcttgctcatcgatatcctgatgactgtggccctctttacagtggacagagcggataagatcctttaa

SEQ ID NO: 2332 - DNA, 327 bp, Streptococcus pneumoniae
atgtactttccaacatcctctgccttgattgaatttctcatcttggctgtactggagcagggtgattcttatggttatgagattagccaaaccattaagctgatcgctaatatcaaagaatccacactctatcccattctcaaaaaattggaaggcaatagctttctgacaacctattctagagagttccaaggtcgcatgcgcaaatactactccttgacaaacggtggtatagagcagctcttgaccctaaaagatgaatggacactctatacagacaccatcaatggcatcatagaagggagtatccgccatgacaagaactga

SEQ ID NO: 2333 - DNA, 594 bp, Streptococcus pneumoniae
atgacaagaactgaatacctgactcagctagaactctatctcaagaaactacctgaagctgaccgtatcgaagccatggactatttcagagagctctttgacgatgctggagtcgaaggagaagaagaactcatcgctagtttgggaactcccaaagaagtggcccacgaagttctatccaatcttctcgataaaaaaatcaatgaagcacccgctcaaaaaaataaccgacaaattttacatatcgccttgttagccctccttgcagcacctatcggcattcctctgggaatcgccatcctcgtgaccctgttcgcaatccttgtagccgctttgactgtcattctggctttctttgcagtttccatactgggtatcatcggcggattcctatttttagttgaaagtttcactgtcctcgcccaagccaaatcagcctttatcttgatttttggttctggtttactggctatcggtgcttcttcgctagttttactaggcatttcctatgtagctcgcttcttcggtctactcattgttcgtctggtacaatttgttcttaaaaaaggaaagagaggtaatcagcatgcgtaa

SEQ ID NO: 2334 - DNA, 912 bp, Streptococcus pneumoniae
atgcgtaaatggacaaaaggatttctcatctttggtgtggtgactaccgttatcggctttatcctgctttttgtaggtatccaatctgacgggattaagagcctactttccatgtccaaagaacctgtctatgatagccgtacggaaaagctaacctttggcaaggaagtcgaaaacctagaaattactctccaccaacacgcgctcaccatcacagactctttcgatgatcaaatccacatttcttaccatccatctctttctgctcaccatgatcttatcaccaatcaaaacgatagaactctgagtctcactgataagaaactgtctgaaactccgtttctctcttctggaattggtgggattcttcatatcgcaagtagctactctagtcgttttgaagaagttattctccagctaccaaaagggagaactctaaaagggatcaacatctcagccaatcgcggacaaaccaccatcataaatgctagccttgaaaatgcgaccctcaatacaaacagctatatcctccgaattgaaggaagtcgtatcaaaaacagtaaactcacaacacccaatatcgttaatatctttgatacagttcttacagatagtcagctagagtcaacagagaatcacttccacgctgaaaatatccaagtccatggtaaggttgaactgactgccaaagattatctcagaatcatcctagaccagaaagaaagccaacgaattaactgggacatctcaagcaactatggttctatcttccaattcacaagagaaaagcctgaatcaagaggtacggaattaagcaacccttacaaaactgaaaaaaccgatgtcaaggatcaactcattgcgagatctgatgataatattgatctaatatccacaccaagcagacgttga

SEQ ID NO: 2335 - DNA, 369 bp, Streptococcus pneumoniae
ttgctgaggaagagcttcttggctctcttcagctatagtgactttttctgtttctttagaaaggtctggctcttcttcagtagaattagatgccttcttttcttctatttctgttctcgcttcaccgacttcaggagtttcaattttctcttcttgctggctttccaattcgacttcagcttgagagacttcctcctctacttgagtattttttccaattggtgtatcgagatcggctatcgtttcttcagccttgtctgcaacctcttgagcttgctcttcaggcttgttcttgcttgttgtttttacaaaatcattactttcaaaccattcttgtttcatggtagaacctcctttttagttagataa

SEQ ID NO: 2336 - DNA, 1065 bp, Streptococcus pneumoniae
atgaaacaagaatggtttgaaagtaatgattttgtaaaaacaacaagcaagaacaagcctgaagagcaagctcaagaggttgcagacaaggctgaagaaacgatagccgatctcgatacaccaattggaaaaaatactcaagtagaggaggaagtctctcaagctgaagtcgaattggaaagccagcaagaagagaaaattgaaactcctgaagtcggtgaagcgagaacagaaatagaagaaaagaaggcatctaattctactgaagaagagccagacctttctaaagaaacagaaaaagtcactatagctgaagagagccaagaagctcttcctcagcaaaaagcaaccacgaaagagccacttcttatcagtaaatctttagaaagtccttatatccccgaccaagctccaaaatctagggataaatggaaagagcaagtgcttgatttttggtcttggctagtggaagcgatcaaatctcctacaagtaagttggaaacaagtatcacacacagttacacagcctttctcttgctcattctgttttctgcatcttcctttttctttagtatctatcacatcaaacatgcttactatggacatatagcaagcattaacagtcgcttccctgagcagctagctcctttaactcttttttctatcatctctatcctagtagcgacaacactcttcttcttttcattcctcttgggtagtttcgttgtgagacgatttatccaccaggaaaagtactggacgctagacaaggttctccaacaatatagtcaactcttggcaattccaatcttcctcactgctattgctagtttctttgctttctttgatagcctacgatttacagccctcttgtgtgtgattagcattggaatcattctgcttgccagtctccatatcattacaagaccaagtcaagcaagtgaaaccgactccttctatcaattattcttgtctgtccttgtgaacggagttattatcctcctcttctttgtagctgaagtggcactgattggagattatcttcgtatcttggcctttctttaa

SEQ ID NO: 2337 - DNA, 954 bp, Streptococcus pneumoniae
ttgaagagattttcgaagagtataaagtttgtttttgtatctttcagaaaaataaggtatactgtatgtaaacgatttcaaaggagtccagttatggcgaaaacattttttattccaaataaacagagcattttaggagaacaagagattttgaatgccaagtcgatcttggccttgctagacggtttggagtcacatagctatgatgtagtctatctccgtcagcctcttaatcgtctcgaatatatcgagtgtgcgatagtggggcaatcacaatttctctttaaggtcagttatgctgatggtcaaaaggcttaccgtgtcgatcttcctgacctactaacaaagacagactggcagattatcaagtcatttttagatgctttgcttgcttatacagggactgatattgaagggctagatggttttgattttgaagcttatttccaagcaagtattcaagcctatctagcagacgctgtagctcgttttacgatttgccaaggaatttttaatcctattttctttagtcgtgagaacttgaaaagctttttagaggcagatggcttggctcagtttgaagcgcgtgtgcgtgcggttcaagagacagatgcctattttgcaagagtttccttctatcaggatggagaaggaaaagtgcatggcgtttaccatttagctcaaggagtcaagacagttttaccgagagaaccgtttgttcctgcagcctatattgagcaattggtggataaggaagtccagtgggagattgacttggttcaaatcacaggagacggctctaaaccagaagactatgaatccatagctcgcttggactatgcaaaattcttagaggtattacccccatctttttaccaccagctagacgccaatcaaatagaaatacaacccatcctaggacaagattttaaaacattagcacaagaaaagtaa

SEQ ID NO: 2338 - DNA, 987 bp, Streptococcus pneumoniae
atggcaaaagatattcgtgtcttactttactacctttatactccaattgaaaatgcagagcaatttgctgcagaccacttggctttctgtaaatcaatcggccttaaaggccgtatcctagtcgctgacgagggaattaacggaacagtttcaggtgactatgaaacaactcaaaaatacatggactacgttcacagccttccaggaatggaagatctctggttcaagattgacgaagaaagtgaacaagccttcaagaagatgtttgttcgctacaagaaagaaattgtccaccttggtttggaagacaacgactttgacaatgacatcaacccacttgaaacaacaggtgcttacttgtctccaaaagagttcaaagaagcgcttcttgataaagataccgttgtccttgacacacgtaacgattatgagtacgacctaggacatttccgtggggctattcgcccagatattcgcaacttccgtgagttaccacaatgggtccgtgacaacaaagaaaaattcatggacaagcgtgtcgtggtttactgtacaggtggtgttcgctgtgagaaattctcaggctggatggttcgtgaaggttacaaagatgttggccaattgcacggaggaatcgcaacttacggtaaagacccagaagttcaaggtgagctttgggatggaaaaatgtacgtatttgacgagcgtatcgccgttgatgtcaaccatgtcaacccaaccatcgtagggaaagactggtttgatggaacaccatgtgaacgttatgtcaactgtggaaatcccttctgtaaccgtcgtatcttgacatcagaagaaaatgaagacaagtaccttcgtggatgctcacacgagtgccgtgttcacccacgtaaccgctatgtttcaaaaaatgaattgacacaagctgaagtgattgagcgcctagccgctatcggtgaaagcttggatcaagcagctactgtataa

SEQ ID NO: 2339 - DNA, 207 bp, Streptococcus pneumoniae
atgttttctcttgtccttattttaaccattcaggaaatttcgagaaccctctacaatttccagtcaaataaattgcattcgttttctcaagcaggtatactagtatggataaataaaaaatttagaaaatttaagaatagaaaagagaacaaatcttatggcaaaagatattcgtgtcttactttactacctttatactccaattga

SEQ ID NO: 2340 - DNA, 1545 bp, Streptococcus pneumoniae
ttgattttcattgagtataagatcattacattgtttataagtttaaaaataaaaaaaggagtttttatcatgaaaaactggaaaaaatatgcttttgcatctgctagtgtagtcgctctggctgcaggtcttgctgcttgtggaaatttgacaggtaacagcaaaaaagctgctgattcaggtgacaaacctgttatcaaaatgtaccaaatcggtgacaaaccagacaacttggatgaattgttagcaaatgccaacaaaatcattgaagaaaaagttggtgccaaattggatatccaataccttggctggggtgactatggtaagaaaatgtcagttatcacatcatctggtgaaaactatgatattgcctttgcagataactatattgtaaatgctcaaaaaggtgcttacgctgacttgacagaattgtacaaaaaagaaggtaaagacctttacaaagcacttgacccagcttacatcaagggtaatactgtaaatggtaagatttacgctgttccagttgcagccaacgttgcatcatctcaaaactttgccttcaacggaactctccttgctaaatatggtatcgatatttcaggtgttacttcttacgaaactcttgagccagtcttgaaacaaattaaagaaaaagctccagacgtagtaccatttgctattggtaaagttttcatcccatctgataactttgactacccagtagcaaacggtcttccattcgttatcgaccttgaaggcgatactactaaagttgtaaaccgttacgaagtgcctcgtttcaaagaacacttgaagactcttcacaaattctatgaagctggctacattccaaaagacgtcgcaacaagcgatacttcctttgaccttcaacaagatacttggttcgttcgtgaagaaacagtaggaccagctgactacggtaacagcttgctttcacgtgttgccaacaaagatatccaaatcaaaccaattactaacttcatcaagaaaaaccaaacaacacaagttgctaactttgtcatctcaaacaactctaagaacaaagaaaaatcaatggaaatcttgaacctcttgaatacgaatccagaactcttgaacggtcttgtttacggtccagaaggcaagaactgggaaaaaattgaaggtaaagaaaaccgtgttcgcgttcttgatggctacaaaggaaacactcacatgggtggatggaacactggtaacaactggatcctttacatcaacgaaaacgttacagaccaacaaatcgaaaattctaagaaagaattggcagaagctaaagaatctccagcgcttggatttatcttcaatactgacaatgtgaaatctgaaatctcagctattgctaacacaatgcaacaatttgatacagctatcaacactggtactgtagacccagataaagctattccagaattgatggaaaaattgaaatctgaaggtgcctacgaaaaagtattgaacgaaatgcaaaaacaatacgatgaattcttgaaaaacaaaaaataa

SEQ ID NO: 2341 - DNA, 402 bp, Streptococcus pneumoniae
ttggcaccaactttttcttcaatgattttgttggcatttgctaacaattcatccaagttgtctggtttgtcaccgatttggtacattttgataacaggtttgtcacctgaatcagcagcttttttgctgttacctgtcaaatttccacaagcagcaagacctgcagccagagcgactacactagcagatgcaaaagcatattttttccagtttttcatgataaaaactcctttttttatttttaaacttataaacaatgtaatgatcttatactcaatgaaaatcaaagagcaaactagaaaactagccgcaggctgctcaaagcactgctttgaggttgtagataagactgacgaagtcagttacatatatctacggcaaggcgacgttgacacggtttga

SEQ ID NO: 2342 - DNA, 924 bp, Streptococcus pneumoniae
atggcaaaaaagaaaattaaaaaagaaaaaattgataatgtcggcattcactccttcagtaagaaagcagatatcttcttcagtatcatttcgggtttgattgccctctcttgtatcctaccttttgtattcgttatcattatttcagtgacagacgagaaaagcctcctccaatacggctatagcttcttcccatcccaatttggcttagacggttttgagtttttggcacagtttaaggataaaatcctacaagccctcttcatctctgtctttgtaaccgtagttgggacattgacaaatgtctttatcacaacaacctatgcctacgctatttcacggacaacctttaagtatcgcagattctttaccatcttcgttctgctcagtatgttgttcaacgctggtttggtaccaggttatatcatggtgactcgtgtgcttcagcttggggatactgtttgggccttgattgttccaatgcttctctcaccatttaacatcatcttgatgcgttccttcttcaagaagaccattccagaagccattctagaatcggctcgtatcgatggtgccagtgaagcccggattttcttccaaatctgtttgccattgtcactaccaggtatcgcaaccatcacgctcttaacagctcttggtttctggaatgactggttcaacgcccttctttacatcaagagtgacaacttgtatccattgcaatatttgctcatgcaaatccaacaaaatatggactacattgccaaagcggtcggcttgactggtcaactgggagttgctctaccgaaagaaacaggtcgtatggccatggttgtggttgcaacccttccaatcgcgattttgtatccatttttccaacgctactttgtaaaaggtttgactatcggtggtgtgaaagaatag

SEQ ID NO: 2343 - DNA, 960 bp, Streptococcus pneumoniae
atggatatcaaaataaaaagggaggaaattatgaaaaagttttcaaaaacattgagagacaactggatctttctcttgatggttttgccaggggcactctggttgattctattcttttacattccagtatttgggaacgtggttgccttcaaagactaccacatgaccagtaatggtttcatagatagtatcataaatagtaaatgggtcggactcgataatttcagattcttatttagttcaagagacgcctttattatcacacgaaatactgtcctctacaatcttggctttatctttctaggtttagttgtatctgtagggattgccattatcctcagcgagctccgttctaagagaatggtgaagatttttcaaacttctatgttgttcccttacttcttgtcttgggttatcatcagtttctttacagatgccttcctaaatattgataaaggggtgttcaatcatctattggaaagtcttggtctcaaagaagtcaatttctacgctgacctgggcatctggccctatctcctacttttcctaggtatttggaaaggttttggatatagcagtgtcatgtactatgcgacgatcatgggaattgatccaacctactacgaagcagcgacagtggacggagctagcaagtggcaacgtattcgcaacgtaaccattcctcagttgactccgcttgtaactgtattgaccatccttgcagtcggaaatatcttccgcgcagacttcggtctcttctatcaaatcccacacaatgctggtcagctttacaatgtaaccaacgttttggacgtatatgtttttaatggtttgactcagacagcagatatcggtatggctgcagcagccggtctttaccaatccgttgttggtttgattctggttatcctatcaaacttgcttgcaagacgagtcgatccaaactcagctttgttctag

SEQ ID NO: 2344 - DNA, 210 bp, Streptococcus pneumoniae
tgtaatcgttatcaaaagtctaaaaaagaatttttagatggatatcaaaataaaaagggaggaaattatgaaaaagttttcaaaaacattgagagacaactggatctttctcttgatggttttgccaggggcactctggttgattctattcttttacattccagtatttgggaacgtggttgccttcaaagactaccacatgaccagtaa

SEQ ID NO: 2345 - DNA, 360 bp, Streptococcus pneumoniae
ttgagatcattgacaggtgtatcgaatcttaccacagattcagcacgtctggttttggcagaggctaagaaagcttttgcagatgatagtttgacagagcaaggtttacgtgatatcttgcaaacagtcaaagatgccattgcttccctagagtccattaaggaaagccagtcagcaactaaggatggaggacaaacagcgggcaaagaaacagcagataaggatgtccttgaaaactctcaagaagaacttcaaaaagcagttttgttcttggcagatgaaaaaggctctgagcatactgaagcagagttgattgataatcttaaagaggttattgctaagttgaaagcaaacgcctaa

SEQ ID NO: 2346 - DNA, 348 bp, Streptococcus pneumoniae; identical to SEQ ID NO: 2066

SEQ ID NO: 2347 - DNA, 531 bp, Streptococcus pneumoniae
  unsure (90): n at each above location is unknown.
atgtcacgttatacaggaccatcttggaaacaagctcgtcgccttggcctttcacttacaggtacaggtaaagaattggcacgtcgtaantacgtaccaggacaacacggaccaaacaaccgttctaaattgtcagaatacggtttgcaattggctgaaaaacaaaaacttcgtttcacttacggtgtaggtgaaaaacaattccgtaacttgttcgtacaagctacaaaaatcaaaggcggaatcctaggtttcaactttatgcttcttttggaacgtcgtttggataacgttgtttaccgtcttggtctcgcgactactcgtcgtcaagctcgtcaattcgtaaaccacggtcacatccttgttgacgggaaacgcgttgatatcccatcataccgcgtaactccaggtcaagtgatctcagttcgtgaaaaatcattgaaagttccagcaatccttgaagcagtagaagctactcttgacgtccagcattcgtatcattcgacgctgaaaaattggaaggttcattga

SEQ ID NO: 2348 - DNA, 1077 bp, Streptococcus pneumoniae
gatagagaaaccgagaggacaaacatgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtagcggccaaggattttccttcaaatttggaggttcaaggtcctgtagaatttcagcaattagggcaaacttttaatgagatgtcccatgatttgcaggtaagctttgattccttggaagaaagcgaacgagaaaagggcttgatgattgcccagttgtcgcatgatattaagacccctatcacttcgatccaagcgacggtagaagggattttggatgggattatcaaggagtcggagcaagctcattatctagcaaccattggacgccagacggagaggctcaataaactggttgaggagttgaattttttgaccctaaacacagctagaaatcaggtggaaactaccagtaaagacagtatttttctggacaagctcttaattgagtgcatgagtgaatttcagtttttgattgagcaggagagaagagatgtccacttgcaggtaatcccagagtctgcccggattgagggagattatgctaagctttctcgtatcttggtgaatctggtcgataacgcttttaaatattctgctccaggaaccaagctggaagtggtgactaagctggagaagggccagctttcaatcagtgtgaccgatgaagggcagggcattgccccagaggatttggaaaatattttcaaacgcctttatcgtgtcgaaacttcgcgtaacatgaagacaggtggtcatggattaggacttgcgattgcgcgtgaattggcccatcaattgggtggggaaatcacagtcagcagccagtacggtctaggaagtacctttaccctcgttctcaatctctctggtagtgaaaataaagcctaa

SEQ ID NO: 2349 - DNA, 699 bp, Streptococcus pneumoniae
atgggaaagacaattttactcgttgacgacgaggtagaaatcacagatattcatcagagatacttaattcaggcaggttatcaggtcttggtagcccatgatggactggaagcgctagagctgttcaagaaaaaaccgattgatttgattatcacagatgtcatgatgcctcggatggatggttatgatttaatcagtgaggttcaatacttatcaccagagcagcctttcctatttattactgctaagaccagtgaacaggacaagatttacggcctgagcttgggagcagatgattttattgctaagccttttagcccacgtgagctagttttgcgtgtccacaatattttgcgccgccttcatcgtgggggcgaaacagagctgatttcccttggcaatctaaaaatgaatcatagtagtcatgaagttcaaataggagaagaaatgctggatttaactgttaaatcatttgaattgctgtggattttagctagcaatccagagcgagttttctccaagacagacctctatgaaaagatctggaaagaagactacgtggatgacaccaataccttgaatgtgcatatccatgctcttcgacaggagctggcaaaatatagtagtgaccaaacgcccactattaagacagtttgggggttgggatataagatagagaaaccgagaggacaaacatga

SEQ ID NO: 2350 - DNA, 372 bp, Streptococcus pneumoniae
ttggacaacatcgtagcaactaaaaaagtcactattaagataaatgttaaagaaacatcagacacagcaaatggttcattatcaccttctaactctggttctggcgtgactccgatgaatcacaatcatgctacaggtactacagatagcatgcctgctgacaccatgacaagttctaccaacacgatggcaggtgaaaacatggctgcttctgctaacaagatgtctgatacgatgatgtcagaggataaagctatgctaccaaatactggtgagactcaaacatcaatggcaagtattggtttccttgggcttgcgcttgcaggtttactcggtggtctaggtttgaaaaacaaaaaagaagaaaactaa

SEQ ID NO: 2351 - DNA, 2673 bp, Streptococcus pneumoniae
atgaaattcaatccaaatcaaagatatactcgttggtctattcgccgtctcagtgtcggtgttgcctcagttgttgtggctagtggcttctttgtcctagttggtcagccaagttctgtacgtgccgatgtggtcaatccgaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaaactcttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaggtagacttaaatggcaatactgttggtaaacaaggtcaagctttaattgatcaacttcgcgctaatggtactcaaacttataaagctactgttaaagtatacggaaataaagacggtaaagctgacttgactaatctagttgctactaaaaatgtagacatcaacatcaatggattagttgctaaagaaactgtcgaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaggacagtatcgatgttccagcagcctacttagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggtgacgctaaaaacccagctctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagatttggacaacatcgtagcaactaaaaaagtcactattaacataaacggtttaatttctaaagaaacagttcaaaaagccgttgcagacaacgttaaggacagtatcgatgttccagcagcctacctagaaaaggccaagggtgaaggtccattcacagcaggtgtcaaccatgtgattccatacgaactcttcgcaggtgatggtatgttgactcgtctcttgctcaaggcatctgacaaggcaccatggtcagataacggcgacgctaaaaacccagccctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaagacagtattgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggtgaaaacgtgaagaccaaaggtcaatacttctatcaattagccttggacggaaatgtagctggcaaagaaaaacaagcgctcattgaccagttccgagcaaatggtactcaaacttacagcgctacagtcaatgtctatggtaacaaagacgtaaaccagacttggacaacatcgtag

SEQ ID NO: 2352 - DNA, 570 bp, Streptococcus pneumoniae
ttgatagacgacattggacagtttgcgatctggcaagacagaatgtttggtcaaacggctcaacatggtcttacgaatagcctgaaagacttctggatttttctgctgaatataggtccacaattggcgtttttttgccagatgctccgttgttccagatcggttgagcagggtactggaaatcaccgtcgtgatttcaatatgattcagcagatattctcgcattttgggatgactcacttgggacaaatcaagttggtctaccaagagtcgattgaccttgagttgctggtcaatgcacttaatcatcacttgctcattgacagactggtcctcacgcccaatcaaataacgatagaaatcgacaggcagatagtacatggtcttgacctgctgaaggggcgtaaagacaaagagattatcgacataaaaagtatgttcaggcagttagaactggctagcacgcaacaaatctgtccgataaatcagcgagtgcatcatggtatactggcctttggagaaatttccgacctggtcccagccaaaaatctgccgaacaggcaagactga

SEQ ID NO: 2353 - DNA, 411 bp, Streptococcus pneumoniae
atgtactatctgcctgtcgatttctatcgttatttgattgggcgtgaggaccagtctgtcaatgagcaagtgatgattaagtgcattgaccagcaactcaaggtcaatcgactcttggtagaccaacttgatttgtcccaagtgagtcatcccaaaatgcgagaatatctgctgaatcatattgaaatcacgacggtgatttccagtaccctgctcaaccgatctggaacaacggagcatctggcaaaaaaacgccaattgtggacctatattcagcagaaaaatccagaagtctttcaggctattcgtaagaccatgttgagccgtttgaccaaacattctgtcttgccagatcgcaaactgtccaatgtcgtctatcaaatcaccaaatctgtttatggatttaattaa

SEQ ID NO: 2354 - DNA, 537 bp, Streptococcus pneumoniae
atgaagttattgtctatcgccattcccagctataatgcagcagcctatcttcattactgtgtggagtcgctagtgattggtggtgagcaagttgggattttgattatcaatgacgggtctcaggatcagactcaggaaatcgctgagtgtttagctagcaagtatcctaatatcgttagagccatctatcaggaaaataaatgccatggcggtgcggtcaatcgtggcttggcagaggcttctgggcgctattttaaagtagttgacagtgatgactgggtggatcctcgtgcctacttgaaaattcttgaaaccttgcaggaacttgagagcaaaggtcaagaggtggatgtctttgtgaccaattttgtctatgaaaaggaagggcagtctcgtaagaagagtatgagttacgattcagtcttgcctgttcggcagatttttggctgggaccaggtcggaaatttctccaaaggccagtataccatgatgcactcgctgatttatcggacagatttgttgcgtgctagccagttc

SEQ ID NO: 2355 - DNA, 666 bp, Streptococcus pneumoniae
atgtcagatcgtacgattggaattttgggcttgggaatttttgggagcagtgtcctagctgccctagccaagcaggatatgaatattatcgctattgatgaccacgcagagcgcatcaatcagtttgagccagttttggcgcgtggagtgattggtgacatcacagatgaagaattattgagatcagcagggattgatacctgcgataccgttgtagtcgcgacaggtgaaaatctggagtcgagtgtgcttgcggttatgcactgtaagagtttgggggtaccgactgttattgctaaggtcaaaagtcagaccgctaagaaagtgctagaaaagattggagctgactcggttatctcgccagagtacgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaagtacaatctgaatattttgggtttccgagagcaggaaaattccccattggatgttgaatttggaccagatgacctcttgaaagcagatacctatattttggcagtcatcaacaaccagtatttggataccctagtagcattgaattcgtaa

SEQ ID NO: 2356 - DNA, 1380 bp, Streptococcus pneumoniae
atgttattcaaattatctaaggaaaaaatagagctaggcttatctcgtttatcgccagcccgtcgtatttttttgagttttgccttggtcattttactaggctctcttcttttgagcttgccctttgtccaagttgaaagctcacgagcgacttattttgatcatcttttcactgctgtctctgcagtctgtgtgacaggtctctcaacccttccagtagctcacacctataatatatggggccaaataatctgtttgctcttgattcagatcggtggtctagggctcatgacctttattggggttttctatatccagagcaagcaaaagcttagtcttcgtagccgtgcaactattcaggatagttttagttatggagaaactcgatctttgagaaagtttgtctattctatttttctcacgacctttttggttgagagcttgggagctattttgcttagttttcgccttattcctcaacttggctggggacgtggtctttttagttccatttttctagcgatctcagccttctgtaatgccggttttgataatttagggagcaccagtttatttgcttttcagaccgatttactggtcaatctggtgattgcaggcttgattattacaggcggccttggttttatggtctggtttgatttggctggtcatgtaggaagaaagaaaaaaggacgtctgcactttcatacgaagcttgtactattgttgactataggtttgttgttatttggaacggcaactactctctttcttgagtggaacaatgctggaacgattggcaatctccctgttgccgataaggttttagttagcttttttcaaacagtgacgatgcgaacagctggcttttctacgatagattatactcaggctcatcctgtgactcttttgatttatatcttacagatgtttctaggtggggcacctggaggaacagctgggggactcaagattacgacattttttgtcctcttggtctttgcacgaagtgagcttctaggcttgcctcatgccaatgttgcgagacgaacgattgcgccgcgaacggttcaaaaatcctttagtgtctttattatctttttgatgagcttcttgataggattgattctgctagggataacagccaaaggcaatcctccctttatccacctcatatttgaaaccatttcagctcttagtacagttggtgtaacggcaaatctgactcctgaccttgggaaattggctctcagtgttatcatgccacttatgtttatgggacgaattggtcccttgaccttgtttgttagcttggcagattaccatccagaaaagaaagatatgattcactatatgaaagcagatattagtattggttaa

SEQ ID NO: 2357 - DNA, 186 bp, Streptococcus pneumoniae
atgttactgacttcgtcagttctatctgcaacctcaaaacagtgttttgagctgacttcgtcagttctatccacaacctcaaaacagtgttttgagcaacctgtgactagctttctaagcgatgccttggttctcattgcctataatcaaaaagagaaattttctcctgaaaagcatatagagtag

SEQ ID NO: 2358 - DNA, 765 bp, Streptococcus pneumoniae
atgattcagaaacatgcgattcctattttagagtttgatgacaatcctcaggcggttatcatgcccaatcacgaggggctggacttgcagttgccaaagaagtgtgtttatgcatttttaggtgaggagattgaccgctatgcaagggaagtaggggcggattgtgtcggcgaattcgtttctgctaccaagacctatccagtctatgtcatcaactacaagggtgaggaggtctgtctggctcaggctcctgttggctccgctccagcagcccagtttatggattggttgattggctatggtgtggagcagattatctctactgggacctgtggtgtcctagctgatatagaggaaaatgcctttctagtccctgttcgcgctttgcgagatgagggagccagttaccactatgtggcaccttgtcgttatatggaaatgcagccagaggctattgctgctattgaggaagttttggaagacagagggattccttatgaagaagtcatgacctggacgacagacggtttttaccgagaaacggctgaaaaggtggcttatcgtaaggaagaaggctgtgctgttgtggagatggagtgttctgctcttgcggcagtagctcaattgcgtggggttctctggggtgaattgttgttcacagcagattctctagcggacttggaccagtacgacagtcgtgactggggctcggaagcttttaataaggcgctagaactgagtttagcaagtgttcaccacctttag

SEQ ID NO: 2359 - DNA, 189 bp, Streptococcus pneumoniae
caaagtgtcaaggaggaaactgatgaactggacaaaaaacaagcctacatcgtcagctgccacagtggtttgcgcagctatatcgcagagcctatcctcaagcaagcaggatttaccgcccaaaaccttgacggcgcttattcactatacaaaatggttaacccagaaggagtagaatatggaaactag

SEQ ID NO: 2360 - DNA, 297 bp, Streptococcus pneumoniae
atggaaactagtatcagcatggctgacttttatggaaaataccaaaatgaaaatctagaacttatcgatgtccgtgaagcacatgaattccaagcaggacatgcaccaggtgccaaaaatcttccattaagtaccttagagcaaggctacaaagaactcaaacctgaccatgaatactatgtcatttgtcaaggaggagtccgctctgcatctacctgccagtttctcagctcccaaggcctcaccgttaccaacgtagaaggtggtatgaatgcttggcccggtcaagtagaataa

SEQ ID NO: 2361 - DNA, 363 bp, Streptococcus pneumoniae
atgaaaatcaaagtgcaaactaggaagttagccgcaggctgctcaaaacactgttttaaggttgtggatggaactgacgaagtcagctcaaaacactgttttgaggttgtggatagaactgacgaagtcagtaaccatatctacggcaaggtgaagctgacgtggtttgaagagattttcgaagagtataagtctctacataataaaacgcatattaccaaggttcttatgaactgcaccccaaaagttagacagaaaaaatctaacttttgggggtcagtacattcaacacctgatactatgcgtttttttaattttaaagattttttacaacttcttttgactcacattaaactattctaa

SEQ ID NO: 2362 - DNA, 294 bp, Streptococcus pneumoniae
agatataatgaagaaaaatcgagcaaggaaaaagaactgacaaattcaaagtatattacttgtttgaaacgttcagagggccagttgtgtgggattcaaaagatgattgaaggagatcgtgactgtgctgatattgtgacgcaactgacagcagtgaaatctagtgtagagcgcgtgattgagatgataattaccgaaaatcttactgaatgtatcaatcagcccctagatgattctgaagctcaaaaggaacgcctagaaaaggctatccgatacttgattaaacggaaataa

SEQ ID NO: 2363 - DNA, 243 bp, Streptococcus pneumoniae
ttgggggaaagagtagagccggttatcctggcagaaggtacaagaatggggcatattcatctttccgtcaaggatagtcgaaagtccagccagttttatcaaaaggtgttagggctagagaataaattcagtgtgcctggcgctagttggattgcggctggagattaccatcatcatttagcagttaacgaatggggaggaaaaggtctggcttcgcgtaagcaaggcttaccaggtttagcc

SEQ ID NO: 2364 - DNA, 396 bp, Streptococcus pneumoniae
atgacctatgaatacaagagtcacatttatttggcagagacagctttaaatgtaaaggatttggccagtcaaacagccttttatcagcaagttattggtttagaaatcttatctcaaactgagacagagtccattctaggccttggtggaaaagtcttggtacagctgattcaagcacaagagagcggagaagtgagggaatattatggtctttaccatttggccattctcttgcccacacgcaaggctttagctgatgtcttgaaacacctgacagatttacaaattcctcttgtcggcggtgcagaccatggttacagtgaagctatttacttggaagatttggagggaaatggcattgaactctatcgagataagccattttccacatggtga

SEQ ID NO: 2365 - DNA, 1038 bp, Streptococcus pneumoniae
atgaaagcatacacagagcgtgtatttggaaatgttgagggtgaggatgtcttggcctatcgatttgagacagacggtggctaccaacttgaggttatgacttatggtgcgactatcttgcgctatgtcgcacctgacaaggctggaaattttgccaatgttatcttgggatttgatgactttgatagttatgtaggcaatagtcccaagcatggagcaagtgtaggtcctgtagcgggtcgtattgcaggtgcgacctttgagctcaatggtaagacctatgaccttgaggttaataatgctagcaactgtaatcacagtggttcaactggttgggattccagcttgtttgaagttgaagaagtaagcgatcatggcttgactctctacacagagcgtacagatgggacaggagggttccctggaaatctcaagatttggatcagttatcacttggaagaaactggtgcctatgaaatcagctacaaggtaacgaccgatcaggatacgctggtcaatccaaccaaccacagctatttcaacttgtctggtgatttcacgcagacgattgaccgtcatgtcttccaactaaacacagagggcatttactcaatcgctcctgacggtgttcctgccaaaactccagaagccaaccgtgatgtggtcaaacacgtctacaatggtaccttgttgaaggatatctttgcagaagaagatgagcaaatccagctggcatcaggtttggatcatccatttgcccttcctgcaggccatgacaatgctggattcctttatgaccaaaattcaggtcgcttcctgcttttcaagacagaagctccttgctttgtggtctacacagcaaactttgtggatgaaagtgtcatcataggaggtcagccaatgctacagcacaatgggattgctcttgaagcgcaagctttaccagatgccattcacagtgaccttaaaggccaagtcattcttaaagctggtcaaaccttcaccagtaagacacgttatgaacttgttgtgaaataa

SEQ ID NO: 2366 - DNA, 459 bp, Streptococcus pneumoniae
gtgattacagttgctagcattattaacctcaaggtcataggtcttaccattgagctcaaaggtcgcacctgcaatacgacccgctacaggacctacacttgctccatgcttgggactattgcctacataactatcaaagtcatcaaatcccaagataacattggcaaaatttccagccttgtcaggtgcgacatagcgcaagatagtcgcaccataagtcataacctcaagttggtagccaccgtctgtctcaaatcgataggccaagacatcctcaccctcaacatttccaaatacacgctctgtgtatgctttcattctgttctccttttactatttctctcaagcaaacaaaccatagaaagcgtactgacaatctatggtttatctgataatttacaaatcctcttgtcaagaattcataaacactgtcttacttttgatattcgtgaattatga

SEQ ID NO: 2367 - DNA, 1167 bp, Streptococcus pneumoniae
atgctacattatacaaaagaagacttgctcgaattgggtgcagaaatcactacgcgtgaaatctaccaacaacctgatgtatggagagaagcttttgaattttatcaagcaaaacgtgaagaaattgcagccttcctacaagaaatcgctgataaacatgactatattaaggttatcttgacaggtgctgggacttctgcttatgtgggagacaccttgctaccttactttaaggaagtctatgacgaacgcaaatggaatttcaatgctattgcgacaacagatatcgttgccaatccagcaacctatttgaaaaaagatgtggcaactgtccttgtgtcttttgctcgtagtgggaactcgcctgaaagtgtggcgactgttgatttggccaaatccttggtggatgagctttatcaagtgacgattacttgtgcagcagatggtaaattggctcttcaagctcacggtgatgaccgtaatctcttgctcttgcaaccagctgtctctaatgatgctggatttgccatgacttctagctttacgtctatgatgttgacaactctcttggtctttgatcctacagaatttgctgttaagtctgaacgttttgaagttgtatctagtcttgcccgtaaagttttagacaaggcagaagatgtcaaagagctcgttgatttagactttaaccgtgtcatctatctaggcgctggtcctttctttggacttgctcatgaagctcagctcaagattttggaattaactgctggtcaagttgcgaccatgtatgaaagcccagttggcttccgtcacggtccaaaatctcttatcaacgaaaatacagttgttttggtctttggtacaaggacagactacactcgtaagtacgacttggacttggttcgtgaagttgctggtgaccagattgctcgtcgtgttgtgcttttgagtgatcaagcttttggtcttgaaaatgtcaaagaagtggcccttggttgtggcggtgtcttgaatgatatttaccgtgtcttcccttacatcgtttatgcccaactctttgccctattgacttcactcaaggtagaaaataaaccagatacaccgtctcctacaggtacagtaaaccgtgtagtacaaggtgtcataattcacgaatatcaaaagtaa

SEQ ID NO: 2368 - DNA, 249 bp, Streptococcus pneumoniae
cttcgtcagtcttatccggcaacctcaaagcagtgctttgagcagcctgcggctagtttcctacagattttagttggaactcgattcaattcatgtgacaacgtgaaaatcgttagagcattttatatagaatatacatgggaatggagcttactcccattcccatatttaatagaaaaagaggaactcaatgctacattatacaaaagaagacttgctcgaattgggtgcagaaatcactacgcgtga

SEQ ID NO: 2369 - DNA, 405 bp, Streptococcus pneumoniae
atgactaaatcattaattttggtgagccatggtcgcttctgtgaggagcttagaggtagcacagaaatgattatgggcctacaagacaacatttacacagtagctcttcttccagaagatggcccagaagaatttactgctaaatttgaagctgttattgaaggattggatgatttcctagtttttgcggatcttctcggtgggacaccttgtaatgtggtgagtcgcttgatcatggaaggtcgtgatattgacctttacgcagggatgaatcttccaatggtgattgaatttatcaatgcgagccttacaggcgcagatgcggactacaagagccgtgctgcagaaagcattgtgaaagttaatgacctgttagcgggcttcgatgatgacgaagatgaataa

SEQ ID NO: 2370 - DNA, 831 bp, Streptococcus pneumoniae
gtggggaaatcgaagatgacgaattctaattacaaacttacaaaagaagattttaatcaaatcaacaaacgtagcttgtttactttccaattaggttggaactacgaacgtatgcaagcttctggttacctttacatgatcttgcctcagttgcgtaaaatgtatggtgatggaactcctgaattgaaagaaatgatgaaagttcatactcaattcttcaatacttcaccattcttccataccattatcgctggttttgaccttgccatggaagaaaaagatggtgtaggttcaaaagacgccgttaacggtatcaagacaggtttgatgggaccattcgctcctcttggggatacaatctttggttcacttgtacctgctatcatggggtcagtcgcagcaactatggctatcgctggccaaccttgggggatcttcctttggattgcagttgcagtagcgtatgacatcttccgttggaaacagttggaatttgcttacaaagaaggggttaaccttatcaacaacatgcaaagtaccttgacagctttgattgacgctgcatccgtacttggtgtcttcatgatgggtgctcttgtagcaacagtgattaactttgaaatttcttacaagttgccaatcggtgaaaagatgattgatttccaagacatcttgaaccaaatcttcccacgtttgcttccagcaatctttactgcctttatcttctggttgcttggtaagaaaggtatgaactctactaaagctatcggtattattatcgtacttgctttggctctttctgcccttggtcactttgcacttggaatgtaa

SEQ ID NO: 2371 - DNA, 906 bp, Streptococcus pneumoniae
atgatacaatggtggcaaattttacttctcactttgtactcagcttatcaaatctgtgatgagttgacgatcgtttcatctgcaggttcccctgtatttgctggtttcattactggtttaatcatgggagatgtgactactggtttacttatcggtggtaacttgcaactgttcgttcttggggttggtaccttcggtggtgcttctcgtatcgacgcaacttctggtgcggttcttgcgacagccttctctgtttcacaaggaattgatgcaccgcttgcaattactacaatcgctgtaccagtagcagctctcttgacttacttcgacgttcttggtcgtatgactactaccttctttgctcaccgtgtggatgctgcaatcgaacgctttgactataaaggtattgaacgcaactacttgcttggtgcgattccgtgggctctatctcgtgcccttccagtcttctttgcccttgcttttggtggtgcctttgtacaatcagtagtagacttcgttgaagcctacaaatgggttgcagatggcttgacactcgcaggacgtatgcttccaggtcttggatttgcaatcttgcttcgttaccttccagttaaacgtaaccttcactaccttgctatgggatttggtttgacagctatgttgactgttctttactcatatgtaacaggtcttggtggcgctgttgctggtatcgtaggtactcttcctgctgaagttgctgaaaaaattggtttcgtgaacaacttcaaaggtttgtctatgattggtatttctatcgtaggtattttccttgcagtgcttcacttcaaaaatagccaaaaagtagctgtagcagcaccttctacaccatcagaaagtggggaaatcgaagatgacgaattctaa

SEQ ID NO: 2372 - DNA, 477 bp, Streptococcus pneumoniae
atgacaattgtaggatgccgtattgatggacgtttgatccacggacaagtagccaatctttgggctggaaaactaaatgtttcacgcattatggttgtagacgacgaagttgtcaacaacgatattgaaaagagtggtttgaaacttgcgacaccaccaggtgtgaaattgagtattttgccagttgagaaagctgcagccaatattcttgctggcaaatacgatagccaacgtctctttatcgtggctcgtaaaccagaccgcttccttggtttggtagaagcaggtgtaccacttgaaactcttaatgttgggaatatgtctcaaacaccagaaactcgttctattacacgttctatcaacgtagtagacaaggatgtggaagacttccacaaactggcagaaaaaggtgttaaacttactgctcagatggttccaaatgatccaatttcagactttttgagcttattaaaatag

SEQ ID NO: 2373 - DNA, 1527 bp, Streptococcus pneumoniae
ttgtgcgtccgtctccatttatctgtgcggaatgggaattcggtgggcttaccagcttggctcttgaccaagaacatgcgaattcgctcatccgacccaacatatatcgaggcagttggtcgctactatgatcagttattgccaagactggttcctcgtttgttggacaatggtggcaatattctcatgatgcaggttgaaaatgagtatggttcttacggagaagataaggcttacctgagagcgattcgacagctaatggaagagtgtggcgtaacctgtcccctctttacatcagatggtccatggcgagctactctgaaagctggaaccttaattgaggaggacctctttgtaacaggaaactttggttctaaggcaccttacaacttttcgcagaggcaggaattctttgatgaacatggtaagaaatggccactcatgtgtatggagttctgggatggttggtttaatcgctggaaagaaccgattatcacacgggatcctaaggaattggcagatgcagttcgagaggttttggaacaaggctctatcaatctttacatgttccacggtggtacaaactttggtttcatgaatggttgctcagctcgaggaactttggacctgccacaagttacgtcttatgattacgatgcccttctggatgaaaaaagaaatccaactgctaaatatcttgcagtcaagaagatgatggcaacacatttttcagagtatccgcagttggaaccactctacaaagagagtatggagttggatgctattccactagttgaaaaagtttctttgtttgaaaccttagatagcttgtcaagtcctgtagaaagtctctatcctcaaaagatggaggagctgggacaaagttatggctacctactttatcgaacagaaacaaactgggatgcagaagaagaaagacttcgtatcattgatggtcgagatagggcccagctgtatgtcgatggtcagtgggttaaaactcaatatcagacagagattggggaagatattttttatcaaggtaaaaagaaagggctatctaggttagatatcttgatagaaaatatggggcgtgtcaactatgggcataagttcttagcggatacgcaacgtaagggaattcggacaggggtctgtaaggatctgcatttcttactaaactggaaacactatccactcccactagacaatcctgagaaaattgatttttcaaaaggatggactcaaggacaaccagccttttacgcttatgactttacagtcgaagagccaaaagatacttacctagacttgtctgagtttggtaagggggttgcctttgtcaatgggcagaatctaggacgtttttggaacgttggcccaactctctcactttatatccctcatagctatctcaaggaaggtgccaaccgcatcattatctttgaaacagaaggtcaatataaagaagagattcatttaactcgtaaacctacactaaaacatataaagggggaaaacttatga

SEQ ID NO: 2374 - DNA, 393 bp, Streptococcus pneumoniae
atgacacgatttgagatacgagatgatttctatctcgatggaaaatcatttaagattttatctggtgccattcattattttagggttcctccagaggattggtatcattcgctctataacttgaaggctcttggttttaatacggtagagacttatgttgcttggaatttacacgagcctcgtgaaggtgagtttcattttgaaggtgatctggatttagagaaatttctccaaatagcgcaggatttgggtctctacgcaattgtgcgtccgtctccatttatctgtgcggaatgggaattcggtgggcttaccagcttggctcttgaccaagaacatgcgaattcgctcatccgacccaacatatatcgaggcagttggtcgctactatga

SEQ ID NO: 2375 - DNA, 717 bp, Streptococcus pneumoniae
atggcaattcccaaatatcaatacataaaagacgaattaaaaaataaaatcatctctgggcagtttagcagtggagataaattttacactgaagcagaactcatttcaatgtacgatgtcagctctatcacagttgttcgcgccttaaacgaccttgccaaagatggctatattgtccgccaacaaggaaaaggaaccttcgtttcacgtgcacgcaaacacaagcttgtagagttttcagatattgaactcttcaatgctaaagatgataaggtaactgttctttcaattgaacgcggaaacaagcttgtttacttggaaaaattgggtctacgcggcgatcaattctactacaagattgaacgtatccgcgaatcaaacggtgtcgtttatatctaccatacatcctacatcccagaacaatatatcaacgcaaattatccaaaccttgaatactatagttctatctataatcgtttcaagttagactaccacattcacatgaatgatgaacactttgaagaaatcaacgaaatagtctttccaactccagaacatgcggcttcagtcctcggagtcgatgaacatttccctactgtcctacaaactaaaatcaccaaactcgaatcaactggccaagttttagaatacagtgaaacttacaaacgatctgattactacaagattaaattcatctcatgtgaccatgatcactaa

SEQ ID NO: 2376 - DNA, 3912 bp, Streptococcus pneumoniae
atgaaacatgaaaaacaacagcgtttttctattcgtaaatacgctgtaggagcagcttctgttctaattggatttgccttccaagcacagactgttgcagccgatggagttactactactacagaaaaccaaccgaccatccatacagtttctgattcccctcaatcatccgaaaatcggactgaggaaacacctaaagcagagcttcaaccagaaactccagctactgataaggtagctagtcttccaaaaacagaagaaaaaccacaagaggaagttagttcaactcctagtgataaagcagaggtggtaactccaacttctgctgaaaaagaaactgctaataaaaaggcagaagaagctagccctaaaaaggaagaagcgaaagaggttgattctaaagagtcaaatacagacaagactgacaaggataaaccagctaaaaaagatgaagcgaaagcagaggctgacaaaccggaaacagaggcaggaaaggaacgtgctgcaactgtaaatgaaaaactagcgaaaaagaaaattgtttctattgatgctggacgtaaatatttctcaccagaacagctcaaggaaatcatcgataaagcgaaacattatggctacactgatttacacctattagtcggaaatgatggactccgtttcatgttggacgatatgagcatcacagctaacggcaagacctatgccagtgacgatgtcaaacgcgccattgaaaaaggtacaaatgattattacaacgatccaaacggcaatcacttaacagaaagtcaaatgacagatctgattaactatgccaaagataaaggtatcggtctcattccgacagtaaatagtcctggtcacatggatgcgattctcaatgccatgaaagaattgggaatccaaaaccctaactttagctattttgggaaggaatcagcccgtactgtcaatcttgacaacgaacaagctgtcgcttttacaaaagcccttatcgacaagtatgctgcttatttcgcgaaaaagactgaaatcttcaacatcggacttgatgaatatgccaatgatgcgacagatgctaaaggttggagtgtgcttcaagctgataaatactatccaaacgaaggctaccctgtaaaaggctatgaaaaatttattgcctacgccaatgacctcgctcgtattgtaaaatcgcacggtctcaaaccaatggcctttaacgacggtatctactacaatagcgacacaagctttggtagttttgacaaagacatcatcgtttctatgtggactggtggttggggaggctacgatgtcgcttcttctaaactactagctgaaaaaggtcaccaaatccttaataccaatgatgcttggtactacgttcttggacgaaacgctgatggccaaggctggtacaatctcgatcaggggctcaatggtattaaaaacacaccaatcacttctgtaccaaaaacagaaggagctgatatcccaatcatcggtggtatggtagctgcttgggctgacactccatctgcacgttattcaccatcacgcctcttcaaactcatgcgtcattttgcaaatgccaacgctgaatacttcgcagctgattatgaatctgcagagcaagcacttaacgaggtaccaaaagacctgaaccgttatactgcagaaagcgtcgcggccgtaaaagaagctgaaaaagctattcgctctctcgatagcaaccttagccgtgcccaacaagatacgattgatcaagccattgctaaacttcaagaaactgtcaacaacttgaccctcacgcctgaagctcaaaaagaagaagaagctaaacgtgaggttgaaaaacttgccaaaaacaaggtaatctcaatcgatgctggacgcaaatactttactctgaaccagctcaaacgcatcgtagacaaggccagtgaactcggatattctgatgtccatctccttctaggaaatgacggacttcgctttctactcgatgatatgaccattactgccaacggaaaaacctatgctagtgatgacgttaaaaaagctattatcgaaggaactaaagcttactacgacgatccaaacggtactacactaacacaggcagaagtgacagagctaattgaatacgctaaatctaaggacatcggtctcatcccagctattaacagtccaggtcacatggatgctatgctggttgccatggaaaaattaggtattaaaaatcctcaagcccactttgataaagtttcaaaaacaactatggacttgaaaaacgaagaagcgatgaactttgtaaaagccctcatcggtaaatacatggacttctttgcaggtaaaacaaagattttcaactttggtactgacgaatacgccaacgatgcgactagtgcccaaggctggtactacctcaagtggtatcaactctatggcaaatttgccgaatatgccaacaccctcgcagctatggccaaagaaagagggcttcaaccaatggccttcaacgatggcttctactatgaagacaaggacgatattcagtttgacaaagatgtcttgatttcttactggtctaaaggctggtggggatataacctcgcatcacctcaatacctagcaagcaaaggctataaattcttgaataccaacggtgactggtactacattcttggtcaaaaaccagaagatggtggtggtttcctcaagaaagctattgagaatactggaaaaacaccattcaatcaactagcttctaccaaatatcctgaagtagatcttccaacagtcggaagtatgctttcaatctgggcagatagaccaagcgctgagtacaaggaagaggaaatctttgaactcatgactgcctttgcagaccacaacaaagactacttccgtgctaattataatgctctccgcgaagaattagctaaaattcctacaaacttagaaggatatagtaaagaaagtcttgaggcccttgacgcagctaaaacagctctaaattacaacctcaaccgtaataaacaagctgagcttgacacacttgtagccaacctaaaagccgctcttcaaggcctcaaaccagctgcaactcattcaggaagcctggatgaaaatgaagtggctgccaatgttgaaaccagaccagaactcatcacaagaactgaagaaattccatttgaagttatcaagaaagaaaatcctaacctcccagctggtcaggaaaatattatcacagcaggagtcaaaggtgaacgaactcattacatctctgtactcactgaaaatggaaaaacaacagaaacagtccttgatagccaggtaaccaaagaagttataaaccaagtggttgaagttggcgctcctgtaactcacaagggtgatgaaagtggtcttgcaccaactactgaggtaaaacctagactggatatccaagaagaagaaattccatttaccacagtgactcgtgaaaatccactcttactcaaaggaaaaacacaagtcattactaagggcgtcaatggacatcgtagcaacttctactctgtgagcacttctgccgatggtaaggaagtgaaaacacttgtaaatagtgtcgtagcacaggaagccgttactcaaatagtcgaagtcggaactatggtaacacatgtaggcgatgaaaacggacaagccgctattgctgaagaaaaaccaaaactagaaatcccaagccaaccagctccatcaactgctcctgctgaggaaagcaaagctcttcctcaagatccagctcctgtggtaatagagaaaaaacttcctgaaacaggaactcacgattctgcaggactagtagtcgcaggactcatggccacactagcagcctatggactcactaaaagaaaagaagactaa

SEQ ID NO: 2377 - DNA, 390 bp, Streptococcus pneumoniae
atgatttccttgagctgttctggtgagaaatatttacgtccagcatcaatagaaacaattttctttttcgctagtttttcatttacagttgcagcacgttcctttcctgcctctgtttccggtttgtcagcctctgctttcgcttcatcttttttagctggtttatccttgtcagtcttgtctgtatttgactctttagaatcaacctctttcgcttcttcctttttagggctagcttcttctgcctttttattagcagtttctttttcagcagaagttggagttaccacctctgctttatcactaggagttgaactaacttcctcttgtggtttttcttctgtttttggaagactagctaccttatcagtagctggagtttctggttga

SEQ ID NO: 2378 - DNA, 1299 bp, Streptococcus pneumoniae
atgatcaaccgttactctcgccctgagatggcgaatatttggagtgaagaaaataaataccgtgcttggcttgaggtggaaatcctctctgacgaggcatgggctgagttgggggaaatccctaaggaagatgtggctttgattcgcaagaaggcggactttgacatcgaccgtattttggaaattgagcaggagacgcgccacgatgtggtggctttcacgcgtgcggtttctgagactcttggtgaagagcgcaagtgggttcactatgggttaacttctaccgacgtggtggatactgcttatggttacctctacaagcaggccaacgacatcatccgtcgtgaccttgaaaacttcactaatatcatcgctgacaaggccaaggagcacaagttcaccatcatgatggggcgtactcatggtgtgcacgctgagccgacaacctttggtcttaaattggcaacttggtacagcgaaatgaaacgcaatatcgagcgtttcgagcatgcagctgctggtgtagaagctggtaagatttctggtgcggttgggaactttgccaatatcccaccatttgtagaggagtatgtctgcgataaacttggcatccgtgcccaagaaatctctacacaagtccttcctcgtgaccttcacgctgagtactttgcggttcttgccagcattgcgacttcaatcgaacgtatggcgactgagattcgtggtctacaaaaatctgagcaacgcgaagtagaagagttctttgctaaagggcaaaaaggatcttcagcaatgcctcacaaacgcaacccaatcggttctgaaaatatgactggtctggcgcgtgtcattcgtggtcacatgattacggcttatgaaaacgtcgctctctggcacgaacgcgatatttcccactcatcagctgagcgtatcatcacaccagatacgaccattttgattgactacatgctcaaccgttttggaaatatcgtcaagaacttgacagtcttcccagaaaatatgatccgaaacatgaactcgacttttggtcttatctttagccaacgggctatgttgacattgattgaaaaaggcatgacccgtgagcaagcctatgacttggtgcaaccaaaaacagcctactcttgggacaaccaagtagactttaaaccacttcttgaggcagattcagaagtaacatcacgtctcactcaagaagaaatcgatgaaatcttcaacccagtttattacaccaaacgagtggatgatatctttgaacgtcttggactaggtgattaa

SEQ ID NO: 2379 - DNA, 228 bp, Streptococcus pneumoniae
atgatacaaattatcgttaatacatttattgaaaaggataggactggagcagttgttgaagtgttgtatgccagtgctgaccaagataaggtacaagctaaatatgaagaactagctgcacaataccccgaaaattatttagctatctatgatgtaccgctggatacggatttgaatacactagatcattacccgtctgtgtttattgaaaaagaggagtttgagtag

SEQ ID NO: 2380 - DNA, 1152 bp, Streptococcus pneumoniae
ttgcggatgcacttgccaactttgctgaagaacaaggaaaaatcgcagaggagtcgtcaaatgagctcatctaaaacaatcggaattatcggtggcggtcaactgggtcagatgatggccatttctgctatctacatgggccacaaggttatcgcgctggatcctgcggcggattgcccggcctctcgcgtggcggaaatcattgtggcaccttataacgatgtggacgccctccgtcagttggcagaccgttgcgatgtcctcacttatgagtttgaaaatgtcgacgctgacggtttggatgccgttatcaaggatggacaactccctcaaggaacagatctgctccgcatttcgcaaaatcgtatttttgaaaaggactttttgtcaaacaaggctcaagtcactgtggcaccctacaaggtcgtgacttctagcctagacttggcagatatcgacttgtcgaaaaactatgtcctcaagactgcgactggtggctacgatggtcatggacaaaaggttattcgttcagaagcagacttggaagcagcctatgcgctagcagactcagcagactgcgtcttggaagaatttgtcaactttgaccttgagatttctgtcatcgtgtcaggaaatggcaaggaggtgacgtttttcccagttcaggaaaatatccaccgcaacaatatcctgtctaagaccatcgtaccagcccgcatttctgaaagtctagtagacaaggctaaagctatggcagtgcgaatcgcagaacaactcaacttgtctggaactctctgtgtggaaatgtttgcgactgatgatgacgttattgtcaatgaaatcgccccacgaccacataactctgggcactattctattgaagcctgtgatttctctcagtttgacacccatattctcggtgttctcggagcaccattaccagtcatcaaactccatgcgccagccgttatgcttaatgtcctcggtcagcatgtcgaggctgctgagcaatatgtgacagaaaattcaagcgcccacctccacatgtatggtaaaatagaagcgaagcacaaccgcaagatgggacatgtgaccttgtttagtgatgtaccggatagtgtggatgagcttggggaagggattgatttttag

SEQ ID NO: 2381 - DNA, 465 bp, Streptococcus pneumoniae
atgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaa

SEQ ID NO: 2382 - DNA, 1263 bp, Streptococcus pneumoniae
atgaaactgcttgttgtcggttctggtggtcgtgagcatgcgattgctaaaaagttacttgaatcaaaagacgtggaaaaagtctttgtagctcctgggaatgatgggatgactctggatggtttggaattggtaaatatctctatttccgaacattctaaattgattgacttcgcaaagaccaatgatgttgcttggacctttatcggtccagatgatgcccttgctgctggcatcgtggatgattttaaccaagctggacttaaggcctttggtccgactagggctgcagcggagctggagtggtccaaggatttcgccaaggaaatcatggtcaaatacggcgttccgacagcaatatatggcacattttcagatttcgaggaagccaaggcctatatcgaaaagcatggtgcgcctatcgtagtcaaggcggatggcttggcacttgggaagggtgtcgtcgttgctgagacggttgagcaagcggtcgaagccgctcatgagatgcttttggacaataaatttggtgactcaggtgcgcgcgtggttattgaggaattccttgaaggagaggaattttcactctttgcctttgtcaatggtgataagttctacatcatgccaacggctcaggaccacaaacgtgcctatgatggcgacaaagggcctaacacgggtggtatgggtgcctatgcgccagttccacacttaccacagagtgtagttgatacagcggttgacaccattgtcaagccagttctagaaggggtgattaaagaaggtcgtccttatctgggagttctttacgcagggcttatcctgacagctgatggaccgaaggtcatcgagttcaacgctcggttcggagatccagaaactcagcttatcttgcctcgcttaacctctgactttgctcaaaatatcacagatatcctggatagcaaggagccaaatatcacgtggacggacaagggtgtgactctgggtgtggttgtcgcatccaagggctacccgctagattattcaaagggtgttgagttgccagtcaaaaccgatggcgacatcattacctactatgcaggggctaagtttgcggaaaatagcagagcactgctctcaaacggcggacgagtttatatgctcgttaccacagcagataccgtcaaagaagcccaagccagcatctaccaagaactatcccaacaaaaaatagaaggactcttctaccgaacagatatcggaagcaaggcaattaagtaa

SEQ ID NO: 2383 - DNA, 681 bp, Streptococcus pneumoniae
ttggcttcctcgaaatctgaaaatgtgccatatattgctgtcggaacgccgtatttgaccatgatttccttggcgaaatccttggaccactccagctccgctgcagccctagtcggaccaaaggccttaagtccagcttggttaaaatcatccacgatgccagcagcaagggcatcatctggaccgataaaggtccaagcaacatcattggtctttgcgaagtcaatcaatttagaatgttcggaaatagagatatttaccaattccaaaccatccagagtcatcccatcattcccaggagctacaaagactttttccacgtcttttgattcaagtaactttttagcaatcgcatgctcacgaccaccagaaccgacaacaagcagtttcattcctcaacctcttttgcgaattatttaccaacattatatcaaaaaagttcgttttaatcttgtttcagttagcattttaagccaaaaaaggaaagaaactgttttcttcccttttatcttcttaatgtctaaaatgtctcacacctgtaaagaccatagtcaagccgtatttatccgctgcttcgatggattcttggtcacggacagagccaccgggctggatgatggccttaattcctgctttggcgatttcttccacgttatccgcaaatgggaagaaggcatctga

SEQ ID NO: 2384 - DNA, 1569 bp, Streptococcus pneumoniae
atgattaaaaaggagaatataatgactaaacgcgtcttaatcagcgtctcagacaaagcgggcattgttgaatttgcccaagaactcaaaaaacttggttgggagattatctcaacaggtggaactaaggttgcccttgataatgctggggtggataccattgctatcgatgatgtgactggtttcccagaaatgatggacggtcgtgtgaagaccctccacccaaatatccacggagggcttctcgctcgtcgtgacttggatagccacttggaagcggctaaggacaacaagattgagctcattgaccttgtggtggtcaacctttacccatttaaggaaactatccttaaaccagatgtgacttatgctgatgcagttgaaaatatcgatattggtgggccgtctatgcttcgttcagcagcgaaaaatcatgccagtgttacagttgtggtagatcctgctgactacgctgtggttttggacgaattggcagcaaacggcgaaacctcttatgaaactcgccaacgtttagcagccaaagtatttcgtcacacagcggcttatgacgccttgattgcagaatacttcacagctcaagtgggtgaaagcaagcctgaaaaactcactttgacttatgacctcaagcaaccaatgcgttacggtgagaatcctcaacaagacgcggacttttaccagaaagctttgcctacagattactctattgcttcagccaaacagctcaacgggaaagaattgtcatttaataatatccgtgatgcagatgctgctatccgtatcatccgtgacttcaaagatagtccaaccgttgtggctctcaaacacatgaatccatgtggaattggtcaagctgatgacatcgagactgcttgggactacgcttatgagtctgacccagtatctatctttggtgggattgtcgtcctcaaccgtgaggtggatgctgcgacagctgagaagatgcacggcgttttcctcgaaatcatcattgcaccaagctatacggatgaagcgctagccattttgatcaataaaaagaaaaacttgcgtatccttgccttgccatttaatgctcaagaggctagcgaagtggaagcagaatacacaggtgtagtcggtggacttctcgtgcaaaatcaagacgtggtcaaggaaagcccagctgactggcaagtggtgaccaaacgtcagccaactgagacagaagcgactgctcttgagttcgcttggaaggctatcaagtacgtcaaatcaaatggtattatcgtgaccaacgaccacatgacacttggtgttggtccaggtcaaaccaaccgtgtggcttctgttcgccttgccattgaccaagccaaagatcgtctggacggggcggtccttgcttcagatgccttcttcccatttgcggataacgtggaagaaatcgccaaagcaggaattaaggccatcatccagcccggtggctctgtccgtgaccaagaatccatcgaagcagcggataaatacggcttgactatggtctttacaggtgtgagacattttagacattaa

SEQ ID NO: 2385 - DNA, 510 bp, Streptococcus pneumoniae
atgttagaatctaaaaaaacaactcgatatgtattttatgtctatctgatgttattaacttggggaatcttatttaagtttgaaacaaatcctgaatttatagcatttttcttagctccaaggtatatcaattggattccattttcagaaccactaatagtcgatggaaaaattgtttttgctgaaatgttatttaatctgattttctttattccattaggtgtttgtttccctttgataaaaactaatttatctagtttaagaatagtcgggacaggtttcttgattagtttattgtttgagtgcttacagtatattttagcaataggtataacagatataacggatttgactttaaatacgctaggtgtctgtgtaggcttactgatttatcaaatttttataagagtgttcaaatcacagactagaaaatggatcaatatcttaggtatgcttagccttggttttgcttatcttgttttactgttactgcatttaattggtgtttaa

SEQ ID NO: 2386 - DNA, 348 bp, Streptococcus pneumoniae
atcagtaagcctacacagacacctagcgtatttaaagtcaaatccgttatatctgttatacctattgctaaaatatactgtaagcactcaaacaataaactaatcaagaaacctgtcccgactattcttaaactagataaattagtttttatcaaagggaaacaaacacctaatggaataaagaaaatcagattaaataacatttcagcaaaaacaatttttccatcgactattagtggttctgaaaatggaatccaattgatataccttggagctaagaaaaatgctataaattcaggatttgtttcaaacttaaataagattccccaagttaataacatcagatag

SEQ ID NO: 2387 - DNA, 546 bp, Streptococcus pneumoniae
atgaaaaaaatagcggtttttgcctctggtaatggctcaaattttcaggtgattgccgaagaatttccagtggagtttgtcttttcagaccatcgtgatgcctatgtgcttgagcgtgcaaagcagctcggcgttctgtcctatgcttttgaactcaaggagtttgagagcaagacagactacgaagcagcccttgtcgaactcttggaagaacaccagattgacttggtttgcctagcaggctacataaaaatcgttggaccaaccttattgtcggcttatgaaggtcggattgtcaacattcatccagcctacttgccagaatttccaggagctcatgggattgaggatgcttggaatgctggcgtgggtcagtctggtgtgaccattcactgggtggattcgggtgtggatacaggccaggtcatcaaacaggttcgtgtgccacgactagctgatgataccattgacagatttgaagctcgcatccatgaagcagagtacaggttgtatccggaagtagtgaaggctctatttacagattga

SEQ ID NO: 2388 - DNA, 1023 bp, Streptococcus pneumoniae
atgacaaataaaaatgcatatgcccagtcgggtgtggatgttgaagcgggttatgaagttgttgaacggattaaaaagcacgtggcccgtacggagcgtgcaggtgtcatgggagctcttggtggctttggtggtatgtttgacctttccaagactggggttaaagaacccgtcttgatttcagggactgacggtgtcggaaccaagctcatgttggctatcaagtacgacaagcacgataccatcgggcaggactgtgtggccatgtgtgtcaacgacatcattgctgcaggtgcggaacccctctattttctcgactacgtagcgacagggaagaatgaaccagctaagctagaacaagtggttgctggtgtggcagaaggttgtgtgcaggctggtgctgccctcatcggtggggaaacggctgaaatgccgggcatgtacggcgaagacgactatgacttggctggttttgcggtcggtgtggctgaaaaatctcaaatcattgacggttcaaaggtggtagagggagatgttcttctcggacttgcttcaagtgggattcactcaaatggttactctttggttcgtcgtgtctttgcggattacacaggtgaggaagtcctaccagaattggaaggcaagaaacttaaggaagttctacttgagccgactcgtatctatgtcaaggctgtcttgccgctcatcaaagaagagttggtcaacggcattgcccacatcacaggtggtggctttatcgaaaatgtccctcgtatgtttgcagatgacctagctgctgaaattgatgaaagcaaagttccagtgcttccaattttcaaagcccttgaaaaatatggtcagattaaacacgaagaaatgtttgaaatcttcaatatgggtgtgggacttatgttggcggtcagccctgaaaatgtagagcgtgtaaaagaattgttggatgaagcagtctatgaaattggtcgcatcgtcaagaaagaaaacgaaagtgtcattatcaaatga

SEQ ID NO: 2389 - DNA, 1443 bp, Streptococcus pneumoniae
atgacatacgaagtaaaatctcttaatgaagaatgtggtgttttcggtatttggggacatccagatgctgctaagttgacctattttggactccacagtcttcaacaccgtggtcaggagggggcaggaatcctctccaacgatcaaggacaactgaagcgccatcgtgacatggggcttttatcagaagttttcagaaatccagctaatttggataaattgacaggagctggtgcgattgggcatgtgcgttatgcgactgctggcgaagcttctgtagataacatccagcccttcctcttccgttttcacgatatgcagtttggcttggctcataatggaaatctgaccaatgcagcctctctcaagaaagaattggaacaaagaggagcaattttcagcgcgacttcggactctgaaatcttggctcacctcattcgtcgcagtcataatcctagcctgatgggcaaaatcaaggaagcgctcagccttgtcaaaggtggttttgcctatatcttgctgtttgagaacaagttgattgcggctcttgaccctaatggctttcgtccgctttctatcgggaaaatggccaacggagcggtggttgtttcctctgaaacctgtgcttttgaggtcattggtgccgagtggattcgtgatttgaagccaggtgagattgtgatcattgatgacgagggcattcagtatgacagctatacagatgatacccagttggcgatttgttctatggagtatatctactttgcccgccctgattctaatatccacggtgtcaatgtccatacggcacgtaagagaatgggagcgcaattggcgcgagaatttaagcatgaggcagatattgtagttggtgtgcccaattcttccctaagcgcggctatgggatttgcggaagaatcaggcttaccaaatgaaatgggtctgatcaaaaaccaatacacccagcgaacttttatccaaccgactcaagaattgcgggagcaaggagtgcggatgaaactgtctgctgtttcgggtgttgtcaaaggcaaacgtgtggtcatggtggatgattccattgtacgtggaacaacctctcgtcgtatcgttcagctcttgaaagaagcgggtgcgactgaggttcacgttgccattggaagtcctgcactagcgtatccatgtttctacgggattgatatccagacccgtcaggagctgattgcagccaatcatacggtcgaagaaactcgccaaatcattggtgcggacagtctgacttatctttcaattgatagcttgattgagtcgattggtatcgaaacagatgcgccgaacggtggtctctgtgtcgcttactttgacggtgactacccaacgcctctctatgactacgaagaagactatcgtagaagtttggaagaaaagaccagtttttacaagtag

SEQ ID NO: 2390 - DNA, 3729 bp, Streptococcus pneumoniae
ttgatggataaacgtatttttgttgaaaaaaaggctgattttcaggtcaagtcagagagtttggttagagagctccagcacaacttgggactgtcaagcttgaaaagtattcgtattgtgcaagtatatgatgtatttgacttggctgaggacttgtttgcacctgcagagaagcacattttctctgagcagggaaccgaccatgttttagatgaagtatctgtgcaggcggatcttgctaactatgctttctttgccattgaaagtctgccagggcagtttgaccagcgtgcagcttcgtcacaggaagccttgcttttgttgggaagttcgagtgacgtgacagtcaacacagcccaactttacttggtgaataaagatattgatgcgactgagttggaagctgtcaaaaactacctgctcaatccagttgattctcgtttcaaggatatcacgacagggattgccaagcaggagttttcagagtcagacaagaccattccaaaattgactttctttgaaagctatacagcagaagactttgctcgctacaaggccgagcaagggatggccatggaagtggatgatttgctctttatccaagactactttaagtcaatcgggcgcgtgccaactgagactgaactcaaggttttggacacttactggtctgaccactgccgtcatacgacttttgagacagagttgaaacacatcgacttttcagcttctaaatttcaaaagcaattgcagtcaacctatgacaagtatattgccatgcgcgaggagttaggtcggtctgaaaaaccacaaaccttgatggatatggcgactattttcggtcgttatgagcgtgctaacggacgattggatgatatggaagtctctgacgaaatcaatgcctgctcagttgaaattgaagtggatgttgatggtgtcaaggaaccttggctcctcatgtttaaaaatgaaacccacaaccatccaacagaaattgagccatttggtggagcggctacctgtatcggtggagctattcgtgatccgttgtcaggccgttcctatgtttaccaagccatgcgtatttcaggtgctggtgatattacagcaccgatttcggaaactcgtgctgggaaattgccacaacaagtcatttctaaaacagcagctcatggttattcttcatatggtaaccagattgggcttgccacaacctacgttcgtgaatacttccacccaggctttgtagctaaacgtatggaacttggtgccgttgttggtgcggctcccaagggcaatgttgtccgtgaaaaacctgaagcaggtgatgtgatcatccttctcggaggcaaaacaggtcgtgatggtgtcggtggtgcgacgggctcttctaaggttcaaacagttgagtctgtagagactgctggtgctgaggttcaaaaaggaaatgccatcgaagaacgcaagattcagcgcctcttccgtaatggcaatgtcactcgtctgatcaagaagtccaatgactttggggcaggcggcgtctgtgtggctatcggtgaattggcagacggtcttgaaatcgacctcaacaaggtgcctcttaaataccagggcttgaatggtacagaaattgccatctctgaatcacaagaacggatggcggtcgtggttcgtcctgaagatgtggatgccttcgttgccgaatgtaacaaagaaaatattgatgctgttgtggtggcgacagtaactgaaaaaccaaatcttgtcatgcactggaatggtgagacaatcgttgacttggagcgtcgtttccttgacaccaatggtgtgcgcgtggttgtcgatgccaaagttgtggacaaggatgtcaaactcccagaagagcgtcaaacatctgctgaaacactggaatcagatacccttacggttctatctgacctcaaccatgcaagtcaaaaaggattacagactgtctttgactgctctgttggacgctcaacggttaatcacccacttggtggtcgttaccaactcacaccaactgaggcatctgtgcagaaattgccagttcaacacggtgtgactcatactgcgtcggtcattgctcaaggtttcaacccatatgtagctgaatggtctccataccacggtgctgcttacgcggttatcgaagcaactgctcgtttggtggctgctggtgccaactggtctaaggctcgtttctcttaccaagaatatttcgagcggatggacaagcaagcagagcgttttggtcagccagtagccgcccttctaggctctattgaagctcagattcaacttggcttgccatctatcggtggtaaggactccatgtctggtacctttgaagaattgactgttccgccaaccttggttgcctttggggtgacgacggcagatagccgtaaggtgctctctccagaatttaaagctgttggggaaaatatctactacatcccaggtcaagccctctctgcagagattgattttgacttgattaagaaaaattttgctcagtttgaagcaagccaagctgaccataaagtgacatctgcatcagctgtcaaatacggtggtgtagttgaaagtttggctcttgctacctttggaaactatattggtgcagaggtgaccttgcctgaacttaaaacagctttgacagctcaattaggcggctttgtcttcacatctcctgaagaaattgctggagtagagaagattggacaaacgaaagcagactttacactgactgtcaacggtgtgaagctagatggacacaagcttgacagtgcatttcaagggacattggaagaagtttacccaacagaatttacccaagcgaaagaactagaagaagtaccagctgtggcatcagatgttgtgattaaagccaaagaaaaggttgaaaaacctgtggtttacatcccagtctttccaggaaccaactcagaatatgattcagctaaggccttcgaaaaagaaggtgcagaggtcaatttggtgccattcgtgaccttgaatgaagaagctattgtcaagtcagttgaaactatggttgacaatatcgacaagactaatattctcttctttgccggtggattctcggctgcggatgaaccagatggttcagctaagtttatcgtcaatatcctgcttaatgaaaaagtgcgtgtggctattgatagctttatcgcccgtggtggcttgattatcggtatttgtaatggattccaagccttagtcaaatcgggtctcctaccatacggaaactttgaagatgctaacagtactagtccaaccctcttctacaatgatgccaaccaacacgtggccaagatggtggaaactcgcattgccaataccaactcaccatggttggctggtgtgcaagtgggcgatatccacgctattcctgtttcgcacggtgaagggaagtttgtcgtgacggctgaggaatttgcagagctccgtgacaatggacaaattttcagccaatacgttgactttaacggtaaaccaagtatggattctaagtacaatccgaatggttctgtccatgccatcgaaggaattaccagcaagaatggtcaaatcatcggtaagatgggccactcagaacgttatgaggatggtcttttccaaaatatcccaggcaataaagaccaacacctgttcgcatcagcggttaaacatttcactggaaaataa

SEQ ID NO: 2391 - DNA, 135 bp, Streptococcus pneumoniae
ttgtgggtttcatttttaaacatgaggagccaaggttccttgacaccatcaacatccacttcaatttcaactgagcaggcattgatttcgtcagagacttccatatcatccaatcgtccgttagcacgctcataa

SEQ ID NO: 2392 - DNA, 612 bp, Streptococcus pneumoniae
ttgattattcaaaaattgaaggaatcgaaaatatcggaccagagtttctcaaccagtcctttgacccaggtaataaattctccatcccttacttctggggcgactcactttgtggagaaactttcagacacggaacaactcaataaaaaggttaagattattcctttggaagtcgtgctccgcaactatactgctggttccttttcaaaacgttttggtgtggatgagggaatcgccttggagactccgattgtcgaattttactacaaaaatgatgatttggatgatccatttatcaatgatgagcatgtgaaattcctacagattgcgggtgaccagcagattgcctacttgaaggaagaaacgcgtcgtatcaatgaactattgaaagtctggtttactgagattgggcttaaattgattgactttaagctagagttcggttttgacaaggatggcaagattatcttggcagacgaattttcaccagataactgccgcttgtgggacgctgatggcaaccacatggataaggatgttttccgtagaggattgggagaactaaccgacgtttatgagattgtttgggaaaagttgcaggaattgaaataa

SEQ ID NO: 2393 - DNA, 309 bp, Streptococcus pneumoniae
  unsure (8),(10),(11),(12),(13),(14): n at each above location is unknown.
ttctgtgntnnnnnccggctcactcgggtgaagaagggcgatgtttttgactccaacgaagccatgtccactaagataaagcagggtggaacgacctacgatattgccattccaagtgaatacatgattaacaagatgaaggacgaagacctcttggttccgcttgattattcaaaaattgaaggaatcgaaaatatcggaccagagtttctcaaccagtcctttgacccaggtaataaattctccatcccttacttctggggcgactcactttgtggagaaactttcagacacggaacaactcaataa

SEQ ID NO: 2394 - DNA, 1293 bp, Streptococcus pneumoniae; identical to SEQ ID NO: 1215

SEQ ID NO: 2395 - DNA, 258 bp, Streptococcus pneumoniae
ttgttccatatgaatctttctaatgatggttttgtcgcttttcattataggtcatatgggactttttttctacacaaaaataggctccataatatctatagtggatttacccactacaaatattatagagccttttttctacacaaaaataggctccataatatctataggggatttacccactacaaatattatagagcccaaaatcctttgtttactaaacaagggatttttcttttgtctctgctccttttttga

SEQ ID NO: 2396 - DNA, 498 bp, Streptococcus pneumoniae
atgttaaaatcagaaaaacaatcacgttatcaaatgttaaatgaagaattgtccttcctattggaaggcgaaaccaatgttttggctaatctttccaacgccagtgctctcataaaatcacgttttcctaataccgtatttgcaggcttttatttgttcgatggaaaggaattggttttaggccccttccaaggaggtgtttcctgcatccgtattgcactaggcaagggtgtttgtggtgaggcagctcactttcaggaaactgttattgttggagatgtgacgacctatctcaactatatttcttgtgatagtctagctaaaagtgaaattgtggtgccgatgatgaagaatggtcagttacttggagttctggatctggattcttcagagattgaggattacgatgctatggatcgagattatttggaacaatttgtcgctattttgcttgaaaagacagcatgggactttacgatgtttgaggaaaaatcttaa

SEQ ID NO: 2397 - DNA, 1656 bp, Streptococcus pneumoniae
atgtatcaagcactttatcgaaaatatagaagtcaaaacttctcccagttagttggtcaagaagttgtggctaagactcttaaacaagcggtggagcaagagaaaataagtcacgcttatcttttttctggtcctcgtggaacgggaaaaaccagtgttgctaaaatctttgccaaggctatgaactgtcccaatcaagtgggtggcgaaccttgcaataactgctatatttgtcaagcagtgacggacggtagtttagaagatgtcattgaaatggatgcagcttctaataatggggtagatgaaattcgcgaaattcgtgataaatctacctatgcgcctagccttgctcgttataaggtttatatcatagatgaggttcacatgctgtctacaggggcttttaatgccctcctaaagacgctggaagaaccaacacagaatgtagtctttattttggccactactgaattgcacaagattcctgctactattctatcccgtgtgcaacgttttgagtttaaatcaattaagacacaggatattaaggaacatattcactatatcttagaaaaagaaaatatcagttctgaaccagaggctgtggaaatcattgccagacgggcggaaggtggaatgcgggacgccttgtctattttggatcaagccctgagtttgacacagggaaatgagctgacgactgctatctctgaagaaattactggcaccattagcctatcagccttggatgattatgtggcggccttgtctcaacaggatgttcccaaagctttgtcttgcttgaatcttctttttgacaatggtaagagcatgactcgttttgtgaccgatcttttgcactatttaagagacttgttaattgttcaaacagggggagaaaatactcatcatagttcagtctttgtagaaaatttggcacttcctcaaaaaaatctgtttgaaatgattcgcttagcaacagtgaatttagcagatattaagtctagtttgcagcccaagatttatgctgaaatgatgaccgtccgtttggcggaaatcaagcccgaaccagctctatcaggagcggttgaaaatgaaattgctacgctgagacaggaagttgcccgtctcaaacaagagctttctaatgcaggtgcggttcctaaacaagttgcaccagctcctagtcgaccagctacgggcaaaacagtctatcgtgtcgatcgcaataaagtgcaatctatcttacaagaggccgtcgaaaatcctgatttagcacgtcaaaatctaattcgtttgcagaatgcctggggagaggtaattgaaagtctaggtgggccggacaaggctctgctagttggttctcaaccggttgctgccaatgaacaccatgctattcttgcttttgagtctaacttcaatgctggtcaaactatgaaacgagacaatctcaataccatgtttggtaatatcctcagtcaggcggcaggtttttcacctgagattttagctatttccatggaggaatggaaagaagttcgcgcagccttttcagccaaagccaaatcttctcaaactgaaaaagaagtagaagaaagcctgattccagaaggatttgaatttttggctgataaagtgaaggtagaggaagactaa

SEQ ID NO: 2398 - DNA, 195 bp, Streptococcus pneumoniae
atgaataaacaacaatttattattatggcgctatttacagctgctgagacctattttttcaatgaagcctggatgactggccgctatattatggcagccttttgggcaattttactctttagaaatttccgagtcagttatgtgatgggcaaaatcgttgatgtcatcgatcagcattttaataggaaagactag

SEQ ID NO: 2399 - DNA, 771 bp, Streptococcus pneumoniae
atgtcagtattagagatcacagatcttcatgttgagattgaaggaaaagaaattttaaaaggggttaacctgaccctgaaaacaggagaaattgccgctatcatgggaccaaatggtacaggtaaatcgactctttctgccgctatcatgggaaatccaaactatgaagtaactaaaggtgaagttttgtttgatggcgtaaacatccttgagttggaagtggatgagcgtgcgcgtatgggacttttccttgctatgcaatacccatcagaaatccctggaattaccaatgctgagtttcttcgtgccgctatgaatgcgggtaaagaagatgatgagaagatttcagttcgtgagtttattactaagctagatgaaaaaatggaattgctcaacatgaaagaagaaatggcagagcgttacctcaacgaaggcttctctggtggtgagaaaaaacgcaatgaaattcttcaacttttgatgttggagccaacatttgctcttttggatgagattgactcaggtcttgatattgacgctcttaaagttgtgtctaaaggtgtcaatgccatgcgtggtgaaggttttggtgctatgatcattactcactaccaacgtcttttgaactatatcacacctgatgtggtacacgtgatgatggaaggtcgtgttgtcctttctggtggtccagaattggctgcgcgtttggaacgtgaaggatacgcaaaactagctgaagaacttggctacgactacaaggaagaattgtaa

SEQ ID NO: 2400 - DNA, 1260 bp, Streptococcus pneumoniae
atgactagagaaaatattaaacttttttcagaaatgcacgctgaaccaagctggttggctgatctccgtcaaaaagcttttgacaagattgagactttggaattaccagttattgagcgtgtcaaattccaccgttggaatctgggtgatggaacgattacagaaaatgagccatcagcaaatgttccagatttcacagctttagatcatcacttgaagttggtgcaagtaggaactcaaactgttttcgaacaaactccagttgagttagctgaacagggtgttgtcttcacagactttcactcagctttagaagaaattccagagctgatcgaagaattcttcatgtcatctgttaagtatgatgatgacaagttggcggcttaccacacagcttactttaacagtggtgctgtactctatattccagataacgtagaaatcacagagccaattgaaggaattttctaccaagatagcgatagcaatgtgccgtttaacaagcatattatgattatcgctggtaaaaattctaagattagttatctggagcgtttagagtcacgcggtgaaggaagtgacaaagtaactgccaatatcacagtggaagtgattgcacgttctggtgcgcaagtcaagtttgctgctatcgaccgtctaggtgaaaacgtcactgcctacattagccgtcgtggtaaattaggcaacgatgcaagtattgactgggctatcggtgtcatgaacgaaggaaatgtcgttgctgattttgatagtgacttgattggtaatggtagccatgctgacctcaaggttgtagctctttcaagtggtcgtcaggtacaagggattgatactcgtgtaactaactatggctgcaactctatcggaaatatcctacaacatggggttatccttgaaaaagcaactttgactttcaatggtatcggccacatcatcaagggtgctaagggagcagatgcgcaacaagagagccgtgttctcatgctttcagaccaagcgcgttcagatgctaacccaattcttttgattgatgaaaatgatgtcactgcaggacacgcagcgtctatcggacaagttgatccagaagacatgtattacctcatgagtcgtggattggataaggcaactgcagagcgtttggttgttcgtggtttccttggatctgttatcgtggagattccagtcaaggaagttcgtgatgaaatgattgcaactatcgaagagaaattgtcaaaacgc

SEQ ID NO: 2401 - DNA, 1227 bp, Streptococcus pneumoniae
atgttagatgtagaagcgattcgcaaggattttccaattttagatcagattgtcaatgatgaacctctggtctatctggacaatgctgcgacgacacaaaaaccactagtagttctgaaagctattaacagttactatgagcaggacaatgccaatgttcaccgtggtgtccataccttagcggaacgagcgacagcttcttatgaagctgctcgtgaaaccattcgtaagtttattaatgcaggctctacaaaggaagttctctttaccagaggaacgacaaccagccttaactgggtggcacgctttgctgaggaaattctcgctgagggagaccgggtcttgatttcagtaatggaacaccattctaatatcattccatggcaggaagcttgtcgaaagactggagcagagcttgtctatgtctatcttaaagacggtgccttggatatggaggatttgcgagctaaattgactgataaggttaaatttgtttccctagctcatgcctccaatgttcttggtgtggtcaatccgatcaaggaaatcactcaattagcccaccaagttggggcaattatggtagtggatggtgctcaatctacacctcatatgaagattgatgtccaggacttggatctggactttttcgccttttcgggtcacaagatggctggtccgactggtatcggtgtcctttacggcaaagaaaagtatcttgagcaaatgtctccagtagaatttggcggcgagatgattgattttgtctacgagcaatttgctagttggaaggaattgccttggaaatttgaggctggaacgccaaatatggcaggagctattggacttgcgactgcagttgattatctggaaaagattggtatggatgccgttgaagctcatgaacaggaattgattgcgtacgtctatccaaaactgcaggcaattgagggattgaccatttacggttctcaggatttggctcaacgttcgggtgttattgcctttaacctaggtgatctccatcctcacgatcttgcgacggctctggattatgaaggagtggctgttcgtgctggtcaccattgtgcgcaacccttgcttcagtatttggaagtcccagcaacagctcgtgcaagtttttatatctacaataccaaggcagattgcgacaaactagtcgatgccctacaaaagacaaaggagtttttcaatggcactttctaa

SEQ ID NO: 2402 - DNA, 471 bp, Streptococcus pneumoniae
atgccctacaaaagacaaaggagtttttcaatggcactttctaaactagatagcctttatatggcagtggtagcagaccattcgaaaaatccacatcaccaagggaagttagaagatgctgagcaaaccagtctcaacaatccgacttgtggggatgtcatcaacctctctgtcaagtttgatgcagaggaccgtttggaagatattgcttttctaaattcaggatgcacgatttcaactgcttctgctagtatgatgacagatgccgttttaggaaaaaccaaacaagaaattttagaactggcgactattttttctgaaatggttcaagggcaaaaagatgagcgtcaaggccaacttggagacgcggcattcttgtcaggtgttgccaaattccctcaaagaatcaagtgtgcaaccctagcttggaatgcccttaagaaaacaattgaaaatcaagaaaaacagtaa

SEQ ID NO: 2403 - DNA, 1410 bp, Streptococcus pneumoniae
atggctgaagaaagagtagaaccaaaaccaattgaccttggtgaatataaatttggtttccatgacgatgtagagcctgtcttatcgacaggaaaaggactcaacgaaggtgttattcgtgaattatctgctgctaagggtgagcctgagtggatgttggagttccgtttgaagtcttatgaaaccttcaaaaaaatgcccatgcaaacttggggagcagacttgtcagagattgactttgatgacttaatctactaccaaaaaccatctgacaaaccagcccgttcttgggatgatgtacctgaaaagattaaagaaacctttgaacgtatcgggattccagaagctgaacgtgcttatttagcaggggcttctgcccagtacgagtcagaagtggtttaccacaacatgaaggaagagttccaaaaattaggtattatctttacagatacagattccgcactcaaggaatacccagacttatttaaacaatactttgcgaagttggtaccgccgacagataacaagttggcagccctcaactcagcagtatggtcgggtggaacttttatctacgtgccaaaaggtgtcaaggtagatattccacttcaaacttatttccgtatcaataacgaaaatataggtcagttcgaacgtaccttgattatcgttgatgagggagcaagcgtccactacgtagaaggatgtacagcaccaacatattcaagcaatagcttacacgctgccattgtagaaatttttgctttggacggagcttatatgcgttatacaactatccaaaactggtctgataacgtctataacttggtaacaaagcgtgctaaggctcaaaaggatgccactgttgagtggattgatggaaacttgggtgccaaaacgactatgaaatatccatctgtttaccttgatggagaaggagcgcgtggtaccatgctctctatcgcctttgctaatgcagggcaacaccaagacacgggtgctaagatgattcacaatgctccacataccagctcgtctattgtgtctaaatccatcgctaaaggtggaggaaaggttgactaccgtggacaagtcacctttaacaagaactctaagaaatctgtttcccacattgaatgtgataccattatcatggatgacttgtcagcatcagatactattccatttaatgaaattcacaactcgcaagtggctttggaacacgaagccaaagtatctaagatttcagaagagcaattgtattatctcatgagccgtggattgtcagaatctgaggcaactgaaatgattgtcatgggatttgtagaaccctttacaaaagaacttccaatggaatacgcagttgagctgaaccgcttgattagctatgaaatggagggatcagttgga

SEQ ID NO: 2404 - DNA, 195 bp, Streptococcus pneumoniae
gtaaatctaatactcaaaatcaaagaacaaactaggaagctagccgcaggttgctcaaaacactgttttgaggttgtagatgaaactgacgaagtcagtaaccatacatacggtaaggcgatgctgacgtggcttgaagagattttcgaagagtataaaatcaaattttatccaactgatccctccatttcatag

SEQ ID NO: 2405 - DNA, 186 bp, Streptococcus pneumoniae
aatttgattttatactcttcgaaaatctcttcaagccacgtcagcatcgccttaccgtatgtatggttactgacttcgtcagtttcatctacaacctcaaaacagtgttttgagcaacctgcggctagcttcctagtttgttctttgattttgagtattagatttactcaaaatcaaggattttga

SEQ ID NO: 2406 - DNA, 1242 bp, Streptococcus pneumoniae
atgaaaaaaatatttttaactttgttaactgtctctcttttagggggtgcttctactgctgttgctcaagattttaccattgccgctaaacatgcgattgctgttgaggcaaatactggtaaaattctctatgagaaggatgcaacgcaacctgtcgaaattgcttccataacaaaattgattactgtttatctggtctatgaagctttggaaaacggaagtattaccctctccactcctgtagatatttctgattatccttatcaattgacgacaaattctgaagccagtaatattcctatggaggcccgtaattatactgtcgaagagttgcttgaagcaactctggtatctagtgccaacagcgccgctattgccctagctgagaaaattgctggctcagaaaaagatttcgtcgatatgatgcgggcaaaactcttggaatggggaattcaggatgccactgttgtcaatacgacaggtcttaacaatgaaactctaggggataacatttacccaggttctaaaaaagatgaggaaaataagcttagtgcttatgatgtcgctatcgttgctcgcaacctcatcaaaaaatacccacaagtcttagaaatcaccaaaaaaccttcttctacttttgctgggatgacaatcacttcaaccaactacatgttagaaggtatgcctgcttaccgtggtggttttgatgggctaaaaacaggaacaacagataaggctggagagtcttttgttggtactactgtcgaaaaaggcatgagagtcatcacagttgttttaaatgcagatcatcaagacaataatccttacgctcgatttacagctacatcttccctaatggattatatttcttctacatttacacttcgcaaaatcgttcaacaaggcgatgcctatcaagatagcaaagcccctgtacaagatggaaaagaagatacagtaactgcagtggctccagaggatatctatctaatcgaacagattgggaatcaatcttcccaatctgttcaattcacacctgattccaaagcaatcccagcaccacttgaagctggaacagtggttggccatttgacttataaagacaaggacttgattggtcaaggttacatcaccacagagcgccctagtttcgaaatggtagcagacaagaaaattgaaaaagccttcttcttaaaagtttggtggaatcagtttgtccgctttgttaacgagaaattataa

SEQ ID NO: 2407 - DNA, 1110 bp, Streptococcus pneumoniae
atgtttcgtagaaataaattatttttttgcaccacagaaattttactcttaaccatcatcttttacctatggagacagatggggtctttgattaacccttttgttagcgtgcttaatacaattatgattccatttttattagggggctttctttattatttgacaaaccctattgttactttcttaaataaagtctgtaaactcaatcgtttgcttggtattttaattaccttgtgtactttggtctggggaatggtcataggtgttgtctatctcttacctattttgattaatcagttatctagtttgattatatctagtcaaactatttatagtcgagtacaagacttaatcatagacttatctaattatcctgcgctccagaatttggatgtagaagctacaattcagcagttaaacttatcctatgttgatattcttcaaaatatcctaaatagcgtatcaaatagtgtggggagcgtcttgtcagctcttatcagtactgttttgattttgattatgactccagtttttttggtttatttcttattagatggacataaattcttgcccatgcttgaaagaacgattctaaagagggatcgcttgcatattgcaggcttattaaagaatttaaatgcgacgattgctcgctatattagtggagtttcgattgacgcaatcattataggttgtttagcttatattggctatagtattattggtttaaaatatgctttagtttttgccattttttctggtgtagccaatttaattccttatgtggggccaagtattggtttgattcctatgatcatcgcaaatatattcactgatccccatagactgctgattgcagtgatttatatgcttgttgttcagcaggtagatggcaatatcttatatcctcgaatcgtaggaagtgttatgaaggttcatccaatcacgattttagttttacttttgttgtcaagcaatatctatggtgtagttggaatgattgtcgcagtgccaacctattctatcttgaaagaaatttctaagttcttatcccgtttgtatgaaaatcataaaataatgaaagaacgagaaagagaattagctaagtaa

SEQ ID NO: 2408 - DNA, 219 bp, Streptococcus pneumoniae
acacgagcaatccaaatcgggtcacgcctgctggtttttaggcagctagagcgtaagaagtgttattttttgcagttatatttaactgagcgtttacgtcgccacacgagtcgcaaaatatgcctcataatgcctgtcgaatccgtaacgaccccaaaagacaataaaactattataccttatctaactcaaaaatgcaaaaagaaatcacatacctaa

SEQ ID NO: 2409 - DNA, 201 bp, Streptococcus pneumoniae
tttaactcctctaaaattagttgtttacgttctgtttttaacactgaatcacctcctgttatcgtttacactattcattctatcatactttctttcgaagtcaagcattttttatcattttctttcaaaatctatcattttttcttatttctagaatttttattgcaagataagagcctttatggtagactatttgagtaa

SEQ ID NO: 2410 - DNA, 741 bp, Streptococcus pneumoniae
gtgttaaaaacagaacgtaaacaactaattttagaggagttaaatcagcatcatgtagtttctctagaaaaattagttagtttgctagaaacgtcagaatcaacggttcgaagagacttggatgagttggaagcggaaaacaagcttcgtcgtgtgcatggtggagcagaactcccccactccttacaggaagaagaaaccattcaagaaaaatctgtcaaaaaccttcaagaaaagaaattgctggctcagaaagcagcctctctcattaaagaaaaagatgtcatctttatcgatgctggaacaacaactgcttttttgattcatgaattggtcaataagaatgttacagttgtgaccaactccattcaccatgccgctcagttggttgaaaagcagattccaactgtcatggttggaggaaacgtcaagacggcgacagatgctagtatcgggggcgttgctcttaaccagattaaccaattgcactttgaccgtgcctttatcggaatgaatggtgttgacgatggctattatacgactcctgatatggaggagggagctgtgaaaagagctattttggagaatgccaagcagacctacgtcttggtggattcgtcaaaaattggacaaacttgctttgccaaggtagccccactcaaacgcgctatcgttatcactagtcaagggcatgagctcttgcaggttattaaggagaaaacggaggtaatagaagtatga

SEQ ID NO: 2411 - DNA, 912 bp, Streptococcus pneumoniae
  unsure (49): n at each above location is unknown.
atgatttatacagtcacactcaatccatccattgactatatcgttcgtntggaccaagtcaaagttggtagtgtaaatcgtatggacagtgatgataagtttgctggtgagaaaggaatcaatgtcagccgtgtcttgaaacgtttgaatatatcaaatacagcgacgggatttatcggtggctttactggtaaatttatcacagatactttagcagaggaagaaatcgagacacgttttgtccaggtggcagaagatactcgtatcaatgttaaaatcaaagcagaccaagaaacagaaatcaacggaacgggtccaactgttgaaccggttaagctagaagaattgaaagctattttatctagtctgacagcagaagatacagttgtctttgcaggttcaagtgctaaaaatctaggcaatgttatctataaggatttgatttccttgacgcgccagactggtgcgcaagtggtctgtgactttgaaggacagaccttaattgatagtttggactaccagcctcttcttgtaaaaccaaataatcatgaacttggagcgatttttggggttaaactcgaaagtttagatgaaattgagaaatacgctcgtgagttactggctaagggtgctcaaaatgttattatctctatggctggtgatggtgcccttcttgtcacatctgagggagcttacttcgctaaaccaatcaaaggaacagtcaaaaattcagttggagctggtgattctatggttgctggattcacaggtgaatttgtcaaatcaaaagacgcagtagaagccttcaaatggggagtggcttgcggaacggcaactaccttctcagatgacttggcaacggcggaatttattaaagaaacatatggaaaagttgaggtagaaaaacgatga

SEQ ID NO: 2412 - DNA, 228 bp, Streptococcus pneumoniae
ttgaattttcatcgtttttctacctcaacttttccatatgtttctttaataaattccgccgttgccaagtcatctgagaaggtagttgccgttccgcaagccactccccatttgaaggcttctactgcgtcttttgatttgacaaattcacctgtgaatccagcaaccatagaatcaccagctccaactgaatttttgactgttcctttgattggtttagcgaagtaa

SEQ ID NO: 2413 - DNA, 1953 bp, Streptococcus pneumoniae
atgaaaattcaagatttattgagaaaagatgtcatgttgctggatttgcaggcaactgaaaagactgctgtcattgaagagatgattaaaagcctaacaggccacggttatgtgacagattttgaaacctttaaagaaggcattttggcgcgtgaagctttaacttctactggtttgggtgatggaatcgctatgcctcacagcaaaaacgctgctgtcaaagaagcgacagttctctttgctaagtcaaacaagggtgttgactatgagagtttggatgggcaggcaactgacctcttcttcatgattgcagctccagaaggtgccaatgatactcacttggcagcattgacagaattgtctcaatacttgatgaaagacggttttgcagacaaacttcgtcaagcaacatctgcagaccaagttatcgaactttttgaccaagcttcagaaaaaactgaggaacttgttcaagcacctgctaatgactctggtgactttatcgtagctgttacagcttgtacaacaggtattgcccacacttacatggcccaagaagcccttcaaaaagtacctgctgaaatgggggttggtatcaaggtcgaaaccaacggtgctagcggtgttggaaatcaactaactgcagaagatatccgtaaggctaaagctattatcattgcagcaaacaaggccgttgaaatggatcgtttcgatggcaaacctttgatcaatcgtccagttgctgacggtatccgtaagacagaagaattgatcaacttggctatttcaggagatgcggaagtctaccgtgccgctaatggtgccaaagtcgcaacagcctctaacgaaaaacaaagccttggtggtgccttctacaaacacttgatgagtggtgtatctcaaatgttaccattcgttatcggtggtggtatcatgattgcccttgccttcttgattgacggtgctttgagtgttccaaatgaaaaccttggcaatcttggttcttaccatgagttagcttctatgttcatgaaaattggtggagctgcctttggtttgatgcttccagtctttgcgggttatgttgcctactctattgctgaaaaaccaggtttggtagcaggtttcgtggctggtgctattgccaaagaaggttttgcctttggtaatattccttatgccgcaggtggtgaagcaacttcaactcttgcaggtgtctcatctggtttcctaggtgcccttgttggtggatttatcgcaggtgccttggttcttgccatcaagaaatacgttaaagttcctcgttcactcgaaggtgctaaatcaatccttctattgccacttcttggaacaatcttgacaggatttgttatgctagctgtgaatatcccaatggcagcaatcaacactgctatgaatgacttcctaggcggtcttggaggaggttcagctgtcttacttggtatcgtccttggtggaatgatggctgttgacatgggtggaccagttaataaagcagcttatgtctttggtacaggtacgcttgcagcaactgtttcttcaggtggttctgtagccatggcagcagttatggctggaggaatggtgccaccacttgcaatctttgtcgcaactcttcttttcaaagataaatttactaaggaagaacgtaactctggtttgacaaacatcatcatgggcttgtcatttatcactgagggagcgattccatttggtgccgctgacccagctcgtgcgattccaagcttcatccttggttcagcagtagcaggtggactcgttggtcttactggtatcaaactcatggcgccacacggaggaatcttcgttatcgcccttacttcaaatgctctcctttacctcgtttctgtcttggtaggagcaatcgtaagtggtgtggtttatggttacctacgcaaaccacaagcataa

SEQ ID NO: 2414 - DNA, 2214 bp, Streptococcus pneumoniae
atggcaaacaagaatacaagtacaacaagacggagaccgtctaaagcagaactggaaagaaaagaagcgattcaacgaatgttgatttcgttaggaattgcgattttattgattttcgcagccttcaaattaggggctgcaggtataaccctttataatttaattcgcttgctagtgggtagcctagcttatctggcgatattcggcctattaatctatctcttctttttcaagtggatacgaaaacaggaaggactcttatctggctttttcaccatatttgctggcttactcttgatttttgaggcctacttggtttggaaatatggtttggacaagtccgttctaaaagggaccatggctcaggttgtgacagatctgactggttttcgaacgactagctttgctggagggggcttgatcggggtcgctctttatattccaacagcctttctcttttcaaatatcggaacttactttattggttctatcttgattttagtgggttctctcctagtcagcccttggtctgtttacgatattgctgaatttttcagtagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgctgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgaccaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgcaactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattaatgaaaatcatccagttcgtctccaaggctcctttatctcggatgacgatgttgagcgcattgtgagcttcatcaagactcaggcagatgcagactacgatgagagttttgatccaggtgaggtttctgaaaatgaaggagaattttcggatggagatgctggtggtgatccgctttttgaagaagctaagtctttggttatcgaaatacagaaagcagttggaatccatgattcagcgtcgtttgtcagttggatttaa

SEQ ID NO: 2415 - DNA, 252 bp, Streptococcus pneumoniae
cagaggaagctgttcaaaatcttccacctattccagaagaaaagtgggtggaaccagaaatcatcctgcctcaagctgaacttaaattccctgaacaggaagatgactcagatgaccaagatgttcaggtcgatttttcagccaaagaagcccttgaatacaaacttccaagcttacaactctttgcaccagataaaccaaaagatcagtctaaagagaagaaaattgtcagagaaaatatcaaaatcttag

SEQ ID NO: 2416 - DNA, 285 bp, Streptococcus pneumoniae
gcttcatcaagactcaggcagatgcagactacgatgagagttttgatccaggtgaggtttctgaaaatgaaggagaattttcggatggagatgctggtggtgatccgctttttgaagaagctaagtctttggttatcgaaatacagaaagcagttggaatccatgattcagcgtcgtttgtcagttggatttaaccgtgcgacccgtctcatggaagagcttgagatggcaggtgtcattggtccagctgaaggtaccaagccaagaaaagtattgcagcaataa

SEQ ID NO: 2417 - DNA, 216 bp, Streptococcus pneumoniae
aggtaccaagccaagaaaagtattgcagcaataaaaaatagcttctttccaaggttggaaggagctattttactggctattgattacttttatactcttcgcaaatctcttcaaaccacgtcagctttgccttgccgtatatatgtgactgacttcgtcatgtcttatctacaacctcaaaacagtgttttgagcagcctacggctagcttcctag

SEQ ID NO: 2418 - DNA, 660 bp, Streptococcus pneumoniae
atggatttcctaaaatttttgaagccacctgcatataggtttcaagggcttctggatagggcctggtcgtcgccgaattatcaaagtaaatcatgtttctcacgctttctaaaatcactagttctattgtatcatgaaacggagcctgcgacaagaaagggcaatttctctttttttaagatttttttaaagaaacagagtataataaatcataatcaaaggagagaatgtatgtctaactatcgtagaacttcaaaaccgaaaacagaacatatcaaaaaaggctttactgtttttcaaaaaaccattactactatcggtagtatccttggtttgattacagcgggtatcacgatcatgaacgccttggataataataataaaaatactaaaaaagaacctacgacaagccagacgacaacctttgtcaaagaaattcaaaaagaatcccctcaggaaaatactactccaaataaggaaaataacacttctcaagaaaaaacacaacaagaagaaacgccaaaatctagcgtcaaggaagagaaaaaagaagatcagaaaacagcaactcaggactctactacacctgctacaagtaaacctgccactgaaaatgaaaaacagcccaatactccaacttcagaaaataatactcaatga

SEQ ID NO: 2419 - DNA, 1203 bp, Streptococcus pneumoniae
ttgtcgcaggctccgtttcatgatacaatagaactagtgattttagaaagcgtgagaaacatgatttactttgataattcggcgacgaccaggccctatccagaagcccttgaaacctatatgcaggtggcttcaaaaattttaggaaatccatctagtctccatcgtttgggagaccaggcaacacgaattttagatgcttcccgtcaacagattgcagatttaatcggtaagaaaagtgatgaaatcttctttacatctggtgggacagaaggggataactggatcatcaagggagtagcatttgaaaaagcccagtttggcaagcacatcatcgtatcagccattgaacatccagcagttaaggaatcagccctctggttgaaagctcaaggttttgaagtggattttgctccagttgataacaaaggatttgtggatgttgaggcgctagaagatttgataagacctgatacgaccctcgtttccatcatggcagttaacaatgaaattggctctgttcagcccattgaggctatttcaaaactattggcagacaagccaactatttccttccacgttgatgcggttcaggcgcttgccaagattccgactgaaaagtatctgacagaacgagtggatttcgcgactttctctggtcacaagttccacggaatccgtggtgttggttttatctatatcaagtctggcaagaagattacgcctcttttaacaggtggtggtcaggaacgtgattaccgttcgacaactgaaaatgtggcaggaattgcagcgaccgctaaggctctccgtttatctatggaaaagctagatatctttaggagcaagactgggcagatgaaggcagtgattcgtcaagcacttctggactatccggatatatttgtcttttcagatgaggaagacttcgcccctcatattctgacttttggaatcaagggtgttcgtggtgaggtcattgttcacgcctttgaagactatgatattttcatctcaacgacctcggcttgttcgtccaaggctgggaaaccagccggaaccctgattgctatgggagtggacaaggataaggctcagtcagctgtgcgtcttagtctagaccttgaaaatgatatgagtcaggtcgagcagttcttgaccaagctaaaattaatttacaatcaaactagaaaagtaagatag

SEQ ID NO: 2420 - DNA, 1215 bp, Streptococcus pneumoniae
atgcagtattcagaaattatgattcgctacggtgagctgtcaaccaagggcaaaaatcgtatgcgtttcatcaataaacttcgcaataatatttcagacgttttgtctatctatccccaagttaaggtaacagcagatcgcgaccgtgcccacgcttacctcaatggagcagattacacagcagtagcagaatcgctcaaacaagtatttggaattcaaaacttttcccctgtttataaggttgaaaaatctgtagaagttctgaagtctgctgtccaagagattatgcaggacatctacaaggaaggcatgacctttaaaatctctagcaagcgtagcgaccacacctttgaattggacagtcgtgaactcaaccaaacgcttggaagggctgtattcgaagccattccaaacgtacaagctcaaatgaaaagtcctgacatcaatcttcaggtggagatacgtgaagaagcagcctatctttcttatgaaaccgttcgaggggcaggtggattaccagtgggaacttctggtaagggcatgctcatgttgtcagggggaatcgattcccctgtagctggctatctagcgcttaaacgaggggtagatatagaggcagttcactttgccagcccaccttacacgagtcctggtgctcttaaaaaagcccaagatttgacccgtaaattaaccaaatttgggggaaatatccagtttatcgaagttccttttacagagattcaagaggaaatcaaagccaaagcgccagaagcctaccttatgaccttgacgcgtcgttttatgatgcgtattactgaccgtattcgtgaggtacgaaatggtttagttatcatcaatggggaaagtctaggtcaagtagccagccaaacccttgaaagtatgaaggctatcaatgctgttaccaacactcccatcattcgtcctgtggttaccatggacaagttggaaatcattgacatcgcccaggaaatcgatacctttgacatttcaatccaaccgtttgaagactgttgtaccatttttgcaccagatcgtccaaaaacaaatcctaaaattaagaatgcggagcagtacgaagcgcgtatggatgttgaaggcttggttgagcgagcagtggctggaatcatgattactgaaatcacacctcaagccgaaaaagatgaagttgatgacttgattgacaatctgctctaa

SEQ ID NO: 2421 - DNA, 630 bp, Streptococcus pneumoniae
ttgaatatagagagttttctgacaatgaatcaatcctacttttatctaaaaatgaaagaacacaaactcaaggttcattatacaggtaaggagcgccgtgtacgtattcttcttcctaaagattatgagaaagatacagaccgttcctatcctgttgtatactttcatgacgggcaaaatgtttttaatagcaaagagtctttcattggacattcatggaagattatcccagctatcaaacgaaatccggatatcagtcgcatgattgtcgttgctattgacaatgatggtatggggcggatgaatgagtatgcggcttggaagttccaagaatctcctatcccagggcagcagtttggtggtaagggtgtggagtatgctgagtttgtcatggaggtggtcaagccttttatcgatgagacctatcgtacaaaagcagactgccagcatacggctatgattggttcctcactaggaggcaatatacccagtttatcggtttggaataccaagaccaaattggttgcttgggcgttttttcatctgcaaactggctccaccaagaagcctttaaccgctatatcgagtgccagaaactatcgcctgaccagcgcatcttcatctatgtag

SEQ ID NO: 2422 - DNA, 348 bp, Streptococcus pneumoniae
ttggaataccaagaccaaattggttgcttgggcgttttttcatctgcaaactggctccaccaagaagcctttaaccgctatatcgagtgccagaaactatcgcctgaccagcgcatcttcatctatgtaggaacagaagaagcagatgatacagacaagaccttgatggatggcaatatcaaacaagcctatatcgactcgtcgctttgctattaccatgatttgatagcagggggagtacatctggataatcttgtgctaaaagttcagtctggtgccatccatagtgaaatcccttggtcagaaaatctaccagattgtctgagattttttgcagaaaaatggtaa

SEQ ID NO: 2423 - DNA, 336 bp, Streptococcus pneumoniae
atgcatattgaacatcttagccactggagtggtcatcttaaccgtgaaatgtaccttaaccgttatggacatggtgggattccagttgtggtctttgcttcatcaggtggtagtcacaacgaatactatgattttggcatgattgatgcctgtgcttcctttatcgaggaaggccgtgtccagttctttaccctatctagtgtggatagtgagagctggttggctacttggaaaaatgctcatgaccaagcggaaatgcaccgtgcctacgaacgttatgtgattgaggaggccattcttttatcaagcacaagacaggttggtttgatggcatga

SEQ ID NO: 2424 - DNA, 432 bp, Streptococcus pneumoniae
ttgtttacgccaccattcccagtcatgggcgacatcatgtccccattcagcaaatcaggctggaatttgtttctggtcaaaggcttctttgagcttgtaaaaggatggcaaaccatcttgttcccaggctccaagccccgtacacagcacaatctctgcctgacggtaacggtcaataaaccagccgtcgttttagttccaaatataatctactggcgagttttggtaaatagcatcatcgttgtagtaatcaccgacaaagaaacgtgcgtcgtaaacaccactgagagcaatcactttggtaaagacatctggatgctggaggaagaaattgagtgcatgataggctcccatagagcaacctgtcgtcatcatgccatcaaaccaacctgtcttgtgcttgataaaagaatggcctcctcaatcacataa

SEQ ID NO: 2425 - DNA, 183 bp, Streptococcus pneumoniae
atgatgacgacaggttgctctatgggagcctatcatgcactcaatttcttcctccagcatccagatgtctttaccaaagtgattgctctcagtggtgtttacgacgcacgtttctttgtcggtgattactacaacgatgatgctatttaccaaaactcgccagtagattatatttggaactaa

SEQ ID NO: 2426 - DNA, 1167 bp, Streptococcus pneumoniae
atgaattaccttgttatttctccctactatccacaaaactttcaacagtttaccatcgaactagctaataaaggcatcacagccttgggaattggtcaagagtcttacgagcaattggatgagcccttgcgcaatagcttgaccgagtattttcgtgttgataatcttgagaacatagatgaagtcaaacgtgcagttgcttttctcttttataaacatggtccaattgaccgcatcgagtctcacaatgaatactggcttgagctagacgcaacactcagagaacaattcaatgtttttggtgccaaaccagaggatctcaaaaagacgaaatataagtctgaaatgaagaaacttttcaaaaaagcaggtgttcctgtggtacctggagctgttatcaagacggaagcagatgttgatcaagcagtgaaagaaatcggtcttccaatgattgccaaacctgataatggagtgagagcagccgcaacctttaaacttgagacagaagacgatatcaatcacttcaagcaagaatgggaccattcaaccctttatttctttgaaaaatttgtcacttccagcgaaatctgtacctttgacgggctcgtggacaaggatggaaagattgtcttctcaacaacctttgactacgcctatacaccgcttgacctcatgatttataagatggacaattcttattatgtgctcaaggatatggatcctaaactgcgcaagtatggggaagcaattgtcaaagaatttggtatgaaagaacggtttttccatattgagttcttccgtgagggggacgattatattaccatcgagtacaataaccgccctgcaggtggttttaccattgatgtttataactttgctcattccttggacctttatcgtggctatgcagctattgtcgcaggagaggagttcccggcgtcagactttgaaactcagtattgtttggctacttctcgccgtgcaaatgctcactatgtttattcagaagaggatttgcttgccaaatatagccagcagttcaaggttaaaaaagtcatgccagctgccttcgcggaacttcaaggagattacctgtatatgctgaccactccgagtcgacaagaaatggagcagatgattgcagatttcggacaacgtcaagaataa

SEQ ID NO: 2427 - DNA, 1494 bp, Streptococcus pneumoniae
atgattacaggcgaattaaaaaataaaatcgatcagctgtgggaaattctttggacagaaggaaacgcaaatcctttaacaaatattgaacagttgacttatctcttatttatgaaagatttggatagtgtcgagcttggacgtgaaagtgatgctgaatttctagggattccttatgagggagtttttccaaaagataaacctgaataccgttggtcaacttttaaaaatataggagatgctcaggaagtttatcgtttaatgactcaggagatttttccgtttattaaaaatctcaagggggatacagatgatacagccttttcacgatatatgcgagaagctatttttcaaataaataaacctgctacgcttcaaaaggcaatttctatcttagatgtttttccaactaggggattagatgtagattttgataatgacaaacaaagtattactgatatcggagatatctatgaatatctgttatcaaaattgtcgaccgcaggtaaaaatggacagttccgtacacctcgtcacatcatcgatatgatggttgagttgatgcaaccgactatcaaagatatcatctcagatcccgctatgggttctgctggcttcttagtatctgctagccgttacttaaagcgtaagaaagatgaatgggaaaccaatacagataatatcaatcattttcataatcagatgtttcatggaaatgatacggatacgactatgttgagacttggggcgatgaacatgatgctacatggagtagaaaatccacaaatcagttaccttgactcgctgtctcaagataatgaagaagctgataaatatactttggttttagcaaatcctccttttaagggctcacttgactacaattcaacctctaatgaccttcttgcaaccgtaaaaaccaaaaaaacagaattactctttctttctcttttcttgcgaactttaaaaccaggtggacgagcagcagttatcgtacctgatggtgtcctttttggttcgtctaaagctcataaaggaattcgtcaggaaattgtagagaatcataagcttgatgctgtaatctcaatgcctagtggtgtgttcaagccttatgctggagtttcaactgccattctcatctttacaaaaactggtaatggtggtactgacaaagtctggttttacgatatgaaagcggatggtttaagtttggatgataagcgacaaccgattagagacaatgatattccagatattatcgaacgctttcatcatcttgaaaaagaagcagaacgtcagagaacggatcaatctttctttgttccagttgctgagataaaggaaaatgattatgatttgtctatcaataaatataaagagattgagtatgaaaaagttgagtatgaaccaacagaagtcatattaaagaaaatcaatgatttagaaaaagaaattcaagctggcttggctgaattggaaaaattactcaagtag

SEQ ID NO: 2428 - DNA, 1122 bp, Streptococcus pneumoniae
atgaaaaaagtgaagttgggggaagtcttatctctaaaaaaaggcaagaaagccactgtacttgctgaacaaacaactctaagccaacgttatattcaaatagatgatttaagaaataataataatttaaaattcactgaaagtttaaatatgactgaagcacttccagatgatattctaatagcatgggatggtgctaatgcaggaacagttggttatggattatcgggagctgttggtagtacaattacggtcttaaaaaagaatgagcgatacaaagaaaaaattatatcagattacttgggagtctttttggaaagtaaatcgcagtatttacgagatcattcaacaggtgcaactattcctcatttaaacaagaatatattacttgatttacaattagaattgctaggtatcgaagaacaagagaacattatctgtattcttaatacgattaaaaggcttattactaaaagaaaatttcagttagatgaactaaacttgctcgtcaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaaggaataataattatagtcgagtgatatcaggaagtgctcagcctcagttaccaattacaaaattaaaaaaaatacttctccccctcccccctctagccctccaaaatgagttcgcagactttgtagttcaggtcgacaaatcacaattggcaatccaaaaatctctggaagaacttgaaactttgaagaaatctctgatgcaggagtattttggctga

SEQ ID NO: 2429 - DNA, 237 bp, Streptococcus pneumoniae
atggtagtaaaaacaagaaaacaaggaaattcaatcaccattacgattccaagtgaatttaatattccaagtggtgttaaatacgaagcgaaattgttacaaagtggtgagattatctttactcctgaagaattggggcagcaggtttcttatgtatctgatgatgcctttgacttaaatttagataaaatatttgacgaatacgacgatgttttcaaagctttggtggaaaaatga

SEQ ID NO: 2430 - DNA, 414 bp, Streptococcus pneumoniae
atgacaatctatctgacagaaaagcaaattgaaaaaataaatgctttagcaattcaacggtattctccaaatgagaaaattcaaacagttagttcttctgccttaaatatgattgtgaacttaccagaacaatttgtctttgggaagtctctttatccaacaatttttgataaagcaacgatactatttgtccaattgataaagaagcatgtttttgctaatgctaataaaagaactgctttcttcgttttggtcaaatttttacaattaaacggctatcgtttttctgtaacggtagaagaagcagtaaaaatgtgtgtaaccatcgcagtagaagctttaactgatgaaaaaatgacaagctattccaaatgggtttctgaacattctgttagagaaaaggtcaaaaagtaa

SEQ ID NO: 2431 - DNA, 828 bp, Streptococcus pneumoniae
ttgcaactatttattaccgccaagcaggtagagggctgtagctcaaaaacaattcgttattaccagaggacgattgaaaacttgtttaatgctattaaagagtctgtgacacaactcacaacagatgatttaaggagttatttagcaaattaccagtctgaaaaggattgtagtaaggcaaatttagacaatattaggcgtatattgtcttctttttttgcttggcttgagcaagaggaatatatcattaaaaatcccattcgacggataaagaaaattaagactgagcaaaatgtgaaggaaacttatactgatgaacatttggaaattatgcgtgataactgtgaaaatttgagagatttggcaataatagacctactagcatcgacaggtatgcgtgtaggggagcttgtacagttgaatcgttcagatattgattttgaaaacagagagtgtgttgtctttggtaaaggaaagaaggagagaccagtatattttgatgctcggacgaaaattcatttaagaaattatcttaacgacagaaaagatagtcaccctgctctttttgtaacgctagttggaaaagcccagagacttggaattgctggtgtagagattcgcttaagaaagttaggagacaaactcggcatacaaaaggttcacccacataagttcagaagaactttagcgactaaggcaattgataaaggtatgcctatcgaacaagtccaaaaactgctaggtcatagcaagattgacacaaccctggcctatgccatggtcaatcaaaataatgtcaagcattcacaccaaaaattcatctcttaa

SEQ ID NO: 2432 - DNA, 1107 bp, Streptococcus pneumoniae
atgaagaaagtgaaattagggcaagtggctacttttatcaatggctatgcttttaaacctcaagattggtcatctgaagggaaagagattatcagaatacagaatctgactaaaacttcaaaagggataaattattattcgggtacgattgataaaaaatacattgttgaagctggtgatattcttatttcgtggtcgggtacattaggggtttttcagtggtgtggaagatccgcagtgttaaatcagcacatttttaaagtggtttttgataagatagatatagataaatcgtattttaaatatgttgttgaaaaaggtttacaagatgctgtaaaacatactcatggttccacaatgaaacatttaactaaaaaatattttgataatattatagttccatatacaaatttgggagagcaacaaagaattgcaagtgagctggatttgttaagcaagctgattttaaggagacaagaacaacttgaagagcttaatctacttgtaaaatcccgatttaacgagatgtttggggaaaataaaatatttgaaagcattgataacttatttgatattatagatggtgataggggcaaaaattatcctaaatcagatgagttgtttagtgaggagtactgtttatttttaaatacaaagaatgttactaaaaacggattttcattcgatacaaagcaatttatcactaaaacaaaggataaattacttcgaaaaggcaaacttgagcgttatgatatagtcttgacaacaagaggtactgttggaaatgtagcgtactacgatgaattaataaaatataaacatttacgtataaattcaggtatggtaatattacgtcccaagacaccaaatctaaatcagaaatttattatccatgttttaagaaataataattatagtcgagtgatatcaggaagtgctcagcctcagttaccaattacaaaattaaaaaaaatacttctccccctccccccactagccctccaaaatgagttcgcagactttgtagttcaggtcgacaaatcacaatttgcttgtgagatagctataaaagtgtggagaaatagcttgaaatttagtataatatag

SEQ ID NO: 2433 - DNA, 3351 bp, Streptococcus pneumoniae
atgggaaattttagctttcttttaaaaaatgacgaatatgaatctttttcaaaaccttgcattgaagctgagaatatgattgctacatcaactgtggctactgcctttatggcgcgtcgtgctttagagcaggctgtccattggatatatagtcacgattcatatttagaagctccctatcgtgctactctatcttctttagtatgggatgatgattttagggatatcgtagattctgaactccacaagcagatagttctgttgattcggtggggaaaccatgctgctcatggtggtgaaattaaggaacgagaagcgattttagctttgcatcatttgtatcagtttgttaattttatcgattattgttacagcaatgagtttgtggagcgttattttgatgagaagtgcttaccactttcagcaaacatcaaataccgagaaactccacaatctatgataaagttacaagacagtttaccagaactgcctgattttcatgaacagatggctgctcagtccgtagaagttcaagagacttatactgaaaaacgtgagactgcagcgcaacggcaagatgtgcctttccatattgatcaattatctgaggcagagacaagaaagctctttattgatatcgatctccgtttagcaggatggatatttgaagaaaactgtcgtgttgagatagccgttgatggtctcaagcacggttcaggaattggttactgtgactatgtactttatggtaaaaatgggaaaattttagcgattgtagaggctaaaaaagcctctgtcaatccagaagtaggggaagtacaggtcaaagaatatgctgaagctcttgagaaacatatcggctatcagccaatttgctttattacaaatggcttgaagcactatatacttgatggtccgaaccgccgccagattgcaggcttttactctcaagaagaattgcaattagtgatggatagacgtcatcttcaaaaaccacttgaggatatttctagtaaaattagggacgatatttccgggcgtcactaccaaaaacacgccattgcaagcgtttgtgaagctttctctaatcatcgtagacaggcacttttggttatggcaactggggctgggaaaactcgtacagcagtttctctagttgatatcttatcacgtcataactgggtaaaaaacgttctcttcttagccgatagaacttccttggttaagcaagcctatgattcgtttagaaaattactcccagatctttccgtttgtaacttcttagaagataaagaaggagctcaatcaagtcgcatggtcttttcaacttatccgaccatgattggagcgattagtggtcaagaagaagtaaatcaacgccctttcactgttgggcattttgaccttatcataattgacgaatctcaccgttctatttatcagaaatacaagtccatttttgattattttgatgcaagaattgtaggcttaacagctactccgcgtcaagatttagataaaaacacctatggattctttaatttggagaatggggttccaacatatgcatatgatttggaagaggctgttaaagacggatatttagtagcctatcattctatcgaaaccaaactgaaactacctacggatggtctacattatgatgatttgtccgaagaagaaaaggaacattttgatagcaaatttgaagacgatagctgtgaaaaagatattgatgggagtgtatttaattcctttgttttcaataaaagtacagtagaaattgttttaaatgaactcatgacaagaggaattcagacagcctcgggtgatgaaattggtaaaactattatttttgctaaaaatcatgatcatgcggaatatatcagaggtatttttaacaaccgctatcctgaaaaagggagcgactatgctcaggtgattgattatagtattaagcattatcagaccttgattgatgattttaaaattaaggagaagtatcctcaaattgcgatttctgtcgatatgttagatacaggtattgatgtaccagaggttgttaatttagtcttcttcaagaaagtacgctctaaaactaagttttggcagatgattggtcgaggaacccgtctatgtaaagatttatttggacctgagcaggataaggaaaacttcttggtatttgattatggggataattttgattattttcgtgcagatccaagagatggagagggtcgtcacattgtttcgttgactcagcgtttatttaatatcaaagtggacttgattcgagaacttcagggactccaataccaagaagatcagtttgcgagagcataccgtcagcagcttgtctcggaacttcaaggtcgtatagagagcttaaatgagttggacttcagggttcgtatggttttagatacagtttatagctataggaaattggaaagttggcagaatctaactgctgttacaagtgaaaccattcaaaaaaatctctctccgcttttatttgatgaagataaagaagatgagatggcgaggagatttgatttgtggttgcttcatattcagttggggcaactgacagctaaatcttccactgttcatatttcccaagtgatgaagacggctagagctctttctgctattggcaatatcccgcaggtttttgagcaggctgaaattatcaggaaagtacaggagcctgaattttggaaagaagttaacttgtctgatttggaaaaaattcgtcttgctattcgagatttattacagtttttggataaaacagaccgtaaaccctactatgttaactttgaagatcgtatactctccactgttcacgagaccacagcatttttgcaggtcaacgatcttcggtcttacaatgaaaaagttgagcattatttgaaaactcatctggatgaggagtccatttctaagctataccataataaaaagttgacatctgatgatatgcttgcacttgaaaaattgctctgggaaaaattaggtagtaaagcagactaccaaagtcattatgaaaataaggcaattccgagattggttcgtgagattattggcttagatagagagtctgccaatcgtattttttctaaatttttgtcggatgagaatcttaatgccaggcagatttcatttgtaaaattgattgtagactacattgtagaaaatggttttttagagacgaaagtgttaacgcaagagccgtttaaatcttatggttctgttcaactactcttccaacaccaactaccagtacttcgtaatattgttcaaatcattgaacttatcaataatcgagctggagaagcggcttaa

SEQ ID NO: 2434 - DNA, 471 bp, Streptococcus pneumoniae
atgaataaatcagaacaccgccaccaacttatacgcgctcttatcacaaaaaacaagattcatacacaggctgagttgcaagcccttcttgctgagaacgacattcaagtaacccaggcaaccctctcacgcgacatcaaaaatatgaacctatcaaaagtccgcgaagaagatagcgcttattatgttcttaacaatggttccatctcaaaatgggaaaaacgtctcgaactctacatggaagacgcccttgtctggatgcgcccagttcaacaccaagtcctactaaaaacccttcctggactggctcaatcctttggttctatcattgatactttgagcttccctgacgctatcgctaccctttgtggtaatgatgtctgtcttatcatctgtgaagatgcagatactgctcaaaagtgctttgaagaactgaaaaaattcgccccaccatttttctttgaagaataa

SEQ ID NO: 2435 - DNA, 2274 bp, Streptococcus pneumoniae
atgcgttttaatcaatatagttatatcaattttccaaaagaaaatgtcttatctgaactaaaaaaatgtggctttgatttacaaaatacagccaatcacaaagactcacttgaaacctttttacgtcgtttctttttcacttatcaagacaccaactacccactttctatcctagcagctgataaaaaaacagacctgctgacattttttcaatcagaagatgaactgacagcagatattttttatactgttgcttttcaacttttaggcttttcttatttggttgacttcgaagatagtgacgtttttcgtaaagaaactggatttcccattatatatggtgacttgattgaaaatctctatcagttactcaatactcgcaccaaaaaaggaaatactcttatcgaccaacttgttagtgatggtcttattccggaggataatgactaccactactttaacggcaagagtttggctactttttctaaccaggatgtcattcgtgaagtcgtttacgttgagtctcgtgtcgatactgaccaaaaagggctatcagacctagtaaaggttagcattattcgccctcgttttgatggaaaaatccctgccatcatgacagccagcccttatcatcagggaaccaatgacaaggctagtgacaaggctctctacaagatggagggcgagcttgaggttaaacttcctcacaagattgagctagagaaacctcaactaaatctcgtccaaccccaaggtaaagctgagcttatagcagaggctgaggaaaagctaactcacatcaactctagctatacactaaacgactacttccttccgagaggctttgccaatctctatgtctcaggtgttggtaccaaagactcgacaggtttcatgactaatggagactaccagcaaatcgaggcttataaaaatgtcatcgattggcttaacggccgttgccgtgcctttactgatcacacgcgccagcgtcaagtcaaggctgattggtcaaacggaaaagttgctacaacaggactttcctatctaggtaccatgtccaatggtcttgcgactacaggagtcgatggtttagaagttatcattgccgaggcaggaatttcatcatggtacaactactaccgtgaaaacggtctggtgactagcccaggtggttatccaggtgaggactttgactcccttgctgagttaacctattctcgtaatctcttagctggcgactatatccgtggcaatgaagctcaccaagctgacttagaaaaagtgaaagctcagctagaccgaaaaactggggactacaatcaattttggcatgaccgcaattatctgctcaatgcccataaagtaaaggcagaggttgtctttactcatggttctcaggattggaatgtcaaaccacttcatgtttaccagatgttccatgctcttcctactcatatacacaagcatctctttttccataatggtgcccatgtttacatgaacaattggcaatcaattgacttccgtgagtccataaatgccttattgaccaagaaattactaggacaggaaacagactttcaacttcctactgttatctggcaggacaatacagctccacagacttggttatcacttgataacttcggtgggcaagaaaactgtgaaaccttctcacttggtcaagaagagcaagctattcaaaaccagtacccagataaggattttgagcgctatggtaagacataccaaaccttcaatacagagctctatcaagggaaagccaatcagattactattaaccttcctgtgactaaagatctccacctaaacggtcgcgctcagctcaatcttcgtatcaaatccagtacaaacaaggggctcttatctgcccaactgctagaatttgggcaaaagaaatacctacaaccttatccagctattttaagtgctagaaccattgacaacggtcgctatcacatgttggaaaatctctgtgaattgccatttagaccagaggcacaacgagtcgtgacaaaaggttaccttaatttacaaaatagaaatgatttactgttagtagaggatattactgcagatgaatggatggacgttcaatttgaactgcagccaactatttacaagctaaaagaaggagacactctccgtttagtcctctatactactgactttgaaatcaccatccgtgacaatacagactaccacttgactgtcgacctcgctcagtccatgcttaccttaccttgctaa

SEQ ID NO: 2436 - DNA, 3102 bp, Streptococcus pneumoniae
ttgatcgcacaactagatacaaaaacagtctatagttttatggaaagcgtcatttcgatcgaaaagtatgtgagagcagctaaagaatacggctacactcatttggctatgatggatattgacaatctttatggcgctttcgactttctagagattacaaaaaaatacggcattcatcctttgctagggcttgaaatgacagtgtttgtagatgatcagggagtaaatttgcgctttttagctctatctagtgtgggctatcagcagttgatgaagctttcgacagccaagatgcagggggagaaaacttggtcagtcctgtcccagtacctggaggatatcgcggtcattgtgccttattttgatagagttgagtcgttagaactaggctgtgattactatataggggtttatccagaaacactagcaagcgaatttcatcatcctatcttacctctttatcgggtcaacgcttttgaaagcagggatagagaagttcttcaagttttaacagcgattaaagaaaatctaccgctcagagaagttcccttgcgttcgagacaagatgtctttatatcagcaagttctttagagaaactattccaagagcgttttccgcaagctttggacaatttagaaaagcttatttcaggcatttcttacgacttggatactagtctgaaactgcctcgttttaatccagctagaccagcagtagaggagttgagagagcgtgctgaactggggcttgttcagaaggggttgactagtaaagaatatcaagatagactagaccaagaattgtctgttattcatgatatgggctttgatgattatttcttggttgtttgggatttgttgcgttttggacgatcgaatggctattatatgggaatgggaaggggttctgcagtaggcagtttggtttcttatgccttagacatcacggggattgacccagtagagaaaaatctgatttttgaacgctttcttaatcgtgaacgctataccatgcctgatattgatattgatatcccagatatttatcgtccagattttatcagatatgttggtaataaatatggtagtaaacatgcggcacaaatcgttactttttcaacctttggagccaagcaagctcttcgagatgtcttgaaacgctttggtgtgccagagtatgaattatctgcaattactaagaaaatcagttttcgtgacaatcttaagtcggcctatgagggcaatctccagtttcgtcagcaaatcaatagtaagttagaataccaaaaagcttttgagattgcttgcaagatagagggctatccaaggcaaacctctgtccatgcggctggtgttgtaattagtgaccaagatttaaccaactacattcctctaaagtatggtgatgaaattccactgactcagtatgatgctcatggagttgaggctagcggacttttgaagatggactttctgggactacgaaatttgacctttgtccagaagatgcaagagttgcttgctgaaatagaaggtattcaccttaaaattgaagaaatagatttggaagacaaagaaacgttagatttatttgcctctggaaatacaaaaggtatctttcaatttgagcaacctggtgctattcgcttgctcaaacgtgttcaaccagtctgttttgaagatgtcgtagcaactacttctctaaatcgaccgggtgctagtgactatatcaataattttgtggcaagaaagcatgggcaggaagaagtgactgttctggatccagtactggaggatattttggctccaacctacggcataatgctctatcaggagcaggttatgcaggttgcccagcgatttgccggatttagtcttgggaaagccgatattttgcgtcgggctatggggaaaaaggatgcctctgccatgcatgagatgagggcttcctttattcaaggttcattagaagctggtcatactgtggaaaaagcagagcaggtctttgatgttatggagaagtttgcaggctatggttttaacaggtcacacgcctatgcctactcagcattggccttccagttggcttattttaaaacacattatccagccatattttatcagatcatgttgaattctgccaacagtgattacttaatagatgcacttgaagcaggttttgaagtggcgcctctgtccatcaacacgattccctatcacgataaaattgccaacaaggccatctatctaggtttgaaatccattaaaggagtcagtaatgatttagctctctggattattgaacatagaccttattctaatattgaagattttatagctaaattacctgagaattatctgaaacttcctctgctagaacctttggtaaaagttggtcttttcgattcatttgaaaaaaatcgtcaaaaagtatttaataacttagctaatctatttgaatttgtgaaagagttgggaagtttgtttggagatgctatttatagttggcaggaatcggaagattggacggaacaagaaaaattttatatggaacaagagcttttagggataggtgtcagcaaacatccactacaagctattgcaagtaaggctatttacccgattaccccaatcggaaatttgtcagaaaatagctatgctattattttggttgaagttcagaaaataaaagtgattcgtaccaaaaagggtgaaaatatggccttcttacaggcagatgatagtaagaaaaaattggatgtcactctcttttcagacttatatcgtcaggttggacaggaaataaaagagggagccttctactatgtaaaaggaaaaatacaatcacgtgatggccgtctgcaaatgattgcacaagaaataagagaagcagttgctgaacgcttttggatacaggtgaaaaatcatgaatcggatcaagaaatttcacgtattttagaacaatttaaaggcccaatcccagtcatcatccggtatgaagaggaacagaaaaccatcgtttctccccatcattttgtagctaaatccaatgaattagaggagaaattgaatgaaatcgttatgaaaacgatttatcgctaa

SEQ ID NO: 2437 - DNA, 189 bp, Streptococcus pneumoniae
atggcagcgttcataccaggtgcgtctccgccactagtcaaaacagcaatacgtttcatattggtttatgctcctttttcttttaacattcttcttgattatatcacatttgattttaaaattcttctattttccgtatttttagcgataaatcgttttcataacgatttcattcaatttctcctctaa

SEQ ID NO: 2438 - DNA, 1008 bp, Streptococcus pneumoniae
atgaaacgtattgctgttttgactagtggcggagacgcacctggtatgaacgctgccatccgtgcagttgttcgtcaagcaatttcagaaggaatggaagtgtttggtatctatgacggatatgctggtatggttgccggtgaaattcatcccctagatgcagcttcagtaggggacatcatttctcgtggtggtacttttcttcactcagctcgttatccagagttcgctcaacttgaagggcaacttaaagggattgagcaattgaaaaaacacggaattgaaggtgtagttgttatcggtggtgacggatcttaccacggcgctatgcgtttgactgaacatggcttcccagctattggtcttccaggtacaatcgataacgatatcgttggtactgactttacaatcggttttgacacagcggttactactgccatggacgctatcaataaaattcgtgatacatcatcaagtcaccgtcgtacttttgtaatcgaagttatgggacgtaacgctggtgatatcgctctttgggctggtattgcaactggtgctgatgaaatcatcatccctgaagcaggcttcaagatggaagatatcgtagcaagcatcaaagctggttatgaatgtggtaaaaaacacaatatcatcgtcttagctgaaggtgtgatgtcagcggctgaatttggtcaaaaacttaaagaagctggagatacaagcgaccttcgtgtaacagaacttggacatattcaacgtggtggttctccaactgcgcgtgaccgtgttttggcgtcacgtatgggtgcacatgctgttaaacttcttaaagaaggtatcggtggtgttgcggttggtattcgtaacgaaaaaatggttgaaaatccaattcttggtactgcagaagaaggggcattgtttagccttactgcagaaggtaagattgtggttaacaacccgcacaaagccgatattgagctatctagcttgaataagagcttgtcataa

SEQ ID NO: 2439 - DNA, 708 bp, Streptococcus pneumoniae
atgaacaaacgtgtaaagatcgttgcaactttgggtcctgcggtagaaatccgtggtggtaaaaaattcggtgaggatggatactggggtgaaaaacttgatgttgaagcttcagctaaaaacattgctaaattgattgaagctggtgctaacacattccgattcaacttctcacacggcgaccaccaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatataaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagaatgtgaacgaagttcgtgcaatctgtga

SEQ ID NO: 2440 - DNA, 915 bp, Streptococcus pneumoniae
ttgctgaacgcgataacgacgatatccgtttcggtcttgaacaaggtatcaacttcatcgcaatttcattcgtacgtactgcaaaagaatgtgaacgaagttcgtgcaatctgtgaagaaactggaaacggacatgttcaattgttcgctaaaatcgaaaaccaacaaggtatcgataacttagacgaaattatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagacgtattcaacgctgttatcgacggaactgacgctacaatgctgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaa

SEQ ID NO: 2441 - DNA, 222 bp, Streptococcus pneumoniae
ttgtcgattgtagccattgtagttactgactcgagtgggtatttaccgtttgcagactcgcctgacagcattgtagcgtcagttccgtcgataacagcgttgaatacgtctgatacttctgaacgagttgcacgtggtttttcagtcattgtttcaagcatgtttgttgcagtgataacaactttacctgcagcattgactttcttgataatcattttttga

SEQ ID NO: 2442 - DNA, 201 bp, Streptococcus pneumoniae
agaaaggcatttaacatcactttgcaaaaggcaaatactaaactagagaaaccgataaaccagccccttagttcccatattttcaggcacacactccttagtacactagctgagaagaatgctataatggttagagtggaacacaaaaacgctaaaacagtaaataacatctacactcacgtaagtaaaagaatggagtaa

SEQ ID NO: 2443 - DNA, 303 bp, Streptococcus pneumoniae
ccgctcgatgcaggacaacgatttagatatggagtttccattatcccagacgactacgacccaatcgcttatgtcgtcagcaagtccatggagccaaagataagaaacagcgactacctatttatcaagaataccccacagattgactataataccatcggcatcttccaagtagacggcgctaactatgtcaagaaactccgccaaggctaccttaaaaaaactcaatcccaaataccccgacatccacctagacgaaagcaaccatattcgtaccatcgggaaagttgtcaggctatatag

SEQ ID NO: 2444 - DNA, 255 bp, Streptococcus pneumoniae
ttggatactaagataggtataagtaaaaacaccattagaaattatgaaaaaagggttaggtctactaagaaaaatactatatttgacttagttaaagtattcagtagcttgattgatgccctcttttctccagttcaaaaggattctcctagcgatatccaatctatctacgaccaacgggcaccacccagacaaggtaaagttctgacctatgccgagaggcaactgtatgatcagaaaaacgaagtatcgtaa

SEQ ID NO: 2445 - DNA, 873 bp, Streptococcus pneumoniae
atgaagaaatcaagaaaattagccacattaggaatctgttcagctttgtttttaggcttggctgcttgtcaacaacaacatgctacttctgaggggacgaatcaaaggcaaagcagttcagcgaaagttccatggaaagcttcatacaccaacctaaacaaccaggtaagtacagaagaggtcaaatctctcttatcagctcacttggatccaaatagtgttgatgcattttttaatctcgttaatgactataataccattgtcggctcaactggcttatcaggagatttcacttcctttactcacaccgaatacgatgttgagaaaatcagtcatctctggaatcaaaagaagggcgattttgttgggaccaactgccgtatcaatagttattgtcttttgaaaaattcagtcaccattccaaagcttgaaaagaatgaccagttgcttttcctagataatgatgcgattgataaaggaaaggtctttgattcacaagataaggaagagtttgatattctattttcgagagttccaactgaggcaactacagatgtcaaggttcacgctgaaaagatggaaacattcttctcacaatttcaattcaatgaaaaagctcgaatgctgtctgtagtcttgcacgacaatctggatggcgagtatctgtttgtaggccacgttggggtcttagtacctgctgatgacggtttcttatttgtagagaaattgactttcgaagagccctaccaagcgattaaatttgctagtaaggaagattgctacaagtatttgggcaccaagtatgcggattatacaggcgagggactggctaagccttttatcatggataatgataagtgggttaaactttaa

SEQ ID NO: 2446 - DNA, 384 bp, Streptococcus pneumoniae
atgaattatgaagcaagtaaacaactaactgatgcacgatttaaatgtcttgttggtgttcagcgcaccacttttgaagagatattagctgtattaaaaactgcttatcaacttaaacacacaaaagggggacgaaaacctaaattaagcctagaagaccttcttatggccactcttcaatatgtgcgagaataccgcacttatgaacaaattgcggctgtttttggtatccacgaaagcaacttactccgtcggagccaatgggttgaagtaactcttgttcaaagtagttttacgatttcaagaactcctctcagttctgaggacacggtaatgattgatagacattcccatcaatatcgtatctttggacatagccaataa

SEQ ID NO: 2447 - DNA, 312 bp, Streptococcus pneumoniae
atggaattaaaagattttacagaaaaagaacaggaaatgattaagaaaaggcttacaatgtctaatattagtgacaaagaaactactgagaagattctggcgctagtaccacaagacttgattaagcgaatcccgttttttgtcagaaaacatgctacaacacgtacgattaaacgcatttcaattgaacaccctgaactctacgctgtagctcaaacaagtggtgagattccagaaaaagaatgcgaagaattgcgtcagattatcacaactatctttgaacaaaagatgaataagcatagtattaagtag

SEQ ID NO: 2448 - DNA, 717 bp, Streptococcus pneumoniae
atgaaaaaatattttattggcggtttgggaagcaatgcctatcatagcaaggattttcttcaagaactagattcgcaggtctattttctaaatccatatgaaaagcatcttcgagatgaaacagaattgaaatcatggtttaaaaatgagattgtagaggaagaatttatctgtctgataggtcattctcttggaggagatttagctcgttatctcgcatcggaatttgaagaagtaaagaaactgattcttttggatggtggctatctagatttagataagattttacctttggatacagagttagaggaaactaaaaattatatcaaatctcaaattgttttggacttagatgttcttacttctaaagaaaaatctgaagcaaagcattggtcagaaaatatggagaaagctgtaagacagtcctatcactggaatgttgagtataatagatatgagttggctataaattatgaaaatatagaagcgatactccgcctacggagaaaaatacaagcttttaagagagaagtgggagataccttgtttattagtcctcgctatcctaatgaagctacatggagagaggaagccctaaaagaattgccagactattttgatactatttttttagaaaactttggccatgagctttatactcaagcacctaaagaaatcgctagtctaatgaatgagtggctcgcttattttctatga

SEQ ID NO: 2449 - DNA, 396 bp, Streptococcus pneumoniae
ttgttcgtttttatcttgattttcttaaaaagctctatatacatagggattttctggtttatcgactttggtaaagctgtcgatttccaaggttggaaggttttgtttgagttctttatggtagtgattgaccagttttcctttggctgttatccaagtgttgttttcatactgccgggtattgcccttggtcagcaatccatagacaccagaatctgcgatacagtggataatgccgaatcggaacagaaattgactattggcatgactggggtcgttatagacaaagcctgtaaactggattgtcttgccctcaaactcatctggatagtcgtagatagcctccatgacttccatatagttttcattagtgatctgaatactatcttgggataa

SEQ ID NO: 2450 - DNA, 816 bp, Streptococcus pneumoniae
atgattcgatttttagttttagctggctattttgaactgactatttacctccatctgtcgggcaaactaaaccagtacatcaacatgcactattcctatctggcctatatctccatggtgctttcttttatcttggctatcgttcaattgtatatctggatgaagcaagtcaaaacccacagtcatctgaacagccgattagccaagatgacgagtatttctcttctggctattccacttgtcatcggcttaactttcccaactgttagcttggattctcagactgtttctgctaaaggttatcatttccccctatcggaaggaacggatctagccattcagacaagcgaagggacgacaagccaatatttgaaaccagataccagttcttatttttcaaaatcagcctatgaaaaggaaatgcgaacggcggcggataaatacttatcccaagatagtattcagatcactaatgaaaactatatggaagtcatggaggctatctacgactatccagatgagtttgagggcaagacaatccagtttacaggctttgtctataacgaccccagtcatgccaatagtcaatttctgttccgattcggcattatccactgtatcgcagattctggtgtctatggattgctgaccaagggcaatacccggcagtatgaaaacaacacttggataacagccaaaggaaaactggtcaatcactaccataaagaactcaaacaaaaccttccaaccttggaaatcgacagctttaccaaagtcgataaaccagaaaatccctatgtatatagagctttttaa

SEQ ID NO: 2451 - DNA, 906 bp, Streptococcus pneumoniae
atgactgcttttcaacaactcccatctagtgtacttcaaactggagccatttttctctccattatcattgaagcccttcccttcgttctgataggaagtattgtctcagggctgattgaagtttatatcacacctgacaaggtttatcattttctccctcgaaatcgttgggggagaatcttttttgggacctttgtcggtatacttttcccttcctgtgaatgtggaatcgtccccatcatcaatcgttttctggaaaaaaaggttccaagttacacggccgttccttttcttgtgacagcacctgttatcaatcccattgttctttttgcgacctattctgcctttggcaactccttccatgtcgccctattacgagctctgggttccatcgttgtggctgtaatactaggaatttttctaggatttttctggcaagaaccgattcaaaaagaaaatcgtctagcctgtcatgagcatgatttttctcacttaagtcctgcaaaaaaagtttttcaggtctttgtgcaagccattgatgagttttttgatacgggacgttatttggtatttggctgtctctttgcctctgttatacaggtttatgttccgactcggattctgacctctatcagtgcgactcctctttttgccatcctgctcttgatgattttggcctttcttctttcgctctgtagtgaggcggatgcctttatcggggcttctctactctcgagtttcggtttggctccagttctggcttttctcgtcattggcccaatgctggatatcaaaaatattcttatgatgaaaaattacttgaaagcacgatttattagtcacttcattacgattgtgactctggtcgttttagcctattctctcttgattggagtcatcctatga

SEQ ID NO: 2452 - DNA, 2130 bp, Streptococcus pneumoniae
atggataaaaaatatgaaaaaatctctcaggatttgggagtgacgttaaagcaaattgataccgttctaagtttgacagctgaaggggcgactattccctttatcgcgcgttatcgcaaggacatgactggtagtctggatgaggtggcgattaaggctattattgatttggataaaagtctgacaaatctcaatgaccgtaaggaagctgtcttagctaagattcaagaacaaggtaagttgaccaaggaattggaagaagctatcttagttgccgaaaaattagcagacgttgaagaactctatcttccttataaggaaaagcgtcgtaccaaggcaaccattgcccgtgaagctggactctttcctcttgctcgcttgattttgcagaatatagttgacttagagaaagaagctgaaaagttcgtctgtgaaggatttgcgactggcaaggaagccttgaccggtgcagttgatattttggtcgaagccttatcggaagatgtgaccttgcgttctatgacttatcaggaagtgctgagacactctaaactcacttctcaagccaaggatgaaagtcttgatgaaaagcaggtttttcagatttattatgatttttcagagacagttggaactatgcaaggctatcgtaccttggctctcaatcgtggggagaaacttggtgtcttgaagatcggttttgaacatgcgacggaccgtattcttgccttctttgctactcgtttcaaggtgaaaaatgcttatattgatgaagttgttcagcaatccgttaagaaaaaggtcttgcctgctattgagcgtcgtattcggacagaattaactgagaaagctgaagagggagctatccaacttttttctgacaatctgcgcaatctcctcttggttgctccactgaaagggcgcgtggttcttgggtttgacccagcctttcgtacaggtgccaagctagctgtcgtggatgcaacaggaaaaatgctgacaactcaggttatttatcctgttaaaccagcatcagctcgtcaaatcgaagaagccaagaaagatttagcagatttaattggtcaatacggtgtagagattattgccattggaaatggaacggccagtcgtgaaagtgaagcttttgtagcggaagttctgaaagatttccctgaagtcagctatgttatcgttaatgaaagtggtgcttctgtctattctgccagcgaacttgctcgtcaggagtttccagacttgaccgttgaaaaacgctctgccatttctatcgcccgtcgtttgcaagatcctcttgcggaattggtcaaaatcgatcctaagtcaattggtgtcggtcaataccaacacgatgtcagtcagaagaaactctctgagagtctggactttgttgtcgatacagtggttaaccaagttggtgtcaatgtcaatacagctagcccagctcttctttcacacgtagctggactcaataaaaccatttctgaaaatatcgtcaaataccgtgaggaagagggaaaaatcacttcacgctcccaaatcaagaaagttcctcgtctgggagccaaggcctttgagcaggctgctggtttccttcgtatccctgaaagtagcaatatccttgataatacaggagttcacccagagaattacactgcagttaaggaactcttcaaacgtttagatattaaagacctaaacgaagaagcccaaagcaaactcaagtccctttcagtcaaggaaatggctcaagagctagacctcggtccagaaacccttaaagatatcattgcagatcttctcaaaccaggtcgagatttccgtgattcctttgacgcacctgtgcttcgccaagatgtcctagatatcaaagacctagtggtaggtcagaagctagaaggtgttgtgcgtaacgttgttgacttcggtgccttcgttgatatcgggattcacgaggacggcttgattcatatttctcatatgagtcgcaagtttatcaaacaccctagtcaagtggtgtcagttggagatttggtgagcgtttgggttaagcaaattgatactgaacgtgaaaaagttaatctgtctctcctagctccaaatgaaactgactga

SEQ ID NO: 2453 - DNA, 450 bp, Streptococcus pneumoniae
atgaaactgactgattacgtcaagcaggtttcactagaagacttcggcagaccttttatccatcatgtccagtggaataggcgtctacgttcgacaggtgggcgatttttccccaaagatgggcatttggattttaatcccaaggtttatcaggaactggggttggacgtttttaggaaaattgtccgacatgaactctgtcattatcacctttatttccaagggaagggctatcaacacaaggatcgggattttaaggaacttttgaaagcagtggatggattacggtttgtaccatccttgcccaatagtaactccaaaccactcaagctctatcgttgccaatcctgccagcaaacttatcagcgcaagcgtaggattgataccaaacgctatcgctgtggactttgtcgaggtaaattgcttctgataaatcagcctgaggactga

SEQ ID NO: 2454 - DNA, 255 bp, Streptococcus pneumoniae
atgtctaacctagcagaaagaggaaatatcatgaacagtaaattttataaaatgagacgcaatcgcatgatttcaggagttctggcaggtctgtcagacaagtggaattttgatgttaccctagttcgtttcttgtttgccatttttacagttgcaaactttggacttggcgtgattatctatatcatcctagcttctatcatgcctaccaaggaagaaatcgaagcagaaatgtacggaacaggcccacgttaa

SEQ ID NO: 2455 - DNA, 192 bp, Streptococcus pneumoniae
atgaaacacaaagaacatatactcatcggacttctctatctgctctctccattcatcggtcagctcttagttgaacacacacactttatcggtacagaatttaccgggactgcttatgttatttgctggttatcagttgttatcagcacccaccatttttccaaaaatgtttggtctcagcagcaaaaataa

SEQ ID NO: 2456 - DNA, 759 bp, Streptococcus pneumoniae
atgacacttttagatgtaaaacacgttcaaaaaatttataaaacacgttttcagggcaaccaagtagaagccctcaaggatattcactttaccgtcgaaaagggtgactacgttgccatcatgggtgagtctggttctggtaaatcaactcttctcaatattctagctatgctggataaaccaagtcgtggtcaggtttacttgaatggaactgacaccgcaaccattaaaaattcacaggcctctagcttccgtcgtgaaaagttgggctttgtcttccaagactttaacttgctagatactctatctgtaaaggacaatatcttgcttccgcttgtcttgtcaagaagacctattacagagatgatgaagaaattggtggtgacagctgagaatctgggaataaaccaattacaagagaagtacccttacgagatttctggtggccagaaacagcgtgtagcagtagcacgcgccatcatcactgaacctgaaattctccttgcggacgaaccgacaggagctcttgactccaagtcatctgcagccttacttgatgtctttgatgaaatcaatgagcgcggccaaaccattctcatggtaacccactcaacagcagcagctagcagagctaaacgtgtactctttatcaaagacggcattctttacaatcaaatctaccgtggagagaagacagaacgtcagatgttccaagaaatctctgataccttgactgtcatggcaagcgaggtgaattag

SEQ ID NO: 2457 - DNA, 225 bp, Streptococcus pneumoniae
ttgataaagagtacacgtttagctctgctagctgctgctgttgagtgggttaccatgagaatggtttggccgcgctcattgatttcatcaaagacatcaagtaaggctgcagatgacttggagtcaagagctcctgtcggttcgtccgcaaggagaatttcaggttcagtgatgatggcgcgtgctactgctacacgctgtttctggccaccagaaatctcgtaa

SEQ ID NO: 2458 - DNA, 1989 bp, Streptococcus pneumoniae
atgtttcgattaaccaataagttagcggtatcgaacttgattaaaaaccgcaaactctactatccttttgcgctggctgttctcttggcagtcactctcacctatctcttttactctctaaccttcaatcctaagattgcggaaatccgtggaggaacaaccattcaggctacacttggatttggtatgtttgtcgtcacccttgcgtcagccattatcgttctctatgccaatagttttgtcatgaagaaccgttccaaggaactaggaatttatggcatgttgggcttggagaagcgtcatcttatcagtatgacctttaaggagttagtggtatttgggattctaactgttggagcgggtatcggtattggagccttgtttgacaagttaattttcgctttcctgctcaaactaatgaaattgaaggttgagctggttgctaccttccagacgaaagttgtcattacagtgcttgttgtcttcggtttgattttcctaggcctcatgttcctgaatgcccttcgaatcgcccgtatgaatgccctccagctctctcgtgagaaagctagtggagagaaaaaaggtcgcttccttcctctccaaaccattcttggttccataagtttaggaattggctattatcttgcccttacggtaaaagatcctcttacagccttaacaaccttcttcatagctgttttactggttatctttgggacttatctcttgtttaatgcagggattaccgttttcctccaaatcttaaagaaaaataagaaatactattaccaaccaaataacctcatatctgtttctaacttgattttccgtatgaagaaaaatgcagttggactagcaactatcgctattttgtcaacaatggttttggtaaccatgtcagcagcgacaagcattttcaattccgcagaatcctttaaaaaagttctaaatcctcatgattttggggtttcaggacaaaatgttgaaaaagaagatttggacaaactcttgagccagtttgcaagtgacaatggttataagattaaagaaaaagaagtgtttcgttacacttactttggtgttgcgaaccaagaaggaaataagttaaccttttttgaaaaaggacaaaatcgtgtccaacccacaacagttttcatggtatttgaccaaaaagattatgaaaatatgactggtcaaaaactgtctctatcaggaaatgaggtcggtctctttgccaaaaatgacggactgaaaggacagaaaactctaattctgaatgatcatcaattttctgtaaaagaagaatttaataaagattttattgtcaaccatgtcccaaatcagtttaatattttgactgctgattacaattaccttgttgtacctgatttacaagcctttttgaaccaattcccagattcggatatctataatcagttttacggtggtatgaatgtaaatgtcagtgaagaagaacaactcaaggtcgctgaggagtatgaaaactacctcaatcaatttaatgctcaattagacacagaaggtagctatgtttatggtagcaatctagcagatgctagttctcagatgagtgccctctttggtggtgtcttctttatcggtattttcctatccattatctttatggtcggaactgttctggtcatctactacaaacaaatttctgaaggctacgaagaccgtgaacgctttattatcttgcagaaagtcggtttggaccaaaagcaaatcaagcaaaccatccacaaacaggttttaactgttttcttccttcctttgctctttgccttcatacatctcgcctttgcctaccatatgcttagcctgattttaaaagtgattggtgtactggatacgactatgatgttgattgtgaccttgtctatctgcgctatcttcctcatcgcctatgtgctgattttcatgattacttcaagaagttatcgcaagattgtgcaaatgtaa

SEQ ID NO: 2459 - DNA, 591 bp, Streptococcus pneumoniae
gtggttatcggggttgccagtgccacgaccaatatctggattatctttttatcaggatttgcggctatcttagctggtgccttttcaatggctggtggagaatatgtatccgtttcaactccaaaagataccgaggaagctgccgtttcgcgagaaaaactcttgttagaccaagatagggaactagccaaaaaatccctctatgctgcttatatccaaaatggagaatgcaaaacttctgcccaactcttgaccaataagatctttcttaaaaatccactcaaggctctggtagaggaaaaatatgggattgagtatgaagaatttaccaatccttggcacgctgccatttctagcttcgttgcctttttccttagaagtttgcctccaatgctgtcagtgaccatattcccaagtgaatatcgcatccctgctactgtccttattgtcggtgtggcccttcttctcactggttacactagtgccagacttggaaaggatccgactagaacagctatgattcggaaccttgctattggtctcttgaccaggggagttaccttcctgctcgaacaacttttcagcatttag

SEQ ID NO: 2460 - DNA, 1095 bp, Streptococcus pneumoniae
gtgttatacttgttgttcaaccacaaacacaagaaaggcacagaaatgcaagacaattatactacaaaaggtaaacatttgacaatcgatagccgtcgcttaatcgaaagatggaaaaaagaaggaaaatcaaatagagaaattgcctctctacttggaaaagctcctcaaactatccacactaaaatcaagcgtaggacagtccgaaaatgtcttggaaaagggcgcttcaaagaggtttattctgccgactatgctcaacagtcttatgaaaacaatcgcaagcgctcggtcaagaaatcaagcttgaccaaggaactaaaggaaaagattctccactatcataaccaaaaattttcgcctgaaatgatggtgatggctaaaggggttaacgtgggaatttcaaccatttactattggattcatcatggaaaattggggttaagcaagcaggatctgctttaccctagaaaaggaaaagtgcttaagaaacaggctagcaccaactttaaacctgctggtcaatccatcgcacagcggcctgaagctatcaatcttcgcttggagaatgggcattatgagattgatacggttttacttacgagatcgaaaaactactgcttgcttgtcttgacggatcgaaagagtagacatcagatcatccgattgattccaaataaaagtgctgaggtggtcaatcaggctctaaaactcatcttaaaacaacacaagattctttccatcacggcagataatggaacggaattcaatcgcttgtctgatgtattttctgaggagcacatttattatgcgcacccctatgcctcttgggaaaggggaactaatgagaatcacaacaggctcattcatagatggttacctaagggaaccaagaaaatgactcccaaagaagtcgcattcatcgaaaagtggattaacaactatcctaaaaaatgcttgaactacaagtcacccagagaagacttcttgatggctaacttgaacttgaaatttagcgtcagaaacaaatcacgaaatcgattcaaattttgcaggtcgtttaaatatcctgcgcgcaggtgttcttggtgctaa

SEQ ID NO: 2461 - DNA, 183 bp, Streptococcus pneumoniae
gtggcttttcaaccacgcttcggcattcaaccctgcctgtccgtaggcattttttactcgggtttatatttgctagaaaacatcatctcattttctaagctttattactatatcatgtttttaagaacttgtaaagtattttttgataaaaaacaaaaatataatagattgaaactagaatag

SEQ ID NO: 2462 - DNA, 1476 bp, Streptococcus pneumoniae
ttgaaagagttagatcaaaaccaagccccaatttatgaagccttggtgaagttacgcaagaaaaggattgttccctttgatgttccaggtcacaagcgtggacggggaaatccagaacttgtcgaactcttaggagaaaaatgtgtaggcattgatgtcaattcgatgaaacccttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccatggagcgcatttgcatttcactggtaaacttccaatttctgctatggatgcaggagctgatatggcagcagtttccatgcataagtctggtgggagtttgacacaaagttcgcttcttttaatcggggagcagatgaatcccgagtacgttcgtcagattataaacctgacccagtctacatctgcctcttacttattgatggctagtttggatatttcacgtcgcaacttggcccttcgtggtaaagagtcgtttgaggaagtcattgagctatccgagtacgctcgtcatgaaatcaatgccattggcggttactatgcttactcaaaagagttaatagatggtgtgtcggtctgtgattttgatgtaaccaagttgtcagtttacactcagggaataggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcacgagatgggaaggacttaatagctggagaatatattcagcccgagttggtgctgtctccacaagaagccttctattcagagagaaaaagtttgaccttagatgagtctgttggacaggtctgtggagaatttgtcatgtgctatcctccagggattcctatcttggctcctggtgaacgcattacacgagaaattgtagactatatccaattcgccaaggaacgtggttgctccctccaagggacggaagatccagaggtcaatcatatcaacgttattaagagaaagacaaactataagaaaagtcaatag

SEQ ID NO: 2463 - DNA, 237 bp, Streptococcus pneumoniae
ttggataaaatcgttggaaagcattcagaatatacctaccaactcttgacacgctaccctaatcctcagaaaaggattgaggcaggatttgataagctgatagaaattaagcgattgaccgcttctaattcaagggctttttgccgtgctctaaaatcatcgccaaatcatcaaattgaaataagaaatagtttagataaaactattgacttttcttatagtttgtctttctcttaa

SEQ ID NO: 2464 - DNA, 528 bp, Streptococcus pneumoniae
atgctttatgtgggcattgatgtcgctaaaaataaacacgatgttacagccttgaatgttccaggaaaaactgttcttaaaccactcactttttcaaataataaagctggttttgaactcttagatctgtctcttcgacaactcaaccaagactgtctcatcgctcttgaaaataccggacattatgcctttaatctactgaacttcctgcatgaacaaggatataaagtttacacctacaatcctttgctcatcaaggaatttgccaaatcattatcacttcgcaagactaaaacggataagaaagacgctcatggcatcgctcttaaacttctttctgaccccaatcgtgaacaatttcaacacgataatcggcaagtagaactaaaaatactggctagacatattcatcgtctcaagaaaaacagtctgattggaaagtacaatacactcgttgtcttgatatcatctttcctgagttggataaaatcgttggaaagcattcagaatatacctaccaactcttga

SEQ ID NO: 2465 - DNA, 861 bp, Streptococcus pneumoniae
atggatttatggttttctgaagttcatactccagatgtcaaattgtctctgagaacagccaagcaactttacgctggaaaaagtgaatggcaggatatcgaagtcttggatacgccagcttttgggaaaatactgattttaaatggccatgtcttgttctcagatgcggatgatttcgtctacaatgaaatgaccgttcacgttcccatggctgtccacccaaatccaaagaaagtattggttattgggggtggtgacggcggtgttgcccaagtattaacactctatcctgaactggaacaaatcgatatcgtggaaccggatgagatgttggtcgaagtctgtcgtgagtatttcccagactttgctgcagggctagatgatcctcgtgttaccatttactaccaaaatgggctacgctttttgcgaaactgcgaagatgattacgatattatcatcaacgatgcgacagatccatttggccatacggaaggactctttaccaaggaattctacggcaatagttatcgagctctgaaggaagacggcatcatgatttaccagcatgggagtcccttctttgacgaggatgagtcggcctgccgaagcatgcaccgcaaggtcaatcaagcctttccaatcagtcgggtttatcaggcccatattccaactagcccagctggctattggttgtttggatttgcatcgaaaaaataccaccctgtcaaagattttgacaaggaaggttggaaaaaacgccagcttttcacagaatactacactgcaaacttacacgtgggatcctttatgttgcccaagtatgttgaggacattttagaagaagaggaaggaaaaaaatga

SEQ ID NO: 2466 - DNA, 1260 bp, Streptococcus pneumoniae
atgagtcgtttactagttattggttgtgggggcgttgcccaagttgctatttcaaagatttgtcaagatagcgaaacatttacagagattatgattgctagccgtaccaagtcaaaatgcgatgacttgaaagcgaagctagaaggcaaaacaagtactaaaattgaaactgcagcacttgatgctgacaaggttgaagaagtgattgccctgattgaaagctacaaaccagaagctgttttgaatgtagctctgccttatcaagatttaaccattatggatgcttgtttggcaacaggtgttcactatatcgatacagccaactacgaagcagaagacacagaagaccctgagtggcgtgctatctacgaaaaacgttgtaaggaacttggttttacagcctactttgactactcatggcagtgggcttatcaagagaaattcaaagaagcaggcttgactgctcttcttggttctggttttgacccaggtgtaactagtgtcttttcagcttatgccctcaaacactattttgatgaaatccattatatcgacattttagactgtaatggcggtgaccacggttatccatttgcaaccaactttaatccagaaattaatctccgtgaggtttctgcgccaggttcttactgggaagatgggaaatgggtcgaagtcgaagctatgtctatcaagcgtgagtatgatttccctcaagttggacaaaaagatatgtatctccttcaccatgaagaaatcgaatcattggccaagaacattccaggtgtcaaacgcattcgtttctttatgacttttggtcaatcttacttgacgcacatgaaatgtcttgaaaatgttggactccttcgtacggataccattaactttaacggccaagaaattgttccaattcaatttttgaaagccttgcttccagatcctgctagccttggcccacgtacagtcggaaaaaccaatattggatgtatctttacaggtgtcaaagatggcgttgaaaagactatctacatctacaatgtttgcgaccatcaagagtgctatgcagaagtcgggtcacaagcaatttcatacacgacaggcgttccagccatgattgggacaaaattagtcatgaacggaacttggaaacaagctggagtgtataaccttgaggagttagatccagatccattcatggaagctttgaatgagtatggtttgccatgggttgtggttgaaaatccacaaatggtggactaa

SEQ ID NO: 2467 - DNA, 1128 bp, Streptococcus pneumoniae
atgaagttagaacaagtaccaacaccagcctatgttattgacttggccaagttagaagctaattgccgcattctacaatatgtacaagaagaggtcggttgcaaggtcttgcttgcccagaaggcatattccctctacaaaacttatcccttgattagccagtatctatcaggtacgacagctagtggactctatgaggccaaattggcaagggaagaatttcctggtgaagtccatgtatttgcgcctgctttcaaggatgcagacttggaggaattgctagagataatggaccatatcgtctttaactcagagagacagttgcgtaaacacggtccgcgttgtcgagaggctggtgtcagtgttggtttgcgcctcaaccctcagtgttcaactcaaggagatcacgcgctctatgacccttgtgcaccaggttctcgctttggagttactatagacaagattccgagtgatttgctagatttggttgacggacttcattttcataccctttgcgagcagggagcagatgatttacaaacaactttgaaagcagtagaagaacagtttggtccctacttacatgaggtaaaatggctcaatatgggtggtggtcatcatattacaagagaaggttacgatgtggatttgctgatttcagaaatcaagcgtatccgaaaaacttacaatcttgaaatctatatcgagcctggtgaagccattgcgcttaatgcgggttatttagcaactgaggtattagatattgtagaaaacggtatggaaatcttggttttagacgcctctgcgacctgccatatgcctgatgtacttgagatgccctatcgtccatctttgagaaatggctttgaggcacaggaaaaagcccatacctacagactttcttctaatacctgtctgacgggcgatgtgattggtgattatagttttgaaaatccagtccaaatcggagacagactttattttcaagacatggccatttattcttttgtcaaaaataatacctttaatggtattggattgccaagcctctatctcatggacgaacagggagactgtagcttactcaaagcttttggctatcaagactttaaagggagattatcatga

SEQ ID NO: 2468 - DNA, 1086 bp, Streptococcus pneumoniae
atgatggacagtccaaaaaaattaggctatcacatgccagcagagtacgaaccccatcatggtaccctcatgatatggccgactcgaccaggatcatggccttttcaaggaaaggctgctaaaagagcatttactcagatcatcgagaccatagcagaaggggaaagagtctatcttttggtggagcaggcctatctatctgaagcccaatcctatcttggagacaaggttgtttatttagacattcccaccaatgatgcctgggcgcgtgatactggcccaaccattctcgtcaatgataaaggtaagaaattagccgtggattgggccttcaatgcttggggaggcacctatgatggtctttatcaagattatgaagaggatgaccaagtagccagtcgttttgctgaggccttgggaaggcctgtctatgatgctaaaccttttgtactggaaggaggcgcaatccatagcgatggtcaaggaactattctcgtaactgaaagttgcttgcttagtcctggtcgcaatcctaacctgactaaagaggagattgaaaacacattattagaaagtcttggtgctgaaaaagttatttggcttccttatggtatttatcaggatgaaaccaatgaacacgtcgataatgttgctgcctttgttggtcctgctgagcttgttttggcttggacagatgacgaaaatgatccccagtatgccatgtcaaaagcagatctcgaactcttagaacaggaaacagatgcaaaaggttgtcacttcaccattcataaattgcctatccctgcagttcgacaagttgtgacagaagaagatttgccaggctacatctatgaagaaggagaagaaaagcgatacgcaggtgaacgactagcagcttcctacgtaaacttttatatcgccaacaaggctgtcttggttccacagtttgaggatgtaaacgaccaagtggccttagatatcctcagcaagtgtttcccagaccgtaaagttgtcggaataccagccagagatattctcttaggtggtggcaatatccactgtatcacccaacaaattccagaatag

SEQ ID NO: 2469 - DNA, 876 bp, Streptococcus pneumoniae
atgagaaatgtaagagttgcaaccattcagatgcaatgcgctaaggatgtggcaacaaatatccaaaccgcagagcgtttagtacgtcaggctgctgagcaaggagcccaaattattctcttgcccgagttgtttgaacatccctatttctgtcaggaacgtcagtatgactactaccagtatgcccaatctgtagcggaaaatactgccattcagcattttaaggtgattgctaaggaactacaagttgttttaccaatcagtttctatgaaaaagatggtaatgtcttgtataactctattgccgtcattgatgcagatggggaagtgctgggcgtttatcgaaagacccacataccagatgaccattattatcaagaaaaattctatttcacgcctggtaacactggtttcaaggtctggaatactcgctatgctaagattggtatcggtatctgttgggatcaatggttccccgaaacagcccgctgtcttgctctgaatggggcagaattgctcttttatccaacagccatcggttcagagccgattttggatacagatagttgtggtcactggcaacgtactatgcaagggcacgcagcagcgaatattgttccagtcatcgcagccaatcgttatggtttagaggaggttactcctagtgaggaaaatggcggacagagttccagtcttgacttctacggttcctcctttatgacggatgaaacaggagctattctagaacgagctgaaagacaagaagaagctgttctgttagctacttatgacctagacaagggagcaagtgaacgcctaaactggggcttgtttcgagatagaagaccagaaatgtatagacaaattacagattag

SEQ ID NO: 2470 - DNA, 810 bp, Streptococcus pneumoniae
atgattaaactactagccttggatatggatggaaccctcctcaatgaagccaaggaaatcccacaggctcacatcgctgctattcaccaagccattgaaaaaggtgtcaaactggttctctgtacgggtcgcccccttttcggtgtcctcccctactacaaaaaactgggactcgacctccagaatgagtatgtgattgttaacaacggttgttcaactcaccagactagcgactggggcttggttgactggcaagaacttagtccagctgacatcgaatacctctatgaccttgctgaaaagagtgatgttcagttgacactttttgacgagtcacattattttgttctcggtggcaaacccaatcaagttattgaaaatgatgctaaactagtattttcagacctgactgaaatttctcttgaagaagcgactagtggaaagttacggatgttccaaggtatgtttttaggaacaaaagaacaaacagacgattttgagcagcgttttgctgaagagctttgccaacgattcagtggagttcgttcgcagcctgtcatttatgaagcaatgccgcttggaacgacaaaggctactgctctttcacgactagctgagattttgaagattgattcctcagagattatggccatgggcgatgctaataacgatatcgaaatgctccagtttgcagggcttgggattgcaatgggaaatgccagcgattatgtcaaatctcttgcggatgccgttacctcaagcaacgaagaagacggcgttgcgcgtgctattgagaaatatattctataa

SEQ ID NO: 2471 - DNA, 222 bp, Streptococcus pneumoniae
atgattttaatgacaaaaaatataaatctaacaaatgaagaattagagctgatacaaggtggagcagatccatatggtaaaaatcctaatggtaggtacgattgggaaatagaaccagtattaactctgccggttcatggattttgtcccagaggcacctatgatttaggatatattggaggaggcaatcatctttgcaaaggaagtgctgcgagattttaa

SEQ ID NO: 2472 - DNA, 672 bp, Streptococcus pneumoniae
atgaaaaaacgggctattcaaattttactagcattgtccttaattttttacaaatcaacttggttttggagagttttcaatcacctcgcaaagccctatctaccagcaagtcgtgaattttttcagattctgcttttgatggagagcggagttcttttcttagcggtcatctatctactggtttttgcaggaaagaaaatttttcatttcaagtggcagctgaggtacttcatctaccttttactgggctacatcatttcatatatgtctgacttcctcttttcgtatttcatatccctgtcttcaaatcagatttctctgaatgaaacggtagaaatgatggggagacaggagttcccttatttcttgctcatcgtttgcttcatcgcccctattgctgaggaattgatttatcgaggtgtgcttatgacaacctttttcaaaaactcaccttggtacggagatgttttgctttctgctattattttcggttatattcatatcaattttgctttaactcctcttgcttttttcatttatgctagtggaggtcttattttagctctattgtatcgcatgactaaaaatctctactatccaatactagttcatattctcatcaatatcactgccttctgggatgtttggttactcctattttcaggaagttag

SEQ ID NO: 2473 - DNA, 909 bp, Streptococcus pneumoniae
atgaacattcaacaattacgctatgttgttgccattgccaatagtggtactttccgtgaagctgctgaaaagatgtatgttagtcagccgagtctgtctatttctgttcgtgatttggaaaaagagttgggttttaagattttccgtcggaccagctcagggactttcttgacccgtcgtgggatggaattctatgaaaaatcgcaagaattggttaaaggatttgatatttttcaaaatcagtatgccaatcctgaagaagaaaaagatgaattttctgttgctagccagcactatgacttcttgccaccaactattacggccttttcagagcgctatcctgactataagaacttccgtatttttgaatcaactactgttcaaatattagatgaagtggcgcaagggcatagtgagattgggattatctacctcaacaatcaaaataaaaaggggattatgcaacgggttgaaaaattaggtctggaggtcatcgaattgattcctttccatacccatatttatctccgtgagggtcatcctttagcccagaaagaggaattagtcatggaggatttagcggatttaccaacggttcgtttcactcaagagaaagacgagtacctttattattcagagaactttgtcgataccagcgctagctcacagatgtttaatgtgacagaccgtgccaccttgaatggtattttggagcggacggacgcctatgcgacaggttctggatttttagatagtgacagtgttaatggtattacagttattcgtctcaaggataacctagataaccgcatggtctatgttaaacgtgaagaagtggagcttagtcaagctgggactctcttcgtagaagtcatgcaagaatattttgatcaaaagaggaaatcatga

SEQ ID NO: 2474 - DNA, 462 bp, Streptococcus pneumoniae
atgaaaaaaagagcaatagtggcagtcattgtactgcttttaattgggctggatcagttggtcaaatcctatatcgtccagcagattccactgggtgaagtgcgctcctggattcccaatttcgttagcttgacctacctgcaaaatcgaggtgcagccttttctatcttacaagatcagcagctgttattcgctgtcattactctggttgtcgtgataggtgccatttggtatttacataaacacatggaggactcattctggatggtcttgggtttgactttgataatcgcgggtggtcttggaaactttattgacagggccagtcagggctttgttgtggatatgttccaccttgactttatcaactttgcaattttcaatgtggcagatagctatctgacggttggagtgattattttattgattgcaatgctaaaagaggaaataaatggaaattaa

SEQ ID NO: 2475 - DNA, 888 bp, Streptococcus pneumoniae
atggaaattaaaattgaaactggtggtctgcgtttggataaggctttgtcagatttgtcagaattatcacgtagtctcgcgaatgaacaaattaaatcaggccaggtcttggtcaatggtcaagtcaagaaagctaaatacacagtccaagagggtgatgtcgtcacttaccatgtgccagaaccagaggtattagagtatgtggctgaggatcttccgctagaaatagtctaccaagatgaggatgtagctgttgtcaacaaacctcagggaatggttgtgcatccgagtgctggtcatactagtggaactctagtcaatgccctcatgtatcatattaaggacttgtctggtatcaatggggttctgcgtccgggaattgttcaccgtattgataaggatacgtcaggtcttctcatgattgctaaaaacgatgatgcgcatctagcacttgcccaagaactcaaagataaaaagtctctccgcaaatattgggcgattgttcatggaaatctgcctaatgatcgtggtgtaattgaagcgccgattggccggagtgaaaaagaccgtaagaaacaggctgtaactgctaaagggaagcctgcagtgacgcgttttcacgtcttggaacgctttggcgattatagcttagtagagttgcaactggagacagggcgcactcatcaaatccgtgtccacatggcttatatcggccattcagtcgctggtgatgaggtctatggtcctcgcaagactttgaaaggacatggacaatttcttcatgccaagactttaggttttactcatccgagaacaggtaagaccttggaatttaaagcagatatcccagagatttttaaggaaaccttggagagattgagaaagtaa

SEQ ID NO: 2476 - DNA, 1884 bp, Streptococcus pneumoniae
atgaaaaagaaattaactagtttagcacttgtaggcgcttttttaggtttgtcatggtatgggaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgacaagacggtttagtaaacatttcaacttcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaattgatggaatctggtattattttaacaaagaaaatcagatggaaattggttgggttcaagataaagagcagtggtattatttggatgttgatggttctatgaagacaggatggcttcaatatatggggcaattgtattactttgctccatcaggggaaatgaaaacgggctgggtaaaagataaagaagcctggtactatatggattctactggtatcatgaagacaggtgagatagaagttgctggacatcattactatctagaagaatcaggagctatgaagcaaggctggcttaaaaaggcaaatgattggtatttctacaagacaggtggttcacgagctataggttggattaaagacaaggataaatggtacttcttgaaagaaaatggtcaattacttgtgaatggtaagacaccagaaggctatactgtggattcaagtggtgcctggttagtggatgttccgatcgagaaatctgctacaattaaaactacaagtcattcagaaataaaagaatccaaagaagtagtgaaaaaggatcttgaaaataaagaaacaagtcaacatgaaagtgttacaaattcttcaactagtcaagatttgacatcctcaacttcacaaagctctgaaacgagtgtaaacaaatcggaatcagaacagtag

SEQ ID NO: 2477 - DNA, 1131 bp, Streptococcus pneumoniae
atgaataatcggagtgagactatgaaatacaaacggattgtctttaaggtgggtacttcttctctgacaaatgaggatggaagtttatcacgtagtaaggtaaaggatattacccagcagttggctatgctgcacgaggctggtcatgagttgattttggtgtcttcaggtgccattgcggctggttttggagccttaggatttaaaaagcgtccgactaaaattgctgataaacaggcttcagcagcggtagggcaggggcttttgttggaagaatatacaaccaatcttctcttgcgtcaaatcgtttctgcacaaatcttgctgacccaagatgactttgtggataagcgtcgttataaaaatgcccatcaggctttgtcggttttgctcaaccgtggggcaattcctatcatcaatgagaatgatagtgtcgttattgatgaggtcaaggttggggacaatgacactctaagtgcccaagtagcggcgatggtccaagcagaccttttggttctcttgacagatgtggacggtctctatactggaaatcctaattcagatccaagagccaaacgcttggagagaatcgagaccatcaatcgtgagattattgatatggctggtggagctggttcgtcaaacggaactgggggtatgttaaccaaaatcaaggctgcaactatcgcgacggaatcaggagttcctgtttatatctgctcatccttgaaatcagattccatgattgaggcggcagaggagaccgaggatggttcttactttgttgctcaagagaaggggcttcgtacccagaaacaatggcttgccttctatgctcagagtcaaggttctatttgggttgataaaggggctgcggaagctctctctcaacatggaaagagtcttctcttatctggtatcgttgaagcagaaggagccttttcttacggtgatatcgtgacagtatttgataaggaaagtggaaaatcacttggaaaaggacgcgtgcaatttggagcatctgctttggaggatatgttgcgttctcaaaaagccaagggtgtcttgatttaccgtgacgactggatttccattactcctgaaatccaactactttttacagaattttag

SEQ ID NO: 2478 - DNA, 1263 bp, Streptococcus pneumoniae
atggtgagtagacaagaacaatttgaacaggtacaggctgttaaaaaatcgattaacacagctagtgaagaagtgaaaaaccaagccttgctagccatggctgatcacttagtggctgctactgaggaaattttagcggctaatgccctcgatatggcagcggctaaggggaaaatctcagatgtgatgttggatcgtctttatttggatgcagatcgtatagaagcgatggcaagaggaattcgtgaagtggttgccttcccagatccaatcggtgaagttttagaaacaagtcagcttgaaaatggtttggttatcacaaaaaaacgtgtagctatgggtgtcatcggtattatctatgaaagccgtccaaatgtgacgtctgatgcggctgctttgactcttaagagtggaaatgcggttgttcttcgtagtggtaaggatgcctatcaaacaacccatgccattgtcacagccttgaagaagggcttggagacgactactattcacccaaatgtgattcaactggtggaagatactagccatgaaagtagttatgctatgatgaaggccaagggctatctagacctcctcattcctcgtggaggagctggcttgatcaatgcagtggttgagaatgccattgtacctgttatcgagacagggactgggattgtccatgtctatgtggataaggatgcagacgaagacaaggcgctgtctatcatcaacaatgctaaaaccagtcgtccttctgtttgtaatgccatggaggttctgctggttcatgaagacaaggcagcaagcatccttcctcgcttggatcaaatgctggttgcagagcgtaaggaagctggactggaaccaattcaattccgcttggatagcaaagcaagccagtttgtttcaggtcaagcagctgagacccaagactttgacaccgagtttttagactatgtccttgctgttaaggttgtgagcagtttagaagaagcggttgcgcacattgaatcccacagcacccatcattcggatgctattgtgacggaaaatgctgaagctgcagcatactttacagatcaagtggactctgcagcggtgtatgttaatgcctcaactcgtttcacagatggaggacaatttggtcttggttgtgaaatggggatttctactcagaaattgcacgcgcgtggtccaatgggcttgaaagagttgaccagctacaagtatgtggttgctggtgatgggcagataagggagtaa

SEQ ID NO: 2479 - DNA, 798 bp, Streptococcus pneumoniae
atgaagattggatttatcggtttggggaatatgggtgctagcttggcaaaatctgtcttgcagactaggacgtcagatgagattctccttgccaatcgtagtcaagctaaggtagatgctttcattgcagactttggtggtcaggcttccagcaatgaagaaatgtttgcagaagcagatgtgatttttctaggagttaagcctgctcagttttctgaactgctttctcaataccagaccatccttgaaaaaagagaaagtcttcttttgatttcgatggcagctggattgaccttagaaaaactagcaagtcttatcccaagccaacaccgaattattcgtatgatgcctaatacccctgcttctatcgggcaaggagtgattagttatgccttgtctcctaattgcagggctgaggacagtgagatcttttgtcagcttttagccaaggctggtctcttggttgaattaggagaaagcttaatcaatgcagcgacaggtcttgcaggttgtggaccagcctttgtctatctctttattgaggccttggcagatgcaggtgttcagacgggattaccacgagaaacagccttgaaaatggcagcccaaactgtggtaggagctgggcaattggtcctagaaagccagcaacatcctggagttttgaaagatcaagtttgtagtccaggcggttcgactattgctggcgtagcaagcctagaagcgcatgcttttcgaggcacagtcatggaggcagttcatcaagcctataaacgaacacaagaactaggtaaataa

SEQ ID NO: 2480 - DNA, 639 bp, Streptococcus pneumoniae
atgtcaaaaggatttttagtctctcttgagggaccagagggagcaggcaagaccagtgttttagaggctctgctaccaattttagaggaaaaaggagtagaggtgttgacgacccgtgaacctggcggagtcttgattggggagaagattcgggaagtgattttggatccaagtcatactcagatggatgctaaaacagagctacttctctatattgccagtcgcagacagcatttggtggaaaaagttcttccagcccttgaagctggcaagttggtcatcatggatcgttttatcgatagttctgttgcctatcagggatttggtcgtggcttagatattgaagccattgactggctcaatcagtttgcgacagatggcctcaaacccgatttgacactctattttgacatcgaggtggaagaagggctggctcgtattgctgctaatagtgaccgcgaggttaatcgtttggatttggaagggttggacttgcataaaaaagttcgtcaaggctacctttctcttctggataaagagggaaatcgcattgtcaagattgatgctagtctccctttggagcaagttgtggaaactaccaaggctgtcttgtttgacggaatgggcttggccaaatga

SEQ ID NO: 2481 - DNA, 252 bp, Streptococcus pneumoniae
ttgctccaaagggagactagcatcaatcttgacaatgcgatttccctctttatccagaagagaaaggtagccttgacgaacttttttatgcaagtccaacccttccaaatccaaacgattaacctcgcggtcactattagcagcaatacgagccagcccttcttccacctcgatgtcaaaatagagtgtcaaatcgggtttgaggccatctgtcgcaaactgattgagccagtcaatggcttcaatatctaa

SEQ ID NO: 2482 - DNA, 891 bp, Streptococcus pneumoniae
atgaaacaagatcaactaaaggcttggcaaccagctcagtttgaccgttttgtccgtatcttagaacaagaccagctcaatcacgcctatctcttttcaggtttctttggaagcttggaaatggcgcaatttttagctaagagcctcttttgtacggataaagttggcgtcttaccatgtgagaaatgccgaagttgcaagctgattgaacaggaagagtttccagatgtcaccttgattaagccagtcaatcaggtcatcaagacagaacgcattcgggaattggtgggacagttttctcaagcagggattgaaagccagcaacaggtctttattatcgagcaagcggataaaatgcatcccaacgcagccaattctctgctcaaggtcatcgaagaaccccagagtgaagtttatattttcttcttgactagcgatgaggaaaagatgttaccgacaatccgaagtcggactcagatcttccactttaaaaagcaagaagaaaaacttatcttactcttagaacaaatgggacttgttaagaaaaaagcgactcttttagctaagtttagtcaatcgcgagctgaagcagaaaagttggctaatcaggcaagtttttggaccttggtcgatgaaagtgaacgcctgctgacttggttagtagctaagaaaaaagaaagttatctacaggttgccaaattagccaacttggcagatgataaggaaaaacaggatcaggttttacggattcttgaagttctctgtgggcaggacctcttgcaggtaagagtaagagtgattctacaagatttactagaagctagaaaaatgtggcaagctaatgtcagctttcaaaatgccatggaatatctggtcttgaaagaaatataa

SEQ ID NO: 2483 - DNA, 318 bp, Streptococcus pneumoniae
atggacaaaaaagaattatttgacgcgctggatgatttttcccaacaattattggtaaccttagccgatgtggaagccatcaagaaaaatctcaagagcttggtagaagaaaatacagctcttcgcttggaaaatagtaagttgcgagaacgcttgggtgaggtggaagcagacgctcccgtcaaggccaagcatgttcgcgaaagtgtccgtcgtatttaccgtgatggatttcacgtatgtaatgatttttatggacaacgtcgagagcaggacgaagaatgtatgttctgtgatgagttgttatacagggagtaa

SEQ ID NO: 2484 - DNA, 870 bp, Streptococcus pneumoniae
atgcaaattcaaaaaagttttaaggggcagtctccctatggcaagctgtatctagtggcaacgccgattggcaatctagatgatatgacttttcgtgctatccagaccttgaaagaagtggactggattgctgctgaggatacgcgcaatacagggcttttgctcaagcattttgacatttccaccaagcagatcagttttcatgagcacaatgccaaggaaaaaattcctgatttgattggtttcttgaaagcagggcaaagtattgctcaggtctctgatgccggtttgcctagcatttcagaccctggtcatgatttggttaaggcagctattgaggaagaaattgcagttgttacagttccaggtgcctctgcaggaatttccgccttgattgccagtggtttagcgccgcagccacatatcttttacggctttttaccgagaaaatcaggccagcaaaagcaatttttcgactcgaaaaaagactatcctgaaactcagattttttatgaatcgccccatcgtgtggcagatacattggaaaatatgctagaagtctacggtgaccgctccgttgtcttggtcagggaattgaccaaaatctatgaagaataccaaagaggtacaatttctgaattgctggaaagcattgctgaaacgtctctcaagggtgaatgtcttctgattgttgaaggtgccagtcaggatgtggaagaaaaagacgaggaagacttgttcttagaaatccaagctcgtatccagcaaggtatgaagaaaaatcaagctattaaggaagtagctaagatttaccagtggaataagagtcaactctacgctgcctaccacgactgggaagaaaaacaataa

SEQ ID NO: 2485 - DNA, 546 bp, Streptococcus pneumoniae
ttgataaatcagaaagaaggtgattttttgcgaacatacgaaaataaagaagaactaaaagctgagatagagaaaacatttgagaaatatattttagaatttgataatattccagaaaatttaaaagataagagagctgatgaagttgacagaactccagcagaaaaccttgcttatcaggttggttggaccaacttggttcttaaatgggaagaagatgaaagaaaggggcttcaagtaaaaacaccatcggataaatttaaatggaatcaacttggtgaattatatcagtggttcacagatacctacgctcatttatctctgcaagagttgaaagcaaaattaaatgaaaatattcattctatctctgcaatgattgattcgttgagtgaggaagaattatttgaaccgcatatgagaaagtgggctgatgaagcgactaaaacagcgacttgggaagtgtataagtttattcatgtaaatacggttgcaccttttggaactttcagaactaaaatcagaaaatggaagaagatagtattataa

SEQ ID NO: 2486 - DNA, 504 bp, Streptococcus pneumoniae
atgtcatttaagaataactggatagacaaggaaggcagagtatttatctattttactgtcgaagaaattatgaaaagaagaaatatctcaaagccaactgccataaaaacattagatgagcttgatataaaaaaaggaataggactgatcgaaagagtaaggcttggacttggtaagccgaacatcatttatgttaaagactttatgagtatatttcaggtaaaagaaaatgacttacagaagtcaaaaaacttaacttcagaagtaaaagattttaacctcagaagtaaagaaaatgaacttcaagaggttaagaaccttgactctaactatatagagaataataagagtaagtatagtaagagagaatatagttttggtgaaaacggacttggaacatttcaaaatgtgtttttagctgctgaagatatatcggatttacaaatcataatgaactcacagcttgagaattacattagacttcctgcaaaactagaatcctag

SEQ ID NO: 2487 - DNA, 450 bp, Streptococcus pneumoniae
aaatcaatcgccctaaaaaaagaattagcgaattattctggtaaaaagaaatgctacgctatgaaggctcaagcgattgtcacaagtcaagggagaattgtttctttggatatcactgtgaactattgtcatgatatgaagttgttcaaaatgagtcgcagaaatatcggacaagctggtaaaatcttggctgacagtggttatcaagggctcatgaagatatatcctcaagcacaaactccacgtaaatccagcaaattcaagccgctaacagttgaagataaaacctataaccatgcgctatctaaggagagaagcaaggttgagaacatctttgccaaagtagaaacgtttaaaatgttttcaacaacctatcgaaatcatcgtaaacgattcggattacgaatgaatttgattgctggtattatcaatcatgaactaggattctag

SEQ ID NO: 2488 - DNA, 402 bp, Streptococcus pneumoniae
atgaatgatgaagcaagtaaacaactaactgatgcacgatttaagcgtcttgttggtgttcagcgcacgacttttgaagagatattagctgtattaaaaacagcttatcaacttaaacacgcaaaaggtggacgaaaacctaaattaagcctagaagaccttcttatggccactcttcaatatgtgcgagaatatcgaacttatgaacaaattgcggctgattttggtattcacgaaagcaacttaatccgtcggagccaatgggttgaagtaactcttgttcaaagtggtgttacgatttcaagaactcctctcagttctgaggacacggtaatgattattgatgcgacggaagtaaaaatcaatcgccctaaaaaaagaattagcgaattattctggtaa

SEQ ID NO: 2489 - DNA, 273 bp, Streptococcus pneumoniae
ttgtttacttgcttcatcattcatagaactactataccatattttgtttcgcaggaagtctattggaaagtaagaaatattgaagctgaggcgattagaagaaattgtgagcgtggtgctattttttcaggtaaaataaaacatcacgaagattctcagtttaaaggagaccactatgttgaatgttatgctgttttagataatacggttatagcaagagatagaataacagtccctatcgatccgttatgtggaaaagattttatagagtag

SEQ ID NO: 2490 - DNA, 1335 bp, Streptococcus pneumoniae
gtgtctcaatcttatatcaatgttatcggtgctggtttggcaggttctgaagcagcttaccaaatcgcagagcgtggtattccagttaaactttatgaaatgcgtggtgtcaagtctacaccccagcataaaacagacaattttgctgagttggtttgttccaattctttgcgtggggatgctttgacaaatgcagttggtcttctcaaggaagaaatgcgtcgcttgggttctgttatcttggaatctgctgaggctacacgtgttcctgccggtggagcccttgcggtggatcgtgatggtttctctcaaatggtgaccgaaaaagtggtcaaccaccccttgattgaagtggtgcgtgatgaaattacagaattgccaacagatgttattacagttgtggcgactggtcccttgactagcgatgccctggctgaaaagattcatgcccttaataatggcgatggcttctatttctacgatgcagcagcgcctattatcgatgtcaacactatcgatatgagtaaggtctatctcaaatctcgttatgataagggagaagcagcctatctcaatgctccaatgaccaagcaagagtttatggatttccatgaagccttggtcaatgcggaagaagcaccgctcaattcttttgaaaaagaaaagtactttgaaggatgtatgccaatcgaagttatggccaaacgtggcattaaaactatgctttatggccctatgaagccagtcggtcttgagtatccggacgactacacaggacctcgtgatggagaatttaaaacaccttatgcggttgtgcaacttcgtcaggataatgcagctggtagcctatacaatattgttggtttccagacccacctcaaatggggagaacaaaagcgtgtcttccaaatgattccgggtcttgaaaatgcggagtttgtccgttatggtgtcatgcatcgcaattcttacatggattcaccaaatcttcttgagcagacttaccgttccaagaaacaaccaaatctcttctttgctggtcagatgacgggggtggaaggctatgttgagtcggcggcttcgggcttagttgcgggaattaacgcagctcgtctcttcaaggaagaaagcgaggttattttccccgagacgacagcgattggaagcttagctcattacattacccatgccgacagcaaacatttccaaccaatgaatgtcaattttgggatcatcaaggagttggaaggcgagcgtatccgtgataccaaggctcgttatgaaaaaattgcagagcgtgcccttgccgacttagaggaatttttgactgtctaa

SEQ ID NO: 2491 - DNA, 738 bp, Streptococcus pneumoniae
atggcgaatcccaagtataaacgtattttaatcaagttatcaggtgaagcccttgccggtgaacgtggcgtagggattgatatccaaacagttcaaacaatcgcaaaagagattcaagaagttcatagcttaggtatcgaaattgcccttgttattggtggaggaaatctctggcgtggagaacctgcagcagaagcaggtatggaccgtgttcaggcagattacactggaatgcttgggactgttatgaatgctcttgtgatggcagattcattgcaacaagttggggttgatacgcgtgtacaaacagctattgctatgcaacaagtggcagagccttatgtccgtggacgtgcccttcgtcaccttgaaaaaggccgtatcgttatctttggtgctggaattggttcaccatacttctcgacagatacaacagcggcccttcgtgcagctgaaatcgaagcagatgccatcctcatggctaaaaatggcgtcgatggtgtgtacaatgccgatcctaagaaggacaagacagccgttaagtttgaagaattgacccaccgtgatgttatcaacaaaggtcttcgtatcatggactcaacagcctcaaccctctcaatggacaacgacattgacttggttgtcttcaacatgaaccaatcaggcaacatcaaacgtgttgtatttggtgaaaatatcggaacaacagtttcaaataatatcgaagaaaaggaataa

SEQ ID NO: 2492 - DNA, 438 bp, Streptococcus pneumoniae
ttggtgagactgggtcattctctctttagctttttcaataattacgttagccatattctttcttattccttttcttcgatattatttgaaactgttgttccgatattttcaccaaatacaacacgtttgatgttgcctgattggttcatgttgaagacaaccaagtcaatgtcgttgtccattgagagggttgaggctgttgagtccatgatacgaagacctttgttgataacatcacggtgggtcaattcttcaaacttaacggctgtcttgtccttcttaggatcggcattgtacacaccatcgacgccatttttagccatgaggatggcatctgcttcgatttcagctgcacgaagggccgctgttgtatctgtcgagaagtatggtgaaccaattccagcaccaaagataacgatacggcctttttcaaggtga

SEQ ID NO: 2493 - DNA, 558 bp, Streptococcus pneumoniae
atggctaacgtaattattgaaaaagctaaagagagaatgacccagtctcaccaatcacttgctcgtgaatttggtggtatccgtgctggtcgtgccaatgcaagcttgcttgaccgtgtacatgtagaatactatggagtcgaaactcctcttaaccaaatcgcttcaattacgattccagaagcgcgtgttttgttggtaacaccatttgacaagtcttcattgaaagacatcgaacgtgccttgaacgcttctgatcttggtatcacaccggctaatgacggttctgtgattcgcttggttatcccagctcttacagaagaaactcgtcgtgaccttgctaaagaagtgaagaaggtcggcgaaaatgctaaagtggctgtccgcaatatccgtcgcgatgctatggacgaagctaagaaacaagaaaaagcacaagaaatcactgaagacgaattgaagactcttgaaaaagatattcaaaaagtaacagacgatgctgttaaacacatcgacgacatgactgctaacaaagagaaagaacttttggaagtctaa

SEQ ID NO: 2494 - DNA, 417 bp, Streptococcus pneumoniae
ttgcaagatttgtattcatatttccttctttcgaataaaactcagccagcaatgccaactgagtttttctgtttatttttagacttccaaaagttctttctctttgttagcagtcatgtcgtcgatgtgtttaacagcatcgtctgttactttttgaatatctttttcaagagtcttcaattcgtcttcagtgatttcttgtgctttttcttgtttcttagcttcgtccatagcatcgcgacggatattgcggacagccactttagcattttcgccgaccttcttcacttctttagcaaggtcacgacgagtttcttctgtaagagctgggataaccaagcgaatcacagaaccgtcattagccggtgtgataccaagatcagaagcgttcaaggcacgttcgatgtctttcaatga

SEQ ID NO: 2495 - DNA, 855 bp, Streptococcus pneumoniae
atgaatacaaatcttgcaagttttatcgttggactgatcatcgatgaaaatgaccgtttttactttgtgcaaaaggatggtcaaacctatgctcttgctaaggaagagggccaacatacagtaggggatacggtcaaaggttttgcatacacggatatgaagcaaaaactccgcctgacaaccttagaagtgactgccactcaggaccaatttggttggggacgtgtcacagaggttcgtaaggacttgggtgtctttgtggatacaggccttcctgacaaggaaatcgttgtgtcactcgatattctccctgagctcaaggaactttggcctaagaagggcgaccaactttacatccgtcttgaagtggataagaaagaccgtatttggggcctcttggcttatcaagaagacttccaacgtcttgctcgtcctgcttacaacaacatgcagaaccaaaactggccagccattgtttaccgtctcaagctgtcaggaacttttgtttacctaccagaaaataatatgcttggttttattcatcctagcgagcgttacgcagagccacgtttggggcaagtattagatgcgcgcgttattggtttccgtgaagtggaccgcactctgaacctctccctcaaaccacgctcctttgaaatgttggaaaacgatgctcagatgattttgacttatttggaaagcaatggcggtttcatgaccttaaatgacaagtcatctccagacgacatcaaggcaacctttggcatttctaaaggtcagttcaagaaagctttaggtggtcttatgaaggctggtaaaatcaagcaagaccagtttgggacagagttgatttag

SEQ ID NO: 2496 - DNA, 216 bp, Streptococcus pneumoniae
atgagaaaatcattttacacttggctcatgaccgagcgcaatcctaaaagtaacagtcccaaagcaattttggcagacctcgcttttgaagagtcagcctttccaaaacatacagatgattttgatgaggtcagtcgctttttggaggagcatgccagtttctcttttaacctaggagattttgacagcatttggcaggaatatctagaacactag

SEQ ID NO: 2497 - DNA, 969 bp, Streptococcus pneumoniae
ttgaaggaacattcaatagacattcaactgagtcatccagatgacctgtttcatctttttggttccaatgaacgccatcttcgtttgatggaagaagagcttgatgttgtgattcatgctcgtacggagattgtccaggttttgggagaagagtctgcttgcgaggaagcccgtcaggttattcaagctctcatggccttggtaaatcgtgggatgaccgttggtacgccagatgtagtgacggctattagtatggtcaaaaatgatgaaattgacaagtttgtcgccctttacgaagaagaaatcatcaaggataatactgggaagcctatccgcgtcaaaaccttaggtcaaaaactttatgtggacagtgtcaaacagcatgatgtgacctttggaattgggccggcaggtacagggaagaccttccttgcagtgaccttggcagtgactgcccttaaacgtgggcaagtcaagcgaattatcctaactcgtccagcggtggaagcgggagagagtcttggatttcttccgggtgatcttaaggagaaggtggatccttaccttcgtcctgtttacgatgccttgtatcaaattcttgggaaagaccaaacgactcgtctcatggagcgtgaaattatcgaaattgcgccccttgcctatatgcgtggccggaccttggatgatgcctttgtcattctcgatgaggcgcaaaacacgaccatcatgcagatgaagatgttcttgacgcgtttaggctttcattctaagatgattgtcaatggagatatcagtcagattgacctgccacgtaatgtcaagtccggtttgattgatgctcaagagaaactcaagaacatccatcagattgactttgttcatttttcagctaaggatgtggttcgccatccagttgtcgctcaaattatccgagcctatgaatattctactgaagttgcacacgactga

SEQ ID NO: 2498 - DNA, 195 bp, Streptococcus pneumoniae
ttgttccctgtgattatgacacaggaagatgcactgatcgtcatcagccacataaaagttctttccatcgtgcctaatcgttgtctcaaacctttggataaaacctttagcctatacaactggattttcctctctcaaaagtatattcttttgcaggcgaacttcctcaaaatcagtcgtgtgcaacttcagtag

SEQ ID NO: 2499 - DNA, 501 bp, Streptococcus pneumoniae
atgattgaccaactatctaagtattacagttgtaggatactaactgaaaaggatattccaagtattttatctttatatgaaagtaatcctctgtattttcagcattgtccaccagagccaaattttgcaactgtaaaagaggacatgctttgtctacctgaaggtaaagctaaggctgataagttttttgttggattttggaatggctctgaccttgtggctgttatggattttgtctatgcatatcctgatgaggagactgtttttattggtttgtttatggttgatcaagcctatcagaggaaagggattggtagtcatattgtgacagaagcactagcttattttgctaagaactttcgaaaggcacgtttggcttatgttaagggaaatccgcaatctcagcatttttgggaaaagcagggctttaaatcaattggatgcgaggttaagcaagaactctatacggttgttatcgttgaacagagcctagaagattag

SEQ ID NO: 2500 - DNA, 276 bp, Streptococcus pneumoniae
gtgacaacgcacgatgaacccgtctatgaaaaacacggtgttctccactataccgttgccaatatccctggtgcggttgctcgcacttcaaccatcgccctaaccaatgtcactcttccttatatcgaagctttggctggcaaaggattcgcacaagcaatctctgaagatgaaggcttgcgtcaaggtgtgaccacttatcaaggttacttgactagcctaccagttgctcaaggacttaatcgtgactacactgatatcaatgatttagtataa

SEQ ID NO: 2501 - DNA, 195 bp, Streptococcus pneumoniae
actcttatatctaattcattcaacattgaagcaagtgtgagagatgctgatgtggtgattggagccattctcatccctggtgcaaaagcaccggaattggtgacagatgagatggtcaaacaaatgcgtccaggctctgtatcgttgaccttgctgttgaccaaggtggccttatcgaaacagctgaccgtgtga

SEQ ID NO: 2502 - DNA, 219 bp, Streptococcus pneumoniae
atcggagctcacttccttactaagcaagctggtggctctggtgttctacctggtggtgtaccaggtgttccaaaaggaaaagtaactatcatcggtgatggtgtcgtcggtacacatgctgcccgcatcgcccttggtcttggtgctcaagtgactattttagatattagtgccaagcgtctctcagttctaaaagaagtctttggaagtcaaatttaa

SEQ ID NO: 2503 - DNA, 426 bp, Streptococcus pneumoniae
atgttaatcggaatcccaaaagaaattaaaaataacgaaaaccgtgtcgccctcacacctgcaggtgttcatagcttagttagtcgtggtcatcgtgtccttatcgaaacaaatgctggtctcggttctggctttactgatgctgactatcaaaagcaaggagctgagattgtcgctactgctggtgaagcttgggcagcagagttggttgtgaaagtaaaagaacctttaagttctgaatacggttactttcgcgacgatcttcttctcttcacctacttgcacatggccgctgctccagaattagcagatgctatgttagcagcaaaaacaacaggaattgcctatgaaactgttcgtgacaatcaaggacaactaccgctcctcgttcctatgagtgaggttgcagatcgtatggctgtttaa

SEQ ID NO: 2504 - DNA, 588 bp, Streptococcus pneumoniae
ttgattggttggaaaagtatggaatcaatttttgtaaaacttgcccagtatccgtctatagaaacggagcgtttattgcttagacctgtaactttggatgatgcggaagcaatgtttgactatgcctcggacaagggtaatacacgttacacttttccaaccaatcaaagtttggaagaaaccaagaataacattgctcagttctatttggctaatcccttgggacgttggggaatagaactaaaaagcaatggtcagtttattggaaccattgacttgcacaagattgattctgttcttaagaaggcagctattggctacattatcaataaaaagtattggaatcaaggattaacgacagaagccaatcgtgctgtgattgagctagcttttgagaagatagggatgaataagttgactgcccttcacgataaggacaatcctgcgtcaggaaaggtcatggagaaatcaggcatgcgtttttcccatgcagaaccatatgcttgtatggaccagcatgaaaaaggccgaatcgtgacaagagttcattatgtcttgaccaaggaagactattttgcaaataaataa

SEQ ID NO: 2505 - DNA, 651 bp, Streptococcus pneumoniae
atggaagcaattatcgagaaaatcaaagagtataaaatcatcgtcatctgtactggtctgggcttgcttgtaggaggatttttcctgctaaaaccagctccacaaacacctgtcaaagagacgaatttgcaggctgaagtcgcagctgtttccaaggatttggtatccgaaaaggaagtgaacaaggaagaaaaggaagaaccccttgaacaagatctaatcacagtagatgtcaaaggtgctgtcaaatcgccagggatttatgacttgcctgtaggtagtcgagtcaatgatgctgttcagaaggctggtggcttgacagagcaagcagacagcaagtcgctcaatctagctcagaaagttagtgatgaggctctggtttacgttcctactaagggagaagaagcagttagccaacagactggtttggggacagcttcttcaataagcaaggaaaagaaggtcaatctcaacaaggccagtctggaagaactcaagcaggtcaagggactgggaggaaaacgagctcaggacattatcgaccatcgtgaggcaaatggcaagttcaagtcagtagacgagctcaagaaggtctctggcattggtggcaaaacaatagaaaagcttaaagactatgttacagtggattaa

SEQ ID NO: 2506 - DNA, 1377 bp, Streptococcus pneumoniae
atgttacagtggattaagaatttctctattcccctaatttacctgagttttctgttactttggctttactacgctattttctcagcatcctatcttgctttgttgggatttgtttttctgctagtctgtctctttttccaatttccttggaaatctgctagcaaagttctagtgatttgtggaatctttggattttggtttgtttttcaaaattggcaacagagtcaagcgagtcaaaatctggcggattctgttgaaagggtacggattttgcctgatactattaaggtcaatggtgatagtctatcctttcgtggcaagtctaacggtcgtgctttccaagtctattataaactccagtccgaggaggagaaagaagcctttcaagctttaaccgacctgcatgagataggactagaagggaagctttcggagccagaagggcagagaaattttggtggctttaattaccaagcctatctgaagactcagggaatttaccagacactcaatattaaaagaatccagtcactccaaaaggttggcagttgggatataggtgaaaaactgtccagtttacgtcgaaaggctgtggtttggattaagatgcacttcccagaccctatgcgcaattacatgacaggactcttgctaggacatctggacaccgattttgaggagatgaatgagctttattccagtttaggaattattcacctttttgccttgtcaggtatgcaggtagggtttttcatgaatggatttaagaaacttgtcttgcgattgggcttgacccaagaaaagttgaaatggctgacttatcccttttcccttatctatgcgggactaactggattttcagcatcggttattcgcagtctcttgcaaaagctactggctcaacatggggttaagggcttggataattttgccttgacggtgcttgtcctctttattgtcatgccaaactttttcttgacagcaggaggagtcttgtcctgcgcttatgcttttatcctgaccatgaccattaaagaagggaaggggctcaaggctgttgctagtgaaagtctagtcatctccttgggcatattgcccattatatccttctattttgcggaatttcaaccttggtctatccttttgacctttgtcttttcctttctatttgacttgaccctcttaccgctcctgtctattttatttgtcctttcctttctctatccagtcattcagctgaactttatctttgaatggttggagggcattattcgcttggtctcacaggtgacaagtaggcctctagtctttggacaacccaatgaatggcttttaaccctattgttaaatattctttggctttggtctatgatttga

SEQ ID NO: 2507 - DNA, 918 bp, Streptococcus pneumoniae
atggcttttaaccctattgttaaatattctttggctttggtctatgatttgaggaaaaaccttaaaggattaacagtattgagtttattgattacaggtctctttttcttgaccaagtatccactggaaaatgaaatcaccatgctggatgtggggcaaggagaaagtattttcctacgggatgtaactgggaaaaccattctcatagatgtaggtggtaaggcagaatcttataagaaaatcgaaaaatggcaagaaaagatgacgaccagcaatgcccagcgaaccttgattccctatctcaaaagtcgaggagtagctaagattgaccagctaattttgactaacacggacaaggagcatgttggagatttgtcagaggtgaccaaggctttccatgtaggggagattttagtatcaaaaggcagtttgaagcagaagcaatttgtggtagaactacaggcgactaaaacaaaggtgcgtagtatgacagtaggggagaacttgcccatttttggaagtcagttagaagttctatctccaaggaaaatgggagatggaggacacgatgataccctagttctgtatgggaaattcttggataagcaatttctcttcacgggaaatttggaggagaaaggagagaaggacttgctgaagcactatccagacttgaaagtaaatgttttgaaagctagccaacatggcaataaaaaatcatcaagcccagcctttctagaaaaactcaaaccagagcttactcttatctcagttggaaagagcaatcgaatgaaactcccccatcaggaaacattgacacgactggaaggtatcaatagcaaagtttatcgaactgaccagcaaggagctatacgttttaaggggttggatagttggaaaatcgaaagtgttcgatag

SEQ ID NO: 2508 - DNA, 588 bp, Streptococcus pneumoniae
atgttgcagcttactcatgtgaccttaaaaacgcgacaagtcatcttgcaagatgcggatttcacctttaaaaagggtaggttttatggtcttcttgctatcaatggctctggaaagacgaccctgttccgtgccattagcaatttaattcccataagtagtggaaatatcgcagcccctccttctttattttattatgagagtattgaatggctggatggaaacttaagtgggatggactaccttcgtcttatcaaaaacatctggaagtcagacctaaacttgagagatgaaatcgcctactgggaaatggctgactatatcagtcttcccatccgcaagtattccttaggcatgaagcaacgcttggtgattgctatgtattttctcagtcaggcaaaatgctggctcatggatgagattacaaatggcttagacgagtattatcgacagaagttttttgataggctagcacaaatcgatagacaagaacagctggttcttttaagttcccactataaggaagagttggttgatatctgcgatagagtagtaaccattcatcaggggcagatagaagaggtttag

SEQ ID NO: 2509 - DNA, 1176 bp, Streptococcus pneumoniae
atgaaagatgttagtctatttttattgaaaaaagttttcaaaagtcgtttaaactggattatcttacttttatttgcatctgtactcggtgttaccttttatttaaatagtcagactgcaaactcacacagcttggagagcaggttggaaagtcgcattgcagccaacgagagagccatcaatgaaaatgaagcgaaactttcccaaatgtctgacaccagctcggaggaataccagtttgctaaaagtaatttagaattgcaaaaaaatcttttgaagcgaaagacagaaattctgactttattaaaagaagggcgctggaaagaggcctactatctgcagtggcaagatgaagagaagaattatgaatttgtatcaaatgacccgactgctagctctggcttaaaaatgggggttgaccgcgaacggaagatttaccaagccctgtatcccttgaacataaaagcacatactttggagtttccgacccacgggattgatcagattatctggattttagaggctatcatcccaagcttgtttgtggttgctattatttttatgctaacacaactatttgcagaaagatatcaaaatcatctggacacagctcacttatatcctgtttcaaaagtgacatttgcaatgtcttctcttggagttggagtgggctatgtaactgtgctgtttatcggaatctgtggcttttcttttctagtgggaagtctgataagtggttttggacagttagattatccctacccgatttatagcttagtgaaacaagaggtaactattggaaagatgcaggatgtattatttcctagcttgctcttagctttcttagcctttatcgtcattgtggaagttgtgtatttgattgcttactttttcaagcaaaaaatgcctgtcctctttctttcactcattgggattgttggcttattgtttggcatccaaaccattcagcctcttcaaaagattgcacatctgattccctttacttacttgcgttcagtggagattttatctggaagattacctaagcagattgataatgtcgatctaaattggagcatgggaatggtcttacttccttgcctgattatctttttgctattgggaattctatttattgaaagatggggaagttcacagaaaaaaagaattttttaa

SEQ ID NO: 2510 - DNA, 264 bp, Streptococcus pneumoniae
atatacaagcccgcacgttatgatagcgtttcttcgaaacttttcatccgtagggccaggcaacttaatgtcacaaggcgagaagctctcacttctgcttttctcaacttttatatgataccaagttttctagctcttgtcaagataaaaagttattttttgaaaagtttgtgtttgtattttggtttggttttcaaatcaaaaagagagaatcaagttgattccctctctatgttagtttttacttattttccctacctatag

SEQ ID NO: 2511 - DNA, 588 bp, Streptococcus pneumoniae
gtgcgggcttgtatatttacgagtccgctattgtttttctctaataaaacaaaagaggtgaaaaccatagcaaagcaagacttattcatcaatgatgagattcgtgtacgtgaagttcgcttgattggtcttgaaggagaacagctaggcattaagccactcagtgaagcgcaagctttggctgataacgctaatgttgacctagtattgattcaaccccaagccaaaccgcctgttgcaaaaattatggactacggtaagttcaaatttgagtaccagaagaagcaaaaagaacaacgtaaaaaacaaagcgttgttactgtgaaagaagttcgtctaagtccaactattgacaagggtgactttgatacaaaacttcgtaatgcacgtaagttccttgaaaaaggaaataaagttaaggtatctattcgctttaagggtcgtatgattacccataaagagattggtgcaaaagttttagccgagtttgctgaagcaactcaagatattgccatcatcgaacaacgtgctaaaatggatggacgtcaaatgttcatgcaattggcgccagcgactgacaaaaaataa

SEQ ID NO: 2512 - DNA, 201 bp, Streptococcus pneumoniae
atgccaaaacaaaaaacacaccgcgcatcagctaaacgtttcaaacgtacaggttctggtggacttaaacgtttccgtgcttacacttctcaccgtttccacggaaaaactaagaaacaacgtcgtcatcttcgtaaagcatctatggtgcattcaggagattacaaacgtatcaaagcaatgcttactcgcttgaaataa

SEQ ID NO: 2513 - DNA, 360 bp, Streptococcus pneumoniae
atggcacgtgttaaaggtggcgttgtatcacgcaaacgtcgtaaacgtattcttaaattagcaaaaggttactatggagctaaacacatcttattccgtactgcaaaagaacaagtaatgaactcttactactatgcataccgtgaccgtcgtcagaaaaaacgtgacttccgcaaattgtggattactcgtatcaatgcggcagctcgtatgaacggactttcatactcacaattgatgcatggtttgaaattggctgagattgaagttaaccgtaaaatgcttgctgacttggctgttaacgatgcagtagctttcacagctcttgcagatgcagctaaagcaaaacttggtaaataa

SEQ ID NO: 2514 - DNA, 381 bp, Streptococcus pneumoniae
atggcttcaaaaatgctacacacttgcttacgagtagaaaatcttgaaaaatcaatcgcattttatcaagatgcttttggttttaaagaattgcgtcgcagagattttccagaccatgccttcacgattgtctatctaggtcttgagggtgatgattatgagttggagttgacttataactacgatcacggtccgtatgtggttggtgatgggtttgcccatatcgctctcagtacacctgatcttgaggcacttcatcaagaacacagtgcaaaaggctatgaagtgactgagccaaatggtctaccaggaactacaccaaactattactttgtcaaagaccctgatggatataaggtcgaagtcattcgtgaaaaataa

SEQ ID NO: 2515 - DNA, 570 bp, Streptococcus pneumoniae
atgaatctcacatgtaagaagcgtttgggtgtcattcggttggaaaccatgaaggtggttgcacaagaggaaatcgcgccagcaatctttgaattagtcctagaaggagaaatggttgaagccatgcgagcaggccaatttcttcatctgcgtgtaccagacgatgcccatctcttacgtcgtcctatttcaatttcgtctattgacaaggcaaacaagcagtgtcacctcatttatcggattgagggagctgggactgcaattttttcaaccttaagtcagggagacactcttgatgtgatggggcctcagggaaatggttttgacttgtctgaccttgatgagcagaatcaggttctccttgttggtggtgggattggtgttccacccttgcttgaggtggccaaggaattgcatgaacgtggagtgaaagtagtgacagtcctcggttttgctaataaggatgctgttattttgaaaacggaattggctcagtatggtcatgtctttgtaacgacagatgatggttcttatggcatcaagggaaatgtttcccgttgtttttcatga

SEQ ID NO: 2516 - DNA, 282 bp, Streptococcus pneumoniae
atgatggttcttatggcatcaagggaaatgtttcccgttgtttttcatgatttaaacagtcagtttgaacctctttactcgtgtggggctccattaatgatgaagtatatcaatcaaacctttgatgatcacccaagagcctatttatctctggaatctcgtatggcttgtgggatgggagcttgctatgcctgtgttctaaaagtaccagaaaacgagacggtcagccaacgcgtctgtgaagatggtcctgttttccgcacaggaacagttgtattataa

SEQ ID NO: 2517 - DNA, 939 bp, Streptococcus pneumoniae
atgactacaaatcgattacaagtttctctacctggtttggatttgaaaaatccgattattccagcatcaggctgttttggctttggacaaaagtatgccaagtactatgatttagaccttttaggttctattatgatcaaggcgacaacccttgaaccacgttttgggaatccaactccaagagtggcagagacgcctgctggtatgctcaatgcaattggcttgcaaaatcctggtttagaggttgttttggctgaaaagctaccttggctggaaagagaatatccaaatcttcctattattgccaatgtagctggtttttcaaaacaagagtatgcagctgtttctcatgggatttccaaggcaactaatgtaaaagctatcgagctcaatatttcttgtcccaatgttgaccactgtaatcatggacttttgattggtcaagatccagatttggcttatgatgtggtgaaagcagctgtggaagcctcagaagtgccagtttatgtcaaattaaccccgagtgtgaccgatatcgttactgtcgcaaaagctgcagaagatgcgggagcaagtggcttgaccatgatcaatactctggttggaatgcgctttgacctcaaaaccagaaaaccaatcttggccaatggaacaggtggaatgtcaggtccagcagtctttccagtagccctcaaactcatccgccaagtagcccaaacaacagacctgcctatcattggaatggggggagtggattcgactgaagctgccctagaaatgtatctggctggggcatctgctatcggagttggaacagctaactttaccaatccttatgcctgccctgacatcatcgaaaatttaccaaaagtcatggataaatacggtattagcagtctggaagaactccgtcaggaagtaaaagagtctctgaggtaa

SEQ ID NO: 2518 - DNA, 2166 bp, Streptococcus pneumoniae
atgaatttaggagaattttggtacaataaaataaataagaccataggaagaaggttaatgaagaaagtaagatttatttttttagctctgctatttttcttagctagtccagagggtgcaatggctagtgatggtacttggcaaggaaaacagtatctgaaagaagatggcagtcaagcagcgaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatagctgaaaaagaatgggtctacgattctcatagtcaagcttggtactacttcaaatccggtggctacatggcagccaatgaatggatttgggataaggaatcttggttttacctcaagtttgatggcaaaatggctgaaaaagaatgggtttacgattctcatagtcaagcctggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatccggtggttacatgacagccaatgaatggatttgggataaggaatcttggttttacctcaagtctgatggcaaaatggctgaaaaagaatgggtctacgattctcatagtcaagcctggtactacttcaaatctggtggctacatggcgaaaaatgagacagtagatggttatcagcttggaagcgatggtaaatggcttggaggaaaagctacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggcagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagattag

SEQ ID NO: 2519 - DNA, 1683 bp, Streptococcus pneumoniae
atggaatacaatcacaaggagagaacgatgtcatttgacggattttttttacaccacatagttgaggaattgcgaagcgaattagtgaatggtcgcatccagaaaatcaatcagccttttgaacaagagttggtcttgcaaatccgcagcaatcgccaaagccatcgcctgctcctttctgcccatccagtttttggacgcattcagctgacccaaacgacttttgaaaatccagcccaaccttctacctttatcatggttttgagaaagtatttgcagggggccctgattgagtcgattgagcaagtggaaaatgaccgtattgtggaaattacagtttccaataaaaacgagattggagaccatatccaggctaccttgattatcgaaattatggggaaacacagtaatattctactggtcgataaaagcagtcataaaatcctcgaagttatcaaacacgtcggtttttcacaaaatagctaccgcaccttacttccaggatcgacctatatcgctccgccaagtacagaatctctcaatccttttactatcaaggatgaaaagctctttgaaatcctgcaaacccaagaactaacagcaaaaaatcttcaaagcctttttcaaggtctgggacgcgatacggcaaatgaattggaaaggatactggttagtgaaaaactttccgctttccgaaattttttcaatcaggaaaccaagccatgcttgactgagacttccttcagtccagttccttttgcaaatcaggtgggagagccttttgcaaatctttctgatttgttggacacctactataaggataaggctgagcgcgaccgcgtcaaacagcaggccagtgaactgattcgtcgtgttgaaaatgaacttcagaaaaaccgacacaaactcaaaaaacaggaaaaagagttactggcgacagacaacgctgaagaatttcgtcaaaaaggagaattgctgacaaccttcctccaccaagtgcctaacgaccaagaccaggttatcctagacaactactataccaaccaacctatcatgattgcgcttgataaggctctgactcccaaccagaatgcccaacgctattttaaacggtatcagaaactcaaagaagctgtcaaatacttgactgatttgattgaagaaaccaaagccactattctctatctggaaagtgtagaaaccgtcctcaaccaagctggactggaagaaatcgctgaaatccgtgaagaattgattcaaacaggttttatccgcagaagacaacgggagaaaatccagaaacgcaaaaaactagaacaatatctagcaagcgatggcaaaaccatcatctatgtcggacgaaacaatcttcaaaatgaggaattgacctttaaaatggcccgcaaggaggaactttggttccatgctaaggacattcctggaagccatgttgtcatctcaggaaatcttgacccatctgatgcagtcaagacagacgcagcagagttagctgcctacttctctcaagggcgcctgtcgaatctggtgcaggtagatatgattgaagtcaaaaaactcaataaaccaactggtggaaaacccggctttgtcacttacacaggacaaaagaccctccgcgtcacaccagactccaaaaaaattgcatccatgaaaaaatcctga

SEQ ID NO: 2520 - DNA, 231 bp, Streptococcus pneumoniae
ctgcttttatcgaccagtagaatattactgtgtttccccataatttcgataatcaaggtagcctggatatggtctccaatctcgtttttattggaaactgtaatttccacaatacggtcattttccacttgctcaatcgactcaatcagggccccctgcaaatactttctcaaaaccatgataaaggtagaaggttgggctggattttcaaaagtcgtttgggtcagctga

SEQ ID NO: 2521 - DNA, 498 bp, Streptococcus pneumoniae
atgtatattgaaatggtagatgaaactggtcaagtttcaaaagaaatgttgcaacaaacccaagaaattttggaatttgcagccaaaaaattaggaaaagaagacaaggagatggcagtcacttttgtgaccaatgagcgtagtcatgaacttaatctggagtaccgtgacaccgaccgtccgacagatgtcatcagccttgagtataaaccagaattggaaattgcctttgacgaagaggatttgcttgaaaatccagaattggcagagatgatgtctgagtttgatgcctatattggggaattgttcatctctatcgataaggctcatgagcaggccgaagaatatggtcacagctttgagcgtgagatgggcttcttggcagtacacggctttttacatattaacggctatgatcactatactccggaagaagaagcggagatgttcggtttacaagaagaaattttgacagcctatggactcacaagacaataa

SEQ ID NO: 2522 - DNA, 396 bp, Streptococcus pneumoniae
atggactcacaagacaataaacgaaaatggaaaaatcgtgacctgatatccagtttagaatttgccatcacaggaatttttactgctatcaaggaagaacgcaatatgcgaaaacatgcagtgacggctctagtggtcatccttgcaggttttggttttcaggtgtcacgaatcgaatggctctttctcctgttgagcattttcttggtggtagcctttgaaattatcaattctgctatcgaaaatgtggtggatttggccagtcactatcacttttccatgctggctaaaaatgccaaggatatggcggctggcgcggtatttgtggtttctctttttgcagccttaacaggcgcattgatttttctcccacgaatctgggatttattattttaa

SEQ ID NO: 2523 - DNA, 900 bp, Streptococcus pneumoniae
atgacttttaaatcaggctttgtagccattttaggacggccccatgttgggaagtcaacctttttaaatcacgttatgggggcaaagattgccatcatgagtgacaaggcgcagacaacgcgcaataaaatcatgggaatttacacaactgataaggagcaaattgtctttatcgacacaccagggattcacaaacctaaaacaactctcggagatttcatggttgagtctgcctacagtacccttcgcgaagtggacaccgttcttttcatggtgcctgctgatgaagcgcgtggtaagggggacgatatgattatcgagcgtctcaaggctgccaaggttcctgtgattttggtggtgaataaaatcgataaggtccatccagaccagctcttgtctcagattgatgacttccgtaatcaaatggactttaaggaaattgttccaatctcagcccttcagggaaataacgtgtctcgtctagtggatattttgagtgaaaatctggatgaaggtttccaatatttcccgtctgatcaaatcacagaccatccagaacgtttcttagtttcagaaatggttcgcgagaaagtcttgcacctaactcgtgaagagattccgcattctgtagcagtagttgttgactctatgaaacgagacgaagagacagacaaggttcacatccgtgcaaccatcatggtcgagcgcgatagccaaaaagggattatcatcggtaaaggtggcgctatgcttaagaaaatcggtagcatggcccgtcgtgatatcgaactcatgctaggagacaaggtcttcctagaaacctgggtcaaggtcaagaaaaactggcgcgataaaaagctagatttggctgactttggctataatgaaaaagaatactaa

SEQ ID NO: 2524 - DNA, 825 bp, Streptococcus pneumoniae
atgcctgaattacctgaggttgaaaccgtttgtcgtggtttagaaaaattgattataggaaagaagatttcgagtatagaaattcgctaccccaagatgattaagacggatttggaagagtttcaaagggaattgcctagtcagattatcgagtcaatgggacgtcgtggaaaatatttgcttttttatctgacagacaaggtcttgatttcccatttgcggatggagggcaagtatttttactatccagaccaaggacctgaacgcaagcatgcccatgttttctttcattttgaagatggtggcacgcttgtttatgaggatgttcgcaagtttggaaccatggaactcttggtgcctgaccttttagacgcctactttatttctaaaaaattaggtcctgaaccaagcgaacaagactttgatttacaggtctttcaatctgcccttgccaagtccaaaaagcctatcaaatcccatctcctaaaccagaccttggtagctggacttggcaatatctatgtggatgaggttctctggcgagctcaggttcatccagctagaccttcccagactttgacagcagaagaagcgactgccattcatgaccagaccattgctgttttgggccaggctgttgaaaaaggtggctccaccattcggacttataccaatgcctttggggaagatggaagcatgcaggactttcatcaggtctatgataagactggtcaagaatgtgtacgctgtggtaccatcattgagaaaattcaactaggcggacgtggaacccacttttgtccaaactgtcaaaggaaggactga

SEQ ID NO: 2525 - DNA, 183 bp, Streptococcus pneumoniae
ttggtggacgaatgggtcggcaatccaatggttgaaagcccttgctgttttagaaaatttgtcacagttgacttacctgaggcaattcccccagtgattccgatgatttttcccatcagtccttcctttgacagtttggacaaaagtgggttccacgtccgcctagttgaattttctcaatga

SEQ ID NO: 2526 - DNA, 609 bp, Streptococcus pneumoniae
atgggaaaaatcatcggaatcactgggggaattgcctcaggtaagtcaactgtgacaaattttctaaaacagcaagggctttcaaccattggattgccgacccattcgtccaccaactacagaaaacctggtggtcgtctgtttgaggctttagtacagcactttgggcaagaaatcattcttgaaaacggagaactcaatcgccctctcatagctagtctcatcttttcaaatcctgaagagcaaaaatggtctaatcaaattcaaggggagattatccgtgaggaactggctactttgagagaacagttggctcagacagaagagattttcttcatggatattcccctactttttgaacaggactacagcgattggtttgctgagacttggttggtctatgtggaccgagatgcccaagtagaacgcttaatgaaaagggaccagttgtccaaagatgaagctgagtctcgtatggcagcccagtggcctttagaaaaaaagaaagatttggccagccaggttcttgataataatggcaatcagaaccagcttcttaatcaagtgcatatccttcttgagggaggtaggcaagatgacagagattaa

SEQ ID NO: 2527 - DNA, 201 bp, Streptococcus pneumoniae
atgggcataaaaggtacaaccaaagaaatactggctcctgtcagaaaattaccaaaccaggcaatacgcagattatccttccagttaatctctgtcatcttgcctacctccctcaagaaggatatgcacttgattaagaagctggttctgattgccattattatcaagaacctggctggccaaatctttctttttttctaa

SEQ ID NO: 2528 - DNA, 1200 bp, Streptococcus pneumoniae
atgacagagattaactggaaggataatctgcgtattgcctggtttggtaattttctgacaggagccagtatttctttggttgtaccttttatgcccatcttcgtggaaaatctatgtgtatggagtcagcaagtcgctttttatgcaggcttagcaatttctgtctctgctatttccgcggcgctcttttctcctatttggggtattcttgctgacaaatacggccgaaaacccatgatgattcgggcaggtcttgctatgactatcactatgggaggcttggcctttgtcccaaatatctattggttaatctttcttcgtttactaaacggtgtatttgcaggttttgttcctaatgcaacggcactgatagccagtcaggttccaaaggagaaatcaggctctgccttaggtactttgtctacaggcgtagttgcaggtactctaactggtccctttattggtggctttatcgcagaattatttggcattcgtacagttttcttactggttggtagttttctatttttagctgctattttgactatttgctttatcaaggaagattttcaaccagtagccaaggaaaaggctattccaacaaaggaattatttacctcggttaaatatccctatcttttgctcaatctctttttaaccagttttgtcatccaattttcagctcaatcgatcggccctattttggctctttatgtacgcgacttagggcagacagagaatcttctttttgtctctggtttgattgtgtccagtatgggcttttccagtatgatgagtgcaggagtcatgggcaagctaggtgacaaggtgggcaatcatcgtctcttggttgtcgcccagttttattcagtcatcatctatctcctctgtgccaatgcctctagcccccttcaactaggactctatcgtttcctctttggcttgggaaccggtgccttgattcccggggttaatgccctactcagcaaaatgactcccaaagccggcatttcgagggtctttgccttcaatcaggtattcttttatctgggaggtgttgttggtcccatggcaggttctgcagtagcaggtcaatttggctaccatgctgtcttttatgcgacaagcctttgtgttgcctttagttgtctctttaacctgattcaatttcgaacattattaaaagtaaaggaaatctag

SEQ ID NO: 2529 - DNA, 150 bp, Streptococcus pneumoniae
gtgcgagtaaaaattaatctcaaatgctcctcttgtggcagtatcaattacctaaccagtaaaaattcaaaaacccatccagacaagattgaggttttaaagtattgtcccaaggaaagaaaagtaaccctacatcttgaatctaagtag

SEQ ID NO: 2530 - DNA, 234 bp, Streptococcus pneumoniae
atgtataacctattattaaccattttattagtattatctgttgtgattgtgattgcaattttcatgcaaccaaccaaaaaccaatccagcaatgtatttgatgccagttcaggtgatttgtttgaacgcagtaaagctcgcggttttgaagctgtaatgcagcgtttgacagggattttagtctttttctggctagccattgccttagcattgacggtattatcaagtagataa

SEQ ID NO: 2531 - DNA, 2355 bp, Streptococcus pneumoniae
atgaaagatagaataaaagaatatttacaagacaagggaaaggtgactgttaatgatttggctcaggctttgggaaaagacagttccaaggattttcgtgagttgattaaaaccttgtccttaatggaaagaaagcaccaaattcgttttgaagaagatggtagtctgacattagaaattaagaaaaaacatgagattaccctcaaggggatttttcatgcccataaaaacggctttggctttgttagtctggaaggcgaggaggacgacctttttgtagggaaaaatgatgtcaactatgctattgatggtgataccgtcgaggtagtgattaagaaagtcgctgaccgcaataagggaacagcagcagaagccaaaattattgatatcctagaacacagtttgacaacagttgtcgggcaaatcgttctggatcaggaaaagcctaagtatgctggctatattcgttcaaaaaatcagaaaatcagtcaaccgatttatgttaagaaaccagccctaaagttagaaggaacagaagttctcaaggtctttatcgataaatacccaagcaagaaacatgatttctttgtcgcgagtgttctcgatgtggtgggacactcaacggatgtcggaattgatgttcttgaggtcttggaatcaatggacattgtatccgagtttccagaagctgttgttaaggaagcagaaagtgtgcctgatgctccgtctcaaaaggatatggaaggccgtctggatctaagagatgaaattacctttaccattgacggtgcggatgccaaggacttggacgatgcagtgcatatcaaggctctgaaaaatggcaatctggagcttggggttcacatcgcagatgtttcttattatgtgaccgaggggtctgcccttgacaaggaagcccttaaccgtgcgacttctgtttacgtgacagaccgagtggtgccaatgcttccagaacgactatcaaatggcatctgctctctcaatccccaagttgaccgcctgacccagtctgctattatggagattgataaacatggtcgtgtggtcaactataccattacacaaacagttatcaagaccagttttcgtatgacctatagcgatgtcaatgatatcctagctggcgatgaagaaaagagaaaagaatatcataaaattgtatcaagtatcgaactcatggccaagcttcatgaaactttagaaaacatgcgtgtgaaacgtggagctctcaattttgataccaatgaagcgaagattttagtggataaacaaggtaagcctgttgatatcgttcttcggcagcgtggcattgccgagcggatgattgagtcttttatgttgatggctaatgaaacagttgccgaacatttcagcaagttggatttgccttttatctatcgaattcacgaggagcctaaggctgaaaaggttcagaagtttattgattatgcttcgagttttggcttgcgtatttatgggactgccagtgagattagtcaggaggcacttcaagacatcatgcgtgctgttgagggagaaccttatgcagatgtattgtccatgatgcttcttcgctctatgcagcaggcttgttattcggagcacaatcacggccactatggactagctgctgactattatactcactttaccagtccaattcgtcgttatccagaccttcttgttcaccgtatgattcgggattacggccgttctaaggaaatagcagagcattttgaacaagtgattccagagattgcgacccagtcttccaaccgtgaacgtcgtgccatagaagctgagcgtgaagtcgaagccatgaaaaaggctgagtatatggaagaatacgtgggtgaagagtatgatgcagttgtatcaagtattgtcaaattcggtctctttgtcgaattgccaaacacagttgaaggcttgattcacatcactaatctacctgaattttatcatttcaatgagcgtgatttgactcttcgtggagaaaaatcaggtatcactttccgagtgggtcagcagatccgtatccgtgttgaaagagcggataaaatgactggagagattgatttttcattcgtacctagtgagtttgatgtgattgaaaaaggcttgaaacagtctagtcgtagtggcagagggcgtggttcaaatcgtcgttcggataagaaggaagacaagagaaaatcaggacgctcaaatgataagcgtaagcattcacaaaaagacaagaagaaaaaaggaaagaaatctttttacaaggaagtagctaagaaaggagccaagcatggcaaagggcgagggaaaggtcgtcgcacaaaataa

SEQ ID NO: 2532 - DNA, 468 bp, Streptococcus pneumoniae
atggcaaagggcgagggaaaggtcgtcgcacaaaataaaaaggcacgccacgactatacaatcgtagatacgctagaggcagggatggtcctgactggaactgaaatcaagagtgtacgagctgctcgaattaatctcaaggatggctttgctcaagtgaaaaatggagaagtttggctgagcaatgttcatatcgcgccttacgaagagggcaatatctggaaccaggaaccagaacgtcgtcgtaaactcctgctccataaaaagcaaattcaaaaattggaacaagagaccaaagggacaggaatgaccttagttccccttaaggtctatataaaagatggctacgctaagcttcttttaggacttgccaaagggaagcatgactatgacaaacgggagtctatcaaacgtcgtgagcaaaatcgagatatcgcgcgtgtgatgaaagctgttaatcagcgataa

SEQ ID NO: 2533 - DNA, 861 bp, Streptococcus pneumoniae
atggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttgacctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 2534 - DNA, 387 bp, Streptococcus pneumoniae
ctcttgaaatcttgcaaagcattgtggagcaggaagatttggacatgcctgttgacctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactag

SEQ ID NO: 2535 - DNA, 222 bp, Streptococcus pneumoniae
cgcaaatggatctggcctccacaagctgggcaggtgtatgcttgcttctcaagtttatcctctaacacatttaccaattctcccctagtatctctcgcaacaaacatgaattccctccttttctatatcattcgtaaaaaagaaaaaagatcaggaaaattcctaatcttcatgtgtgtttacttgattttcttagctagtaaggtcgcaaagcgtagttga

SEQ ID NO: 2536 - DNA, 954 bp, Streptococcus pneumoniae
atgtttgttgcgagagatactaggggagaattggtaaatgtgttagaggataaacttgagaagcaagcatacacctgcccagcttgtggaggccagatccatttgcgtcaaggaccaagtgtacggacgcattttgcccataaatccttaaaagactgtgattttttctttgaaaatgaaagtccagaacacatagccaataaggaatccctctatcactggttgaaaaaagagacaaaggttcaattagagtacccgctttcagaacttaaacagattgcggatgtatttgtaaatggcaatctagctctagaagttcagtgtagtcccttgcctcagaaagtccttaaagagcgaagtgagggctatcgtagtcagggttaccaagtactgtggttgctgggtcaaaaactgtggctcaaggagcgtttgactcgtctacagcaaggttttctgtatttcagtcaaaacatgggcttttatgtttgggaattagacaaggaaaaacaagttttaagactcaaatacctgatttaccaggatctccgcggtaaactccattatcaaatcaaggaattttcctatggtcaaggtagtttattggaaatattgcgtcttccctataagagacaaaaaatatctcattttacagtttctgaggacaaggacatctgtcgctatattcggcaacaactttattatcaaaatctcttttggatgaaagaacaagcagaagcctatcaaaagggagaaaatatcctgacttatggactgaaagaatggtatccacaaattcgaccaatagtgggcaaatttttccagattgaacaagacttgactagctattatcggaacttttatacctattaccaaaaaaatcctcaaaatgattggcaaaagctttatccaccagccttttatcagcaatatttcttgaaaaatatggtagaatag

SEQ ID NO: 2537 - DNA, 1803 bp, Streptococcus pneumoniae
atggtattacaaagaaatgaaataaatgaaaaagatacatgggatctatcaacgatctacccaactgaccaggcttgggaagaagccttaaaagatttaacagaacaattggagacagtagcccagtatgaaggccatctcttggatagtgcggataacctactagaaatcactgaattttctcttgaaatggaacgccagatggagaagctttacgtttatgctcatatgaagaatgaccaggatacacgtgaagctaagtatcaagagtactatgccaaggccatgacactctacagccagttagaccaagccttttcattctatgagcctgaatttatggagattagcgaaaagcagtatgctgactttttagaagctcaaccaaagctgcaggtttatcaacactattttgacaagctcttgcaaggcaaggatcacgttctttcacaacgtgaagaagaattattggctggagctggagaaatctttggttcagcaagtgaaaccttctctatcttggacaatgcggatattgtgttcccttatgtcctagacgatgatggtaaagaagttcagctatctcatgggacttacacacgtttgatggagtctaaaaaacgtgaggttcgccgtggtgcctatcaagctctttatgcgacttacgaacaattccaacacacctatgccaaaaccttgcaaaccaatgttaaggtgcaaaattaccgtgctaaagttcgtaactacaagagtgctcgtcatgcagccctcgcagcgaattttgttccagaaagtgtttatgacaatttggtagcagcagttcgcaagcatttgccactcttacatcgctatcttgagcttcgttcaaaaatcttggggatttcagatctcaagatgtacgatgtctacacaccgctttcatctgttgaatacagttttacctaccaagaagccttgaaaaaagcagaagatgctttggcagtcttgggtgaggattacttgagccgtgtcaaacgtgccttcagcgagcgttggattgatgtttacgaaaatcaaggcaagcgttcaggtgcctactctggtggttcttatgataccaatgcctttatgcttctcaactggcaggacaatctggacaatctctttactcttgttcatgaaacaggtcacagtatgcattcaagctatactcgtgaaactcagccttatgtttacggagattactctatctttttggctgagattgcctcaactaccaatgaaaatatcttgacggagaaattattggaagaagtggaagacgacgcaacacgctttgctattctcaataacttcctagatggtttccgtggaacagttttccgccaaactcaatttgctgagtttgaacacgccattcaccaagcagatcaaaatggggaggtcttgacaagcgatttcctaaataaactctacgcagacttgaaccaagagtattatggtttgagtaaggaagacaatcctgaaatccaatacgagtgggctcgtattccacacttttactataactactatgtatatcaatattcaactggatttgcggccgcctcagccttggctgaaaaaattgtccatggtagtcaagaagaccgtgaccgctatatcgactacctcaaggcaggtaagtcggactatccacttaatgtcatgagaaaagctggtgttgatatggagaaggaagactacctcaacgatgcctttgcagtctttgaacgccgtttaaatgagtttgaagcccttgttgaaaaattaggattggcataa

SEQ ID NO: 2538 - DNA, 714 bp, Streptococcus pneumoniae
atggttgaatcgtatagtaagaatgctaaccataacatgcgtcgtcctgtcgtcaaagaagaaattgtagacttgatgcgtcagcgtcaaaagcaggtcacaggtttcttgaaagaattggaagactttgcccgcaaggaaaatattcctattattccccatgaaacggttgcttatttccgttttcttatggaaaccatgcagcctaaaaatattctggaaattgggacggctatcggtttttcagctctcttgatggctgaacatgcgccaaatgctaagattacaactattgatcgtaatccagaaatgattggttttgccaaggaaaattttgcccagtttgacagtcgcaagcaaatcactctcctagagggagatgcggtggatgtcttatctacactgacagagtcttatgatttcgtctttatggattctgccaagtctaaatacatcgtctttctgccagaaatcctcaaacatttggaagttggtggtgtggttgtcttggatgatatttttcaaggtggtgatgttgccaaggatattatggaagtccgtcgtggtcagcgaaccatttatcgaggccttcaaaaattatttgatgcaaccttagacaatccagaactcaccgcaacattagtgcctttaggagatggtattctcatgcttcgtaaaaatgtagcagatgttcaactgtctgaaagcgaatga

SEQ ID NO: 2539 - DNA, 942 bp, Streptococcus pneumoniae
atgaagaaaaaattattggcaggtgccatcacactattatcagtagcaactttagcagcttgttcgaaagggtcagaaggggcagaccttatcagcatgaaaggggatgtcatcacagaacatcaattttatgagcaagtgaaaaacaacccttcagcccaacaagtcttgttaaatatgaccatccaaaaagtttttgaaaaacaatatggctcagagcttgatgataaagaggttgatgatactattgccgaagaaaaaaaacaatatggcgaaaactaccaacgtgtcttgtcacaagcaggtatgactcttgaaacacgtaaagctcaaattcgtacaagtaaattagttgagttggcagttaagaaggtagcagaagctgaattgacagatgaagcctataagaaagcctttgatgagtacactccagatgtaacggctcaaatcatccgtcttaataatgaagataaggccaaagaagttctcgaaaaagccaaggcagaaggtgctgattttgctcaattagccaaagataattcaactgatgaaaaaacaaaagaaaatggtggagaaattacctttgattctgcttcaacagaagtacctgagcaagtcaaaaaagccgctttcgctttagatgtggatggtgtttctgatgtgattacagcaactggcacacaagcctacagtagccaatattacattgtaaaactcactaagaaaacagaaaaatcatctaatattgatgactacaaagaaaaattaaaaactgttatcttgactcaaaaacaaaatgattcaacatttgttcaaagcattatcggaaaagaattgcaagcagccaatatcaaggttaaggaccaagccttccaaaatatctttacccaatatatcggtggtggagattcaagctcaagcagtagtacatcaaacgaatag

SEQ ID NO: 2540 - DNA, 342 bp, Streptococcus pneumoniae
atgttggaacaggcattcaaagagaagcactacgagaatacgattctccatagtgaccaaggctggcaataccaacacgattcttatcatcgcttcctagagagtaagggaattcaagcatctatgtcacgcaaaggaaacagccaagacaacggtaggatggaatctttctttggcattttaaaatccgaaatgttttatggctatgagcaaacatttaaatcacttaatcaattggaacaagccattatagactatattgattattacaacaataagagaattaagataaaactaaaaggacttagctctgtgcaatacagaactaaatccttcggataa

SEQ ID NO: 2541 - DNA, 573 bp, Streptococcus pneumoniae; identical to SEQ ID NO: 19

SEQ ID NO: 2542 - DNA, 273 bp, Streptococcus pneumoniae
aagcagttatgtactattttagattcacttttctatactaagatgagtagggaggaaaaggtaaaagtttatgcccaaactcttcacataagaactctagcttacccattctatggaatcttgcattatccattaaaacttccagactcatacccttctaaaatctattcaaaccacgtcagcttcacattatatatgttggttacctcacaagttttatctgcaacctcaaagctgttctttgagcagcctacagctagcttcctagtttaa

SEQ ID NO: 2543 - DNA, 192 bp, Streptococcus pneumoniae
attgatttaaattctcaaatcatattattcagttcttatttcattttgctctacaatcctgttgagaagacacgtgttcatatcaaaaaggtattggcaagttgcaatacctttttacgaggctcttttatcttatttttgtttcaactgactatatctcctatggttctagttcagaaggctaggctataa

SEQ ID NO: 2544 - DNA, 621 bp, Streptococcus pneumoniae
atgaaactctactttgtccgccacggtcgtaccctctggaaccaagaaggtcgttttcaaggtgctagcggtgattctcctcttcttcctgaatccattgaaaccctaaaacgacttggccagtatctcaaggaaattccttttgatcagatttattcaagtgatttacctcgagcggtcaaatctgctgagattatccaaagtcaactctataccccctgttctttagaaatcgttcctaatctccgtgaatggcaacttgggaagttagaaggtttgaaaattgcaaccttggaagctatttacccgcaacaaatccaggcttttcgttcaaatcttgctcaatttgacactcgaatgttcggagccgaatccctctatagtacaactcagcggaccatccaatttatcaaatcattaaaagatagtccagctgagcgtattctaattgtcggacacggcgccaatcttactgccagtcttcgtactctcctaggctataaagaaccacttcttcgtaaagatggcggtctagcaaatgccagcctgaccattatagaaacccatgattttgaaacattcactctcaatacttggaatgatacttcttatcaatcataa

SEQ ID NO: 2545 - DNA, 483 bp, Streptococcus pneumoniae
atggcaaaaaaagttaaaatcaaaaaaacattggtggaacaaatcctatctaaagcagctatccctcatcaggggattcaaatcaatgccctagaaggagagcttcctcaaggttatgaacgagatcagattttcaaaaccttggcgcttttgggagacaagaccggaccgattatcggaattgtccctatcactcagcacttgtctgaaaagaaactagctaaaatttctggcaataaaaaagtgagcatgattccacaaaaggacttagaaaaaacaactggttacattcatggagccaataatcctgtcggaattcgtcagaaacacaattatcccatttttatcgataaaattgctctagatttggatcgaatgattgtctctgcaggcgaagtcggacacagcattatcgtcgcgccacaagacttggctagctttgtaaaggcagactttgtagatattttggaggacatcaagtaa

SEQ ID NO: 2546 - DNA, 843 bp, Streptococcus pneumoniae
atgctctcatggttagcacgcgttattaaagggattgtaattgctcttggatttatcctaccgggaatttccggaggggttctagcagcaatcttaggaatctatgaacgaatgattggctttctggcccatccctttaaagactttaaagaaaatgttttgtactttattccagttgccatcggtatgcttctgggaatcggcttattttcctacccgattgaatacctgcttgaaaattatcaggtttttgtattatggagctttgcgggagctattatcggtacagttcctagcctcctcaaagaatcaactcgagaatctgaccgagacaagattgatttagcttggttatggacaacctttatcatttctggattaggactctatgccttaaattttgtcgttggaaccttaagcgccagctttcttaacttcgtcctagcaggcgcactattggcccttggcgtcttggttcctggcctcagtccatcaaatttacttttgattttgggactctatgctcctatgttgactggttttaaaacttttgatctcttgggaaccttctttccgattggaattggtgcaggtgcaactctcatcgttttttcaaaattgatggattatgccttaaacaactaccactcacgcgtctatcatttcatcatcggtatcgtcctatcaagtacccttttgatcttaattccaaatgcaggaaacgctgaaagtatccaatacacaggactttcacttgtcggttatgtcatcatcgccttcttctttgcgctgggaatctggcttggtatttggatgagtcaattggaggataaatataaataa

SEQ ID NO: 2547 - DNA, 789 bp, Streptococcus pneumoniae
atgagaaaacaaattcatccacttattttatttagtttttttgggattatgatgttcattttaatcatcaatcgcccacttaatgacagccaatcgtttaaaacaaaatccaatatagcacaggctttgaaacacttagacaaaccgattattgacctctctggctggcagcgtcctgaggaaatcaactacgatgccctctcacaaaatatttcaggtgctattgttcgtgttcacagtggtgctcaaacaacaaaagaaaatgatgcttcatttatcaatggaatagacaaggcctataagagtcatatcactgaacttcaaaagcggaatgtcccagttgctgtctacgcttatgtagctggaaaaagtgtccaagaaatggaaaaggctgccgaagttttctacaatgctgcctctccttacagccctagttactattggcttgacgtggaaaataaaaccatgtctaatatgaacgaaggtgtcgaaaactttcgagcaaaactagcatcactaggtgctaaaaacatcggcatctacgttggtgtctacttcatggaagaaacacgtattgatacaggcaagtttacctctgtgtggattccgtcctacggctcaaactcaggatttttggagagcagtcctaaaactgatttagattatgatattcaccaatacacatctaaaggaaaaattgccggctttgaccacgatttagatatcaacgttatctctcccttaaaaaataaagaagaaacctttcgaaaactttttttaaaaccttaa

SEQ ID NO: 2548 - DNA, 1380 bp, Streptococcus pneumoniae
atgtcaaattttgccattattttagcagcgggtaaagggactcgcatgaaatctgatttgccaaaagttttgcacaaggttgcgggtatttctatgttggaacatgttttccgtagtgtgggagctatccaacctgaaaagacagtaacagttgtaggacacaaggcagaattggttgaggaggtcttggctggacagacagaatttgtgactcaatctgaacagttgggaactggtcatgcagttatgatgacagaacctatcttagaaggtttgtcaggacacaccttggtcattgcaggagatactcctttaatcactggtgaaagcttgaaaaacttgattgatttccatatcaatcataaaaatgtggccactatcttgactgctgaaacggataatccttttggctatggacgaattgttcgtaatgacaatgctgaggttcttcgtattgttgagcagaaggatgctacagattttgaaaagcaaatcaaggaaatcaacactggaacatacgtctttgacaacgagcgtttgtttgaggctttgaaaaatatcaataccaataacgctcaaggcgaatactatattacagacgtcattggtattttccgtgaaactggtgaaaaagttggcgcttatactttgaaagattttgatgaaagtcttggggtaaatgaccgtgtggcgcttgcgacagctgagtcagttatgcgtcgtcgcatcaatcataaacacatggtcaacggtgttagctttgtcaatccagaagcaacttatatcgatattgatgttgagattgctccggaagttcaaatcgaagccaatgttatcttgaaagggcaaacgaaaattggtgctgagactgttttgacaaacggtacttatgtagtggacagcactatcggagcaggagcggtcattaccaattctatgattgaggaaagtagtgttgcagacggtgtgacagtcggtccttatgctcacattcgtccaaattcaagtctgggtgcccaagttcatattggtaactttgttgaggtgaaaggatcttcaatcggtgagaataccaaggctggtcatttgacttatatcggaaactgtgaagtgggaagcaacgttaatttcggtgctggaactattacagtcaactatgacggcaaaaacaaatacaagacagtcattggagtcaatgtctttgttggttcaaattcaaccattattgcaccagtagaacttggtgacaattccctcgttggtgctggttcaactattactaaagacgtgccagcagatgctattgctattggtcgcggtcgtcagatcaataaagacgaatatgcaacacgtcttcctcatcatcctaagaaccagtag

SEQ ID NO: 2549 - DNA, 546 bp, Streptococcus pneumoniae
atggagtttgaagaaaaaacgcttagccgaaaagaaatctatcaaggaccaatatttaaactggtccaagatcaggttgaattaccagaaggcaagggaactgcccgacgggatttgattttccacaatggggctgtctgtgttttagcagtaacggatgaacaaaaacttatcttggtcaagcagtaccgcaaagctatcgaggctgtctcttacgaaattccagccggaaaattggaagtaggagaaaacacagcccctgtggcagctgcccttcgtgaattagaggaagaaacagcctatacagggaaattagaactcttgtacgatttttattcagctattggcttttgtaatgagaagttaaaactatatttagcaagcgatttgacaaaagtggaaaatccgcgtccgcaggatgaggatgaaaccttggaagtccttgaagtgagcttagaagaagcgaaagaattaatccaatcaggtcatatctgtgatgccaagacaattatggctgttcagtattgggagttgcagaaaaaatag

SEQ ID NO: 2550 - DNA, 315 bp, Streptococcus pneumoniae
atgggtaaatctttattaacggatgaaatgattgaaagagctaatagaggcgaaaaaatttcaggtcctcctttgctagatgataatgaggaaactaagattttaccaacctcttcttcccgttttggttatgccaatcctaaggatcatggttttagccaggaaaccttgaagattcaggtcgaaccatctattcataaaagccgtcgtattgaaaataccaagagaaatgtcttcaattctaagttgaataaaatcttatttgcggtcatctttctcttgattttgcttgttttagcaatgaaacttttgtaa

SEQ ID NO: 2551 - DNA, 693 bp, Streptococcus pneumoniae
atgaaaataggaattattgctgctatgccagaagaactggcttatctggtccagcatttagataatacccaggagcaagttgttttgaggaatacctatcatacaggaaccattgcttctcatgaagtcgttcttgtagaaagtggaattggtaaggtcatgtctgctatgagtgtggcgattttggctgatcatttccaggtggatgcccttattaatacgggttcagctggggcagtagcagaaggtatcgctgttggggatgtcgtgattgctgacaaattagcctatcatgacgtggatgtcacagcttttggctatgcttatggacaaatggcgcaacaaccgctttatttcgaatcagacaaaacctttgttgctcaaatccaagagagtttatctcaattggaccaaaactggcatcttggtttgattgctacaggagatagttttgttgcaggaaatgacaagatagaagcgattaagtcccatttcccagaagttttagccgtggagatggagggggcagctattgctcaagcagcgcatgccctcaatctcccagtcttagtcatcagagctatgagtgacaatgccaaccatgaagcaaacatcttttttgatgagtttattatcgaagctggacgtcgctctgcccaagtcttgttgacctttttgaaggctttagattaa

SEQ ID NO: 2552 - DNA, 492 bp, Streptococcus pneumoniae
atgagtattgaaatgaccgtcagtgagattgcagaggtcttaggattatctcgccaagcaatcaataaccgtgtcaaagaattaccagaagaagacacagataaaaatgacaaaggggtaacagttgttaccagaagtggcttgattaagctagaagaaatctataaaaaaacgatttttgaagatgagcctgtcagtgaagatgtcaaacaacgtgaactgatggagattctagtggatgagaagaatgcagaaattcttcgtctttatgaacaattaaaagccaaggatcgtcagttatcagaaaaagacgagcagatgcgtatcaaagaccgtcagattgctgagaaagacaaacaattagatcagcaacaacaattgacccttcaagccatgaaggatcaagaaaatcttaagctagagctggaccaagcaaaagaagaagtccaatccactaaaaaaggcttttttgctcgtttatttggaggataa

SEQ ID NO: 2553 - DNA, 591 bp, Streptococcus pneumoniae
atggaacgattagaagattacattgcttttgatttagaatttaatcagcacgaaggacaaacacacttgattcaagtatcggcagtgcgttttagagatggtcgggaaatcgatgcctatgattcctatgttcataccagcgtccctctaaaaagctttatcaatggtttgaccgggattacagctgagaccttaaaagatgctcctccagttgagaaagtcttagaagaattccaagagtttgtgggttctttgctgatgataggctacaatgctgctaaaagtgatttacctattttagcagagcatggtttagactatagccaacagtacaaggtggatttgtatgatgaagcttttgaacgtcggagttcagatttacatggtattgccaatctcaaattgcaaactgttgcctcatttcttggatttcaaggtcagtctcataatagtttagaggatgctcggatgacggcgcgtgtttacgaatccttcttagagtcggatcaagctagggaattgttagagacagaaagtagcttatcaaacaatccttttggtggcttggacttgtctcaattatttgactag

SEQ ID NO: 2554 - DNA, 771 bp, Streptococcus pneumoniae
atggttcatctacctcaacttatttctcaccgaggggtttccaatgcaaatgggattcaaaatacagtagagtccttggaaactacagcacaactcaaaccagacttggtggagacggacgtgcaggaaacaaaagatgggcagtttgtcatgatgcatgatgctaacttgaaaaatctagcaggtatcaataaaagtcctcaagacttaaacttggaggagcttaaagggattgatatttttgaaaatggctaccagactaaaatttcaagctttgaagattatctcagtcgagccaacgaacttggtcaaaaattactaattgaaattaaaaccagtaaaaaagatagtccagacatgatgaaccgctttttagcccgttatgctgcaatgctcaagatttatggacatcaaatccagtctttagactaccatgttgtcgaaaaagtaagacagtatgatgccgaactgccagtttatttcatcatgccctacaattctgtctttcctaaaacaagagcgacaggatatactatggagtactcaaccttggatgaatattttgtaagcaaactatggacaacggatcagaaactttatgtctggactgtcaatgattcagaagctatcagcaaatctcttcacttaggagtagatggagtgattacagatgatttggaaaaagttcagcgggaaatagaagtagcccaagaagatccagaatatacggatttgctcttgaaaaaagcattggaattctttgaattttag

SEQ ID NO: 2555 - DNA, 348 bp, Streptococcus pneumoniae; identical to SEQ ID NO: 2066

SEQ ID NO: 2556 - DNA, 141 bp, Streptococcus pneumoniae
ttggttgcaggtctaacaaatggtgaattaatcgctccaatgacttacgaagagatgatgacgagcgacttttttgaagtatggtttcagaagtttttcttaccaacattaaccacaccatcggttattatagtaaaatga

SEQ ID NO: 2557 - DNA, 201 bp, Streptococcus pneumoniae
gtggtagcaagcgcttcggctagctcaacgagcacacaagctcaagagcaagttgacaagtctgaacttcgtgccttgagtcaagagttagaccaacgcttgaaagctttggcaacaatatctgatccgaaaatcgatgcaaccaaggctgtcctcctagatgctcaaaaagctccggaagatagtgccttgacagagtaa

SEQ ID NO: 2558 - DNA, 633 bp, Streptococcus pneumoniae
atgttttacttgagtttgtcaaggattgctttaagctcctctactagtttagtttctgtctctgctgagccattttcttctttcacgaaatcaagggtttcttggagaaggttttgggctttggcaaggacttttttatccgctttttctgcatctagctgtcctagaaccttgatcaattccgtgcttaattgctggatttctgactctttcttacggcgaatcagccagaaggcaatcacgcctaggagggcaagtagactgaccacaatcactcctgccggaactgagtttgtttcagtcatcttatctgaatccttactatcttccgttccttgttttgcatccttcttgtcctgtgcaggcttgctgtcgctagcatttgctttcacatctttgagagagtccaaggcagcccagccttcacagactctactgcagtatgcagaccttactctgtcaaggcactatcttccggagctttttgagcatctaggaggacagccttggttgcatcgattttcggatcagatattgttgccaaagctttcaagcgttggtctaactcttgactcaaggcacgaagttcagacttgtcaacttgctcttgagcttgtgtgctcgttgagctag

SEQ ID NO: 2559 - DNA, 300 bp, Streptococcus pneumoniae
atgactgaaacaaactcagttccggcaggagtgattgtggtcagtctacttgccctcctaggcgtgattgccttctggctgattcgccgtaagaaagagtcagaaatccagcaattaagcacggaattgatcaaggttctaggacagctagatgcagaaaaagcggataaaaaagtccttgccaaagcccaaaaccttctccaagaaacccttgatttcgtgaaagaagaaaatggctcagcagagacagaaactaaactagtagaggagcttaaagcaatccttgacaaactcaagtaa

SEQ ID NO: 2560 - DNA, 708 bp, Streptococcus pneumoniae
ttggaaacgatagtatttttaatctctgtttttctagcaggtgttttatcctttttttctccttgtatttttcctcttctgccagtctatgctgggattttattggatgatcaagaaagtgcaaaaagcttttctttgtttgggagaaaggttctctggtcaggcttgattcgaacactttgctttatcgctggtatctctctcattttctttattctaggctttggtgctggttactttggtcatattctctatgcaaattggtttcgatatggcatgggagctattattatcattttgggtcttcaccagatggaaatttttcatttgaagaaattagaagttcaaaaaagttttacctttaaaaaatcagattctaatcgttattggtcagcttttttacttggtattacctttagctttggttggacaccttgtattggtccagttttaagttctgttttagcacttgcggcttctggaggcaatggcgcttggcaaggagcgatttatactctcatttacactctgggcatggcccttcctttcttggtattggcactagcttcaggtctagtcatgccatattttagtaaaatcaagcgtcatatgatgctactaaagaaaattggtggtttcctcattgttttaatgggaattttgttactattaggacaagtaaatgttctagctggaatttttgaataa

SEQ ID NO: 2561 - DNA, 558 bp, Streptococcus pneumoniae
atgaaaaaagtaatgtttgctggcttaagtctcttgtcattagttgtattgatggcctgtggtgaggaagaaactaaaaagactcaagcagcacaacagccaaaacaacaaacgactgtacaacaaattgctgttggaaaagatgctccagacttcacattgcaatccatggatggcaaagaagttaagttatctgattttaagggtaaaaaggtttacttgaagttttgggcttcatggtgtggtccatgcaagaaaagtatgccagagttgatggaactagcggcgaaaccagatcgtgatttcgaaattcttactgtcattgcaccaggaattcaaggtgaaaaaactgttgagcaattcccacaatggttccaggaacaaggatataaggatatcccagttctttatgataccaaagcaaccaccttccaagcttatcaaattcgaagcattcctacagaatatttaattgatagccaaggaaagattggaaagattcaatttggtgctatcagtaatgcggatgcagaagcagcatttaaagaaatgaactag

SEQ ID NO: 2562 - DNA, 1392 bp, Streptococcus pneumoniae
atgaatatatttagaacaaagaatgttagtttagataaaacagagatgcataggcatttgaagttatgggatttgattttgctgggtatcggagccatggtagggacaggcgtctttacaatcacaggtactgcagctgcaacacttgctggcccagccctagtgatttcaatcgttatttctgccttgtgtgtgggattatcagccctcttttttgcagaatttgcctcgcgagtacccgctacaggaggtgcctatagttacctctatgctatcttaggagaattccctgcctggttggctggttggttaaccatgatggagttcatgacagccatatcaggcgtagcttcgggttgggcagcttattttaaaggcttgctctctcaatacgggatagcctttcctcaggctttaaatggtacctttaatcctcaagcagggacatttgttgatttattgcctattcttgtcttggtcttggtgacttcgcttgttttactaaatgccaaggcagccttacgctttaattcgattctagttattttgaaattttccgctttagctctctttgttttagtaggaatttggaatattaagtttgataattggagcaattttgctccttacggttttggacaaatctatggagctagcactggtattatggctggtgcgtccttgatgttcttcggttttttgggatttgaatccatctctatggctgtagatgaagtcaagactcctcaaaaaaatattcctagagggattgtcttatcgctttctatcgtaaccattctctatgccttggtgacccttgttttgactggtgtggttcactatagtcatttaaatgtcgatgatgccgttgcctttgcccttcgtagtgttgggattagttgggcagccaactatgtgtcattagtggctatcttgaccttgattacagtttgtatttcgatgacctatgccctatcgcgtatgatttacagtttagcacgtgacggcttagtgcctgctgcctttaaggaactgacgaagactagcaagataccaaagaatgctactatcttgacaggtctagcttcagcagtagcagcaggaatgttcccactagccagtattgcagcctttttaaatatttgtaccttagcctacttgatcatgttggcttatggtctgattcgcttacggaaagaaaaaggaatgcccaaagctggggaatttaaaacaccattggtacctctgttaccaattttatcgatcatcatttgtttatccttcatgttacagtataatatgaatacctggattgctttcctagttgcgttgttagtaggaagtattatttacttcacttatggctataagcattctaccatagaagaataa

SEQ ID NO: 2563 - DNA, 924 bp, Streptococcus pneumoniae
  unsure (608): n at each above location is unknown.
ttgttcatgaagaaacaaaatttatttttagtcctgttaagtgtctttcttttgtgcttgggggcttgtggtcaaaaggaaagtcagacaggaaaggggatgaaaattgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagatacccaaattatcgctgataaactttcagaggtggatagtgagcataaagagacttatcaaaaaaatgcgcaagcctttatcaaaaaagctcaggaattgactaagaaattccaaccaaaatttgaaaaagcgactcagaaaacatntgtaacacaacatacagccttttcttatctagcgaagagatttgggcttaatcaacttggtattgcaggcatctctcctgaacaagaaccaagtccacgacaattaacagaaattcaggaatttgttaaaacctataaggttaaaacgatttttacagaaagtaatgcttcttcaaaagtagctgaaactcttgtcaaatcaacaggtgtgggtcttaaaactctgaatcctttagaggcagacccacaaaatgacaagacctatttagaaaatctggaagaaaatatgagtgttctagcagaagaattaaagtga

SEQ ID NO: 2564 - DNA, 2517 bp, Streptococcus pneumoniae
atgaaaatcaataaaaaatatctagcaggttcagtggcagtccttgccctaagtgtttgttcctatgaacttggtcgtcaccaagctggtcaggttaagaaagagtctaatcgagtttcttatatagatggtgatcaggctggtcaaaaggcagaaaatttgacaccagatgaagtcagtaagagagaggggatcaacgccgaacaaattgttatcaagattacggatcaaggttatgtgacctctcatggagaccattatcattactataatggcaaggttccttatgatgccatcatcagtgaagaacttctcatgaaagatccgaattatcagttgaaggattcagacattgtcaatgaaatcaagggtggctatgtgattaaggtagacggaaaatactatgtttaccttaaagatgcggcccatgcggacaatattcggacaaaagaagagattaaacgtcagaagcaggaacacagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagttcaaccaagattgtcagagaaccacaatctgactgtcactccaacttatcatcaaaatcaaggggaaaacatttcaagccttttacgtgaattgtatgctaaacccttatcagaacgccatgtagaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtctgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggttttggataacctgttggaacgactcaaggatgtctcaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatagtcttgaggatcttttggcgactgtcaagtactatgtcgaacatccaaacgaacgtccgcattcagataatggttttggtaacgctagtgaccatgttcgtaaaaataaggcagaccaagatagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctcaagtagagaattctgttattaacgctaagatagcagatgcggaggccttgctagaaaaagtaacagatcctagtattagacaaaatgctatggagacattgactggtctaaaaagtagtcttcttctcggaacgaaagataataacactatttcagcagaagtagatagtctcttggctttgttaaaagaaagtcaaccggctcctatacagtag

SEQ ID NO: 2565 - DNA, 3120 bp, Streptococcus pneumoniae
atgaaatttagtaaaaaatatatagcagctggatcagctgttatcgtatccttgagtctatgtgcctatgcactaaaccagcatcgttcgcaggaaaataaggacaataatcgtgtctcttatgtggatggcagccagtcaagtcagaaaagtgaaaacttgacaccagaccaggttagccagaaagaaggaattcaggctgagcaaattgtaatcaaaattacagatcagggctatgtaacgtcacacggtgaccactatcattactataatgggaaagttccttatgatgccctctttagtgaagaactcttgatgaaggatccaaactatcaacttaaagacgctgatattgtcaatgaagtcaagggtggttatatcatcaaggtcgatggaaaatattatgtctacctgaaagatgcagctcatgctgataatgttcgaactaaagatgaaatcaatcgtcaaaaacaagaacatgtcaaagataatgagaaggttaactctaatgttgctgtagcaaggtctcagggacgatatacgacaaatgatggttatgtctttaatccagctgatattatcgaagatacgggtaatgcttatatcgttcctcatggaggtcactatcactacattcccaaaagcgatttatctgctagtgaattagcagcagctaaagcacatctggctggaaaaaatatgcaaccgagtcagttaagctattcttcaacagctagtgacaataacacgcaatctgtagcaaaaggatcaactagcaagccagcaaataaatctgaaaatctccagagtcttttgaaggaactctatgattcacctagcgcccaacgttacagtgaatcagatggcctggtctttgaccctgctaagattatcagtcgtacaccaaatggagttgcgattccgcatggcgaccattaccactttattccttacagcaagctttctgctttagaagaaaagattgccagaatggtgcctatcagtggaactggttctacagtttctacaaatgcaaaacctaatgaagtagtgtctagtctaggcagtctttcaagcaatccttcttctttaacgacaagtaaggagctctcttcagcatctgatggttatatttttaatccaaaagatatcgttgaagaaacggctacagcttatattgtaagacatggtgatcatttccattacattccaaaatcaaatcaaattgggcaaccgactcttccaaacaatagtctagcaacaccttctccatctcttccaatcaatccaggaacttcacatgagaaacatgaagaagatggatacggatttgatgctaatcgtattatcgctgaagatgaatcaggttttgtcatgagtcacggagaccacaatcattatttcttcaagaaggacttgacagaagagcaaattaaggctgcgcaaaaacatttagaggaagttaaaactagtcataatggattagattctttgtcatctcatgaacaggattatccaggtaatgccaaagaaatgaaagatttagataaaaaaatcgaagaaaaaattgctggcattatgaaacaatatggtgtcaaacgtgaaagtattgtcgtgaataaagaaaaaaatgcgattatttatccgcatggagatcaccatcatgcagatccgattgatgaacataaaccggttggaattggtcattctcacagtaactatgaactgtttaaacccgaagaaggagttgctaaaaaagaagggaataaagtttatactggagaagaattaacgaatgttgttaatttgttaaaaaatagtacgtttaataatcaaaactttactctagccaatggtcaaaaacgcgtttcttttagttttccgcctgaattggagaaaaaattaggtatcaatatgctagtaaaattaataacaccagatggaaaagtattggagaaagtatctggtaaagtatttggagaaggagtagggaatattgcaaactttgaattagatcaaccttatttaccaggacaaacatttaagtatactatcgcttcaaaagattatccagaagtaagttatgatggtacatttacagttccaacctctttagcttacaaaatggccagtcaaacgattttctatcctttccatgcaggggatacttatttaagagtgaaccctcaatttgcagtgcctaaaggaactgatgctttagtcagagtgtttgatgaatttcatggaaatgcttatttagaaaataactataaagttggtgaaatcaaattaccgattccgaaattaaaccaaggaacaaccagaacggccggaaataaaattcctgtaaccttcatggcaaatgcttatttggacaatcaatcgacttatattgtggaagtacctatcttggaaaaagaaaatcaaactgataaaccaagtattctaccacaatttaaaaggaataaagcacaagaaaactcaaaacttgatgaaaaggtagaagaaccaaagactagtgagaaggtagaaaaagaaaaactttctgaaactgggaatagtactagtaattcaacgttagaagaagttcctacagtggatcctgtacaagaaaaagtagcaaaatttgctgaaagttatgggatgaagctagaaaatgtcttgtttaatatggacggaacaattgaattatatttaccatcaggagaagtcattaaaaagaatatggcagattttacaggagaagcacctcaaggaaatggtgaaaataaaccatctgaaaatggaaaagtatctactggaacagttgagaaccaaccaacagaaaataaaccagcagattctttaccagaggcaccaaacgaaaaacctgtaaaaccagaaaactcaacggataatggaatgttgaatccagaagggaatgtggggagtgaccctatgttagatccagcattagaggaagctccagcagtagatcctgtacaagaaaaattagaaaaatttacagctagttacggattaggcttagatagtgttatattcaatatggatggaacgattgaattaagattgccaagtggagaagtgataaaaaagaatttatctgatttcatagcgtaa

SEQ ID NO: 2566 - DNA, 189 bp, Streptococcus pneumoniae
aattctcccaaagtcagagttttatttctaacttttgagagaacttcatttttgattcagactttttctactgctattccttacgctatgaaatcagataaattcttttttatcacttctccacttggcaatcttaattcaatcgttccatccatattgaatataacactatctaagcctaatccgtaa

SEQ ID NO: 2567 - DNA, 189 bp, Streptococcus pneumoniae
gttagtcaaaaagaaggaattcaagcaaaacaaattgttattaagattacagatcaaggttatgtaacttctcatggcgatcattatcgctactataatggtaaagttccttttgatgcgctctttagtgaagagctattaatgaaagcccccaactatcagccgaaagatcaagatatcgtcagttag

SEQ ID NO: 2568 - DNA, 201 bp, Streptococcus pneumoniae
gttaagggaggatatattattaaggtagatggaaagtattatgtttaccttaaagatcaagctcatgcagaaaatgtacgaacaaaagatgaaatcaatcgccaaaaacaagaacatggtaaagacgataaaggagctagtgcagaagtatctgtagcaaaattacagggacgttatactaccgatgatggttatatatag

SEQ ID NO: 2569 - DNA, 483 bp, Streptococcus pneumoniae
ttgtcggtgacaccgaataatggtgtttctgcagcagatgatggttatgtctttaaccctaatgatattgtcagagatacaggtgatgcttatatagtaagacacggggatcactatcattatattcctaagtcatctcttaacaatcccccatcacactctaacacggaagaggcaggaagttcttctagttctgtattaagtaatccgtcactacatgtccaccatgaggaagaagatggtcatggttttgatgccaatcgaattataagtgaagattcagaaggttttgtgattcctcatggcgaccacaatcactacatcaaggttcaaactaagggatatgaagcggctttgaaaaacaagattccatccctgcaatccaactatcaacctggaacttttgatgagaaggcagtcttggcaaaagtagatcaacttctagctgatagcagaagcatctacaaagacagattgagttag

SEQ ID NO: 2570 - DNA, 240 bp, Streptococcus pneumoniae
ttgtctgattccttcttcatggatttgttccaagagttgatttgccttgctcaaaagactttctacttcttccttgctatctgtcgcagattattggttgctatctaccatgtactcctaaaacaggagagttataatccaagattacaaggccttacagaaataagaaatccagataagacaatgttcgtccaagacgctattcgcttcgcacaacagcacggattcaatatgctttaa

SEQ ID NO: 2571 - DNA, 258 bp, Streptococcus pneumoniae
ttgagcaaggcaaatcaactcttggaacaaatccatgaagaaggaatcagacaatccttggcagaagaagtagaaaatctaaaagctgccacaaacaaggttgatgcagacttggatgaagtaaacagtcaggtaaaagatgttttgactcgtatcgctagcgcccttcaacaagaaaaggaaaatgctgagcaagattctcagacacttgtactctatcaaaaactctacgatattctcatgtcgcttagaaagtaa

SEQ ID NO: 2572 - DNA, 435 bp, Streptococcus pneumoniae
atgctgagcaagattctcagacacttgtactctatcaaaaactctacgatattctcatgtcgcttagaaagtaataatggatctgatgcggactttgataaggtggatgcattattagatcaactttctgctaatagtaaagacaaaacagctttacttgaatcgacaaaagctattctagttttgaatcatcaaatccagtcaaaagctagcgcaagtgaagaaacaagtccagcaagaaatgctgaagcaaatggtgataacaccagtgctgagaaccaaccaaacgcaactgcagaatctaacattgaaactgctagcgacgaaaacaaaccaagcaatacaagagattctaaacctgctgaatcaacttcagaaaataaaacaacagaatcttctacaactactggaaatcaagaaaaaccagtagaataa

SEQ ID NO: 2573 - DNA, 1224 bp, Streptococcus pneumoniae
atgacttatccaaatctcttggaccgcttcttaacctatgttaaggtcaacacgcgctctgatgaacactctactactactccaagtacacagagtcaggttgacttcgcaacaaatgtcctaattcctgaaatgaaacgtgttggactgcaaaatgtttactatctaccgaatggttttgctattggaaccttgccagccaacgatccgtctttaacacgtaagattggttttatatcgcacatggatactgctgattttaatgctgaaggagtcaatccacaggtaattgaaaactacgatggtggtgtgattgaactagggaattctggtttcaaactcgatccagctgacttcaagagtcttgaaaaatatccaggacaaacgctcatcacaacagatggaacaaccttgctaggtgctgatgacaagtcaggaattgctgaaattatgacagccattgaatatctaactgctcatcctgaaattaagcactgtgagattcgtgttggttttggtccagatgaagaaatcggtgttggtgccaataaatttgatgcagaagattttgatgtggattttgcctacactgttgatggtggtccactaggtgaacttcagtacgagactttctcagccgctggtgctgaattgcatttccaaggccgtaatgtccaccctggtactgccaaagggcagatggtcaatgcccttcagctagcaattgattttcataatcaacttccagaaaatgaccgacctgagttaactgaaggttaccaaggtttttaccatctaatggatgtgacaggtagtgttgaggaggcgcgtgcaagctacatcattcgtgattttgaaaaagatgcctttgaagcgcgtaaagcatccatgcaatctatcgctgataagatgaatgaagaacttgggagcaaccgtgtcactctcaacttgacagaccagtactacaatatgaaagaagtcattgaaaaagatatgactccaattaccgttgctaaagccgttatggaagatctaggtatcacgcctattatcgaaccaatccggggtggaacagacggctctaagatttcctttatgggaatcccaactccgaatatctttgcaggtggcgaaaatatgcacggacgttttgaatacgttagccttcagactatggaacgtgcagttgataccatcattggcatcgtagcttataaaggctaa

SEQ ID NO: 2574 - DNA, 1095 bp, Streptococcus pneumoniae
atgaaaaaagcaattttaatgatgaccttcggttcaccagaagagattacctttgaaggtgtagctgattttttcacaaatattcgtcgtggggtgagaccccaagaccacgagattcagactctctatgataattatgtacgaattggaggcacgcctctgcaaaaaattacccgtcaagaggttgccttggtagaagctaggctggggaatgaatacagtgtctactttgctaataagttttccagtccctttattccagatgtgatcggtcaaatggaagcagacggaattgaacagtgtatttgcttgattttggagccccattattctttctactctgtcatgggctatgaaaaatttttagaaagcaaacaaattcaatttttggtcattaaggactggtatcaggaagaagcgctcttaaactattgggtagatgaaattgctaagattttaaaagaagaagttaagcaagacagctgtaaagtcatcttttcagcccatagtgtgcccatttttgccttggactttggtgatccttatatagaccaaattttcgaaaatagcaagctagtcgctgaaaaactgggcttgagttcagaacaatataccaacacttggcagagtgagagtgatattggtattccatggattaaaccagatgttttggagtatctcagagaacagacagaacatccagaccattatatttttgtacctattagtttcatcagtgagcatattgaggtcttgtttgacaatgatgtagaatgttatgacttatgccaggaatttggggtaaactaccatcgtccaccaatgccaaatacagattctcgtttgattgatgctttggtcaatacagttagagtcaatgaaaatcaagagtttaaggaatttctcccagaagaagagacctttgatgagttagttccttcagacgagacgaaaaacattttagctgaatctgaagatttacaaatgccagaatttgtgaaaaaactgattgagaaaaaagggcgggagaatgttaagatgccttatcttatcaaaaaaatgcttgaaaaagcaggcaagttacccaaagagtaa

SEQ ID NO: 2575 - DNA, 378 bp, Streptococcus pneumoniae
atgttaaaaaatctaaaatcgttcttgcttcgaggaaatgttattgaccttgctgtcggtgttgtaattgcctctgcttttggtgctatcgttacttcacttgtaaacgacattatcactcctcttattttaaatcccgctttgaaagctgctaaagttgaacgtatcgctcaactttcttggcatggagtcggctatggtaacttcttaagtgctattatcaattttatctttgtgggtaccgccctcttctttattatcaagggcattgaaaaagcacagaaactgactggcataaagaaagaaaaaactgccgaaaaaaaaccaaccgaattggaagtccttcaagaaataaaagctctccttgagaaaaaataa

SEQ ID NO: 2576 - DNA, 261 bp, Streptococcus pneumoniae
tcccaaattgatccggttgtatttaagccaaaaaaagaaaatagctttatccgtttaaggaaaattttttcttgctggcctttctacttttctgttagactggtttttaacttttttcttgtaacccaatttcctcacattatagggcaattcgtaactgaaaacattgataagataaaggctattgaaacaataattgcacaaatattcattattatcatcaattatatcttgagcaaggcctatatttttagaaaataa

SEQ ID NO: 2577 - DNA, 384 bp, Streptococcus pneumoniae
atgatgagtcaaaagattattgggattgaccttggtggaacttctatcaaatttgcaatcttaacaacagcaggagaaatccaaggaaaatggtcaatcaagaccaacattttggatgagggaagtcatatcgttgatgatatgattgagtctattcaacatcgtttggacttgcttggattggcagcagcggacttccaaggcattggaatgggatcaccaggtgtggttgaccgtgacaaagggactgttatcggtgcctacaacttgaactggaaaacccttcaaccaatcaaacaaaagattgaaaaagctttgggcattccatttttcatcgataatgatgccaacgtagcagctcttggtgagcgctggatgggtgct

SEQ ID NO: 2578 - DNA, 264 bp, Streptococcus pneumoniae
atggtaaaatggctgtcaatgaatgggttgatggtggacgttattatgttggcgctgacggagtttggaaggaaggtcaagcaagtacagtttcttctagtaatgatagcaatagtgaatatttctgctgctttaggaaaggcaaaaagttataattcgttattccacatgtcaaaaaaacgtatgtatagacaattaacttctgattttgataaattttcaaatgatgcagctcaatatgccattgatcatttagataattaa

SEQ ID NO: 2579 - DNA, 819 bp, Streptococcus pneumoniae
ttgtcaacgattgataaatcaggagttcttcctttttcagcgcaaacggtgcaggctgacatacaaacgcttaccccaatggcaaaatattatattattcttccgaaggatgcagaaatatataaaacttggagaggtactgtcaatattcccattattgatgctacaaaaactactccagaattatcttatttcaaagaagatcatcgcaactatatagctaatgagaataagtctggtgccaattacatagagtggaagggaacagtagaagagtttaaagaggccattaagaagttgactgataaaaaatcaactactgcaacaccaaaaaaggatgaaaagccaacaccaaaaccggatgagaagccaaaaccaacacctacagttcagtctggttgggtaggttcatcctattatcaagatggtaaaaaagtcattagtaagtggatttttgataaaaaatataattcatacttctatctagatgcatcaggaaattatgttcaaaacgcttgggtaggtaactattatcttaaatcaggcggatacatggctaaaggtgaatgggtttatgatgccacctatcaagcttggtattatttgacatcagatggttcttatgcttacagtacatggcaaggaaattactatctaaaatcggatggtaaaatggctgtcaatgaatgggttgatggtggacgttattatgttggcgctgacggagtttggaaggaaggtcaagcaagtacagtttcttctagtaatgatagcaatagtgaatatttctgctgctttaggaaaggcaaaaagttataa

SEQ ID NO: 2580 - DNA, 1530 bp, Streptococcus pneumoniae
ttgatgaaatcaaaaatagttttgggagcttcgctagcgatcgcaacacttagcttagtatctcttgtcgagattgaaggactctcaccgtttttaatagagaatgttagcgcaaatactcattctgcaaataaagttattaatcataaagtaagtatttacttagaaaatgctgatgaaggtaaaggtctaactgtaaacttttcaacagacagtgttagtccaaatttatttgatgagttcgaaaaaaagagtggaattacaataactactatgttagtgaatgctaagacaggtgaagttgtagaaaaaagattaacaccaagcgtttttttacgttccaatgatttaaccagtgggaccatatcttcgtttatttttagtgaatatcctgatggagaatataaatatgttgtgtctaaaggagactttatcgatcctaagactcagtttaaacatcagtatagaggagaatctccagtttttagaatacgtaatcgaaaatatgtggagttgggaacaactgataaaaaattagatgaaagacgtgataatagcgtttataaagatggggttgttgaacacaaggtaaatttaagtttaacaagttatcaaggaggtaatggagttactgcaattttttcaactgatagtgttaactctaacttacttaattcttttggtgaaaaggctaaaaaagttttgattaggtctaagttaattaatgttaagactggcgaggttattgatgaaacgttttctccaaaagtaagtttaacctctaaaattttgaaaagtggttctacagcagtattttattttatagatttaactgatggcgaatataaatatgttgcgtatgaaagccagcaatatactgatcctcaaacaacattgactcatcagtatagaggagaatctcctatttttagtatcaaagatggaaaattttctggtttagtatctgcctcaaaaccagacgaaaacccgaagccaacgccaaaaccggatgagaaaccaaaaccttcagcaccacaacaggagaaaccaaaacctacagttcagtctggttgggtaggttcatcttattatcaaaatggtaaaaaagtcactagtaagtggatttttgataaaaaatataattcatacttctatctagatgcatcaggaaattatgttcaaaacgcttgggtaggtaactattatctcaaatcaggcggatacatggctaaaagtgagtggatttatgataagaactatggttcatactactatctaacatcagaaggcagctacgctcgtaacacttggtcaggcaattattatttgaagtcaaatggtaagatggctaaaagtgagtgggtatacgatagtaactacaaatcatattactacttgacatcagaaggaagttatgctcgtaacacttgggtaggcaattactatcttaaatcaaacggtaaaatggctgttaatgaacgtacaccagatggttatcgtgtagatggttcaggtaaatgggttaaataa

SEQ ID NO: 2581 - DNA, 1722 bp, Streptococcus pneumoniae
atgcatagaaaaacagtgattgattttaggactttgggggagagatatacctttaccaagcctattaaagagttgaaaacgagaaatgtagaagaagtggcagatttgctggcacaagtggaaagctaccaagagcaaggttattatgtggtggggtatgtcagctacgaggctgcacctgcttttgaggaaaaattagcagttcacaaggatcccctactgggagagtacctgctttattttactgttcatgatagcgtagaaacttcctctattcctctgacttatgaggatattgatttgccctcaaattggcaggaagtaacgtctgcagcagactatgaaaaggccattgcccaaattcaccatcatttacggcagggagatacctatcaggtcaactacaccgtccaacttaagcaaaagttaaatgccaatccttttgccatctacaatcgtatggtggtagagcaggaggcgggctacaatgcctatgtggaacatgacgagatggcagtgatttccatgagcccagagctcttttttgagcaaaatgatcgcgagttgacaacacgaccaatgaaggggacgactcagcgtggggtaactgaccaagaagatcttgaacaggccagttggttggaacaggatcccaaaaatcgctctgaaaatatgatgattgtggacctcttgcgcaatgatatgaaccgtatttctgaagttgggagcgagcacgtggagcgtctgtgtcaggtagagcagtattcaactgtttggcagatgacttcgaccatcaagagtcagttgcgagaggatgtggaccttgttgaaatcttccgctcactctttccttgtggttccataacgggtgcaccgaaaattgcgacaatggagattatcaaggacttggagcctcaaccgcgtggagtctactgtggaacgattggtctcttgcttccaaatggacgacggatttttaatgtggccattcgtaccattcaacttcacaaaggtcaagccatttatggagttggcggagggattacttgggatagcacatgggaatctgaataccgagaggttcatcaaaaggcagcagttctttatcgtaaacaagctcgcttccaactgattacgacaggggaaatcagccagaagaacctgttgtttgaagatcaacatctggaaagactgagaaaagctagtcgttattttgcctttccttttgatgcagaagacttgggacacaagattgaggaagagtgtcaggattgtgaagctaatcgagattaccgcttgcgaatcagccttagcaaatctggagagatagaagtcaatcgtcaagtattaacccctctcagtacaagcttttgtcaggcccaagtctgccttcaggaagctgctttgaatcaatcctttacctactttaaaaccactcaccgaccgcatttgagcctaggagaacaagagaagatttaccacaataagtcaggagaactgcttgaaacctctataggaaatttggttctgaaaatcgctggaaaactctacacaccgcctatccgacttggaatcttgccaggaatttaccgtcagtatttgctagaaacaggacaggtagaagagaaagtcttgaccttggcagatttagcccaagcagaagctatttacggctgtaatgcagtgagaggcttgtatgagttgcaagtgataggattgtga

SEQ ID NO: 2582 - DNA, 5892 bp, Streptococcus pneumoniae
gtgtttaaaaaagaccgtttttcaattcgtaagattaagggagttgtaggctctgtatttcttggaagccttttgatggctccttctgtagtggacgcagccacctatcactatgtaaataaagagattatttcacaagaagctaaagatttaattcagacaggaaagcctgacaggaatgaagttgtatatggtttggtgtatcaaaaagatcagttgcctcaaacagggacagaagcatctgttttgacagcttttggtttgctgactgttgggagcttgcttttaatctacaagagaaagaaaattgctagcgtctttctagttggagctatgggattggtagttcttcctagtgcaggggctgtagacccagttgcgaccctagcgctggctagtcgagagggtgttgttgaaatggagggctatcgctatgttggttatctatcaggtgacatcctcaaaacgcttggcttggacactgttttagaagaaacctcagcaaaacctggagaggtgactgtagtcgaagttgagactcctcaatcaacaacaaatcaggagcaagctaggacagaaaaccaagtagtagagacagaggaagcacctaaaacagaagaaagtccaaaggaagaaccaaaatcggagataaaacctactgacgacacccttcctaaagtagaagaggggaaagaagattcagcagaaccagctccagttgaagaagtaggtggagaagttgagtcaaaaccagaggaaaaagtagcagttaagccagaaagtcaaccatcagacaaaccagctgaggaatcaaaagttgaaccaccagtagaacaagcaaaaggcccagaacaacccgtgcaacctacacaagctgagcaaccaaggataccaaaagattcatcacaaccagaagatcctaaagaagataggggagcggaagatacaccgaaacaagaagatacacagccagaagtagtagaaacaaaagatgaggctgctaatcaacctgttgaagaaccaaaagttgaaacgcctgctgtagaaaaacaaacggaaccaaaagttgaacaagtaggtgaaccagtcgagccaagtgaagacgaaaaggcaccagtctctccagaaaagcaaccagaagctcctgaagagaaggctgtagaggaaacaccgaaaccagaagataaaataaagggtattggtactaaagaaccagttgataaaagtgagttaaataatcaaattgataaagctagttcagtttctcctactgattattctacagcaagttacaatgctcttggacctgttttagaaactgcaaaaggtgtctatgcttcagagcctgtaaaacagcctgaggtaaatagcgagacaaataaacttaaaacggctattgacgctctaaacgttgataaaagtgaattacaggaacaattaagagttgctgaacaaaaacaacaagctgactatagcgctaaaacttggagggaattcaaaattgctgaacttcaagctaaagaaatcaacaaccaaactacaccacttcctaaacaaagtgaaatagatgcagctactaaggctcttcaagacgctcttcaagctcttgctgtagataaaactgtattacaaaacgctattaacacagctaatagcaaacgtgaagaagagtatactgctcagacatggaaagcgttagaagatgctcttacagcagtgaatcctgttaatgaagatgaaactgcaactcaaagcaaagtagacgaagctactagaaacttagaagaagctatcaataacctagttctattaactgaaaaaccggtattaacatttattgagactgataagaaagcattagaacgtgaagtagttgctaagtattctctagaaaaccaaaataaaacaaaaattaaatcaatcacagctactctgaaaaaaggagaaacagttgttagcactgtagagcttataggcgatgatgtaactaatgaaactataacctctgcatttaagaatctagagtactacaaagaatacaccctatctacaactatggtttacgatagaggtgacggtgatgtaacagaaatcttagataatcaaccaatccaactagatcttaaaaaagttgagcttaaaaatattaaacgtacagatttaatcaaatacgaaaatggaaaagaaactaatgaatcactaataacaactgttcctgatgataagcggaattattatttaaaaataacttcaaagaatcaaaaaactacattactagctgttaaaaatatagaagaaactacggttaacggaacacctgtatataaagttacagcaatcgcagacaatttagtctctagaactgctgataataaatttgaagaagaatacgttcactatattgaaaaacctaaagtccacgaagataatgtatattataacttcaaagaattagtggaggctattcaaaacgatccttcaaaagaatatcgtctgggacaatcaatgagcgctagaaatgttgttcctaatggaaaatcatatatcactaaagaatttacaggaaaacttttaagttctgaaggaaaacaatttgctatcactgagttggaacatccattatttaatgtgataacaaacgcaacgataaataatgtgaattttgaaaatgtagagatagaacgttctggtcaagataatattgcatcattagccaatactatgaaaggttcttcagttattacaaatgtcaaaattacaggcacactttcaggtcgtaataatgttgctggatttgtaaataatatgaatgatggaactcgtattgaaaatgttgctttctttggcaaactacactctacaagtggaaatggctctcatacagggggaattgcaggtacaaactatagaggaattgttagaaaagcatatgttgatgctactattacaggaaacaaaacacgcgccagcttgttagttcctaaagtagattatggattaactctagaccatcttattggtacaaaagctctcctaactgagtcggttgtaaaaggtaaaatagatgtttcaaatccagtagaagttggagcaatagcaagtaagacttggcctgtaggtacggtaagtaattctgtcagctatgctaagattatccgtggagaggagttattcggctctaacgacgttgatgattctgattatgctagtgctcatataaaagatttatatgcggtagagggatattcgtcaggtaatagatcatttaggaaatctaaaacatttactaaattaactaaagaacaagctgatgctaaagttactactttcaatattactgctgataaattagaaagtgatctatctcctcttgcaaaacttaatgaagaaaaagcctattctagtattcaagattataacgctgaatataaccaagcctataaaaatcttgaaaaattaataccattctacaataaagattatattgtatatcaaggtaataaattaaataaagaacaccatctaaatactaaagaagttctttctgttaccgcgatgaacaacaatgagtttatcacaaacctagatgaagctaataaaattattgttcactatgcggacggtacaaaagattactttaacttgtcttctagcagtgaaggtttaagtaatgtaaaagaatatactataactgacttaggaattaaatatacacctaatatcgttcaaaaagataacactactcttgttaatgatataaaatctattttagaatcagtagagcttcagtctcaaacgatgtatcagcatctaaatcgattaggtgactatagagttaatgcaatcaaagatttatatttagaagaaagcttcacagatgttaaagaaaacttaacaaacctaatcacaaaattagttcaaaacgaagaacatcaactaaatgattctccagctgctcgtcaaatgattcgtgataaagtcgagaaaaacaaagcagctttattactaggtttaacttacctaaatcgttactatggagttaaatttggtgatgttaatattaaagaattaatgctattcaaaccagatttctatggtgaaaaagttagcgtattagacagattaattgaaatcggttctaaagagaacaacattaaaggttcacgtacattcgacgcattcggtcaagtattggctaaatatactaaatcaggtaatttagatgcatttttaaattataatagacaattgttcacaaatatagacaatatgaacgattggtttattgatgctacagaagaccatgtctacatcgcagaacgcgcttctgaggtcgaagaaattaaaaattctaaacatcgtgcattcgataatttaaaacgaagtcaccttagaaatactatactcccactactgaatattgataaagcacatctttatttaatttcaaattataatgcaattgcctttggtagtgcagagcgattaggtaaaaaatcattagaagatattaaagatatcgttaacaaagctgcagatggttatagaaactattatgatttctggtatcgtctagcgtctgataacgttaaacaacgactactaagagatgctgttattcctatttgggaaggttataacgctcctggtggatgggttgaaaaatatggccgctataataccgacaaagtatatactcctcttagagaattctttggtcctatggataagtattataattataatggaacaggagcttatgctgctatatatcctaactctgatgatattagaactgatgtaaaatatgttcatttagaaatggttggtgaatacggtatttcagtttacacacatgaaacaacacacgtcaacgaccgtgcgatttacttaggtggctttggacaccgtgaaggtactgatgctgaagcatatgctcagggtatgctacaaactcctgttactggtagtggatttgatgagtttggttctttaggtattaatatggtatttaaacgcaaaaatgatgggaatcagtggtatattacagatccaaaaactctaaaaacacgagaagatattaatagatatatgaagggttataatgacactttaactcttcttgatgaaattgaggctgaatctgtgatttctcaacaaaataaagatttaaatagtgcatggttcaaaaaaatagatagagaataccgtgataacaataaattaaatcaatgggataaaattcgaaatctaagtcaagaagagaaaaatgaattaaatattcaatctgttaatgatttagttgatcaacaattaatgactaatcgcaatccaggtaatggtatctataaacccgaagcaattagctataacgatcaatcaccttatgtaggtgttagaatgatgaccggtatctacggaggtaatactagtaaaggtgctcctggagctgtttcattcaaacataatgcttttagattatggggttactacggatacgaaaatgggttcttaggttatgcttcaaataaatataaacaacaatctaaaacagatggtgagtctgttctaagtgatgaatatattatcaagaaaatatctaacaatacatttaatactattgaagaatttaaaaaagcttacttcaaagaagttaaagataaagcaacgaaaggattaacaacattcgaagtaaatggttcttccgtttcatcatacgatgatttactgacattgtttaaagaagctgttaaaaaagatgccgaaactcttaaacaagaagcaaacggtaataaaacagtatctatgaataatacagttaaattaaaagaagctgtttataagaaacttcttcaacaaacagatagctttaaaacttcaatctttaaataa

SEQ ID NO: 2583 - DNA, 234 bp, Streptococcus pneumoniae
ttatttaactcacttttatcaactggttctttagtaccaataccctttattttatcttctggtttcggtgtttcctctacagccttctcttcaggagcttctggttgcttttctggagagactggtgccttttcgtcttcacttggctcgactggttcacctacttgttcaacttttggttccgtttgtttttctacagcaggcgtttcaacttttggttcttcaacaggttga

SEQ ID NO: 2584 - DNA, 324 bp, Streptococcus pneumoniae
acttttatcaactggttctttagtaccaataccctttattttatcttctggtttcggtgtttcctctacagccttctcttcaggagcttctggttgcttttctggagagactggtgccttttcgtcttcacttggctcgactggttcacctacttgttcaacttttggttccgtttgtttttctacagcaggcgtttcaacttttggttcttcaacaggttgattagcagcctcatcttttgtttctactacttctggctgtgtatcttcttgtttcggtgtatcttccgctcccctatcttctttaggatcttctggttgtga

SEQ ID NO: 2585 - DNA, 564 bp, Streptococcus pneumoniae
atgaacgagacacagattcaaagagaaacacgtcaggtagtggaagatgttttagaaaagaccaatttgaagcagggggccctttttgttttaggtctatcttctagtgaggtgctaggtggtcagattgggaaagaatccagtcaagagattggtgagctgatagtggagactatcttgggtattctaagtagtagaggtatccatttagcagttcaaggttgtgagcatgtcaatcgggctctcgttgttgaacgtcaggtggcagagcagtttggtctggaaattgtcagtgtccatcctactcttcatgcaggaggttcggggcagttggcagcctttaagtttatgcaggatccagttgaggttgaatttatcaaggctcatgctggattggatatcggagacactgcaattggcatgcatgtcaagcatgttcaggttccgattcgccctattttgagagagattggtcatgcccatgtaacggcactggctagtcgtccaaaattaatcggaggtgcgcgtgcgcactatccgcaagacgctattagaaagtcttga

SEQ ID NO: 2586 - DNA, 1134 bp, Streptococcus pneumoniae
aactctggaagcctatctcaatcaactccagttggggcagcaggctttgccttcattatcaatgaaaaccatgaatttgtctaccatcctcaacacacagtttatagttcgtctagcaaaatggaggctatgaaaccctacatcgatacaggtcagggttatactcctggtcacaaatcctacgtcagtcaagagaagattgcaggaactgattggacggtacttggcgtgtcatcattggaaaagttagaccaggttcggagtcagctcttgtggaccttgcttggggccagtgtcacatctcttcttgtctgtctctgcttagtgtggttcagtcttaaacgctggattgctcctttgaaggatttgagagaaaccatgttggaaattgcttctggtgctcaaaatcttcgtgccaaggaagttggtgcctatgaactgagagaagtaactcgccaatttaatgccatgttggatcagattgatcagttgatggtagctattcgtagccaggaagaaacgacccgtcagtaccaacttcaagccctttcgagccagattaatccacatttcctctataacactttggacaccatcatctggatggctgaatttcatgatagtcagcgagtggtgcaggtgaccaagtccttggcaacctatttccgcttggcgctcaatcaaggcaaggacttgatttgtctctctgacgaaatcaatcatgtccgccagtatctctttatccagaaacaacgctatggagataagctggaatacgaaattaatgaaaatgttacctttgataatttagtcttacccaagctggtcctacaaccccttgtagaaaatgctctttaccatggcattaaggaaaaggaaggtcagggccatattaaactttctgtccagaaacaggattcgggattggtcatccgtattgaggatgatggcgttggcttccaagatgctggtgatagtagtcaaagtcaactcaaacgtgggggagttggtcttcaaaatgtcgatcaacggctcaaacttcattttggagccaattaccagatgaagattgattctagaccccaaaaagggacgaaagttgaaatatatataaatagaatagaaactagctaa

SEQ ID NO: 2587 - DNA, 189 bp, Streptococcus pneumoniae
ttgttgatgcaaagggagccaatcttggtgtgcttcgtttggatatttcttcatgaaactctggaagcctatctcaatcaactccagttggggcagcaggctttgccttcattatcaatgaaaaccatgaatttgtctaccatcctcaacacacagtttatagttcgtctagcaaaatggaggctatga

SEQ ID NO: 2588 - DNA, 558 bp, Streptococcus pneumoniae
atgaagcgttcttctcttttagttagaatggttatttccatctttctggtctttctcattctcctagctctggttggaactttctactatcaatcaagttcttcagccattgaggccaccattgagggcaacagccaaacgaccatcagccagactagccactttattcagtcttatatcaaaaaactagaaaccacttcgaccggtttgacccagcagacggatgttctggcctatgctgagaatcccagtcaagacaaggtcgagggaatccgagatttgtttttgaccatcttgaagtcagataaggacttgaaaactgttgtgctggtgaccaaatctggtcaggtcatttctacagatgacagtgtgcagatgaaaacttcctctgatatgatggctgaggattggtaccaaaaggccattcatcagggagctatgcctgttttgactccagctcgtaaatcagatagtcagtgggtcatttctgtcactcaagaacttgttgatgcaaagggagccaatcttggtgtgcttcgtttggatatttcttcatga

SEQ ID NO: 2589 - DNA, 738 bp, Streptococcus pneumoniae
atgacctacacaatcttaatcgtagaagatgaatatctggtaagacaaggtttgactaaactggtcaatgtagcagcctacgatatggaaatcattggtcaggctgaaaatggaaggcaggcttgggaattgatccaaaagcaggtgccagatatcattttaaccgatatcaacatgcctcatctaaatggcatccagttggccagtctggtacgagaaacctatcctcaggttcatttggtctttttaacaggttacgatgattttgattatgccttgtctgctgtcaaactaggtgtggacgactacctgctcaaacccttttctcgtcaggatattgaggaaatgttggggaaaatcaaacaaaaactagacaaggaagagaaagaagagcagttacaagatttattgactaataggtttgaaggaaacatggcccagaaaatccagtctcatctggctgatagccaatttagtttaaagtctttagccagtgacttaggttttagtccgacctatctgagttccttgattaagaaagagttgggcttgccttttcaggattatctggtgagagaacgtgttaaacaagccaagctcttgcttttaactacagatctgaagatttatgagatcgcagagaaggttggttttgaagatatgaactattttacccaacgttttaagcagattgcaggtgtgacacctcgtcagtttaagaagggagaagaccgatga

SEQ ID NO: 2590 - DNA, 1113 bp, Streptococcus pneumoniae
atgaatgataagttaaaaatcttcttgttgctaggagtattttttctagccataaccggtttctatgttctattgatacgaaatgcagggcagacagatgcctcgcaaattgaaaaggcggcagttagccaaggaggaaaagcagtgaaaaaaacagaaattagtaaagacgcagacttgcacgaaatttatctagctggaggttgtttctggggagtggaggaatatttctcacgcgttcccggggtgacggatgccgtttcaggctatgcaaatggtagaggagaaacaaccaagtacgaattgattaaccaaacaggtcatgcagaaaccgtccatgtcacctatgatgccaagcaaatttctctcaaggaaatcctgcttcactatttccgcattatcaatccaaccagcaaaaataaacaaggaaatgatgtggggacccagtaccgtactggtgtttattacacagatgacaaggatttggaagtgattaaccaagtctttgatgaggtggctaagaaatacgatcaacctctagcagttgaaaaggaaaacttgaagacttttgtggtggctgaggattaccatcaagactatctcaagaaaaatccaaatggctactgccatatcaatgttaatcaggcggcctatcctgtcattgatgccagcaaatatccaaaaccaagtgatgaggaattgaaaaagaccctgtcacctgaggagtatgcagttacccaggaaaatcaaacagaacgagctttctcaaaccgttactgggataaatttgaatccggtatctatgtggatatagcaactggggaacctctcttttcatcaaaagacaaatttgagtctggttgtggctggcctagttttacccaacccatcagtccagatgttgtcacctacaaggaagataagtcctacaatatgacgcgtatggaagtgcggagccgagtaggagattctcaccttgggcatgtctttacggatggtccacaggacaagggcggcttacgttactgtatcaatagcctctctatccgctttattcccaaagaccaaatggaagaaaaaggctacgcttatttactagattatgttgattaa

SEQ ID NO: 2591 - DNA, 594 bp, Streptococcus pneumoniae
ttgaataaaatggaaaggaatatcaatatgaaaaaatggcaaacatgtgttcttggagcaggttcgctcctttgtttgacggcttgttcaggcaagtccgtgactagtgaacaccaaacgaaagatgaaatgaagacggagcagacagctagtaaaacaagcgcagctaaagggaaagaggtggctgattttgaattgatgggagtagatggcaagacctaccgtttatctgattacaagggcaagaaagtctatctcaaattctgggcttcttggtgttccatctgtctggctagtcttccagatacggatgagattgctaaagaagctggtgatgactatgtggtcttgacagtagtgtcaccaggacataagggagagcaatctgaagcggactttaagaattggtataagggattggattataaaaatctcccagtcctagttgacccatcaggcaaacttttggaaacttatggtgtccgttcttacccaacccaagcctttatagacaaagaaggcaagctggtcaaaacacatccaggattcatggaaaaagatgcaattttgcaaactttgaaggaattagcctag

SEQ ID NO: 2592 - DNA, 711 bp, Streptococcus pneumoniae
  unsure (493): n at each above location is unknown.
atgggtcatattttcttttttctaagtgtctttttggcagggattctatccttcttttctccttgtatcttacctttgttaccggtctatacaggagtgttactagatgataaggatggtgctcaggcttctagcggcaaattttcaatctcagttactagtttattacgaactctggcctttatagcaggaatttcctttatatttattttgttgggctatggagctggttttttaggcgatttgctttatgcttcttggttccaatatcttactggggcaattattatccttcttggtttgcaccaaatggagattctacactttaaggagctttataaggaaaagaggctacaactgcaaggacaggggcaaaatggtaagggctatagtcaggcatttttattgggcttgacctttagttttgcttggacgccttgcgtggggccggttctggggtctgttttggccttggcggcttcaggtggttcangagcttggcagggagctggtctcatgttggtgtatacgctgggcttggcgctaccattcttgcttctagctctgacctctagttatgttttgaaacatttccgaaaacttcatccctatctcggaatcctcaaaaaagtgggtggttttctcattattgtgatgggactcttggttctgtttggaaatgcttcaattttaagtcaattatttgaataa

SEQ ID NO: 2593 - DNA, 861 bp, Streptococcus pneumoniae
atgaaaaagtggtggaaagagctgatagacaagcctttattaaaagcttttttgcattattatcaagcatcagatagtgagttgaccagtgtcgcagtagcctactattggttgatttcgattttccccctgcttttggtggtggtcaatatcctcccctattttcagattcctgtgggagaatttttgggctttatgaaagacgttctgcccccaagcctctatgaaggtgtggaaaaaatagccagagaagttttgacgcaaccttcaacaggtttattgagtttttctgttttatcggcgttatggagtttttcaaaatctatgaatttcttgcaaaaagcttttaacaaggcttatggcgtcgaaaagagtcgtggacttatttcccatcagatgctaagtctcctagtcagttttggcttgcagatcctctttgcgtttgccttgtttttgatcttatttggtcagatgattttggctttacttgctcattattggacaaaagatggcattatctatcaggctttacaagggttggcaggtcctctgatttacgccctcctctttgctatcttggtcatgctttattattttcttcccaatctatctaacaggaaaattagctataccctaccaggcagtgcctttgttctcttagtgattttaggtttactaactctgttctctagttatctcaattactatgtccatcatttggtggatgtccgaattttaggttccgttcttcttgttgttatgatgttttggtttatcttgattgctaaaattgttatcctaggcgcggttatcaatgccagtatgcagagtttgaaagatccggtctttaaaaaagactaa

SEQ ID NO: 2594 - DNA, 2055 bp, Streptococcus pneumoniae
gtggaattactgatttacctcatcctatttttactggttttgattgtctcaagtacaaccaataagctcctgccctttttgcctctccctttggtgcagattcttttaggaattgtgattggtctctttttacccaatactgactttcaccttaatacggagttgtttttggcactggttatcggacccttgcttttccgagaggctgaagaagcagatgttacggctattttaaaacactggcgaatcattgtttatctcatatttccagtgatttttatctcgaccctgagtttgggtggcttggcccatcttctttggttcagccttcccttggcagcttgcttggctgttggtgcagcccttggtcctacggacttggtggcctttgcctctctttcggagcgttttagctttcctaagcgcgtgtccaatattcttaagggcgaaggactcttgaatgatgcttctggtttggtggcttttcaggtagctttgacagcttggacaactggagctttttctctggggcaagctagcagttcgctcatcttttcaatcctaggcggttttttaattggatttttaacagccatgaccaaccgcttcctccataccttcttgctaagtgtgcgcgcaacggatattgccagtgaacttttattagaattgagtttgcctctagtgaccttctttctggcagaagaagtccatgtttcagggattattgccgtcgtagttgctggaattttaaaggcaagtcgcttcaagaaaatcacgctcctcgaagcccaagtggatacggtgaccgagacggtctggcatacagtgacctttatgctcaacggttctgtctttgtgattttagggatggagttggaaatgatagcagaacctatcttgaccaatccaatctataatcctctacttttattgctatctctcatcgcccttacctttgtcctctttgtcattcgttttattatgatctatggctattatgcctatagaacccgacgcctcaagaaaaagctaaataagtatatgaaggacatgtttctcttgaccttttcaggtgttaagggaacggtgtcgattgctacgattctcttgataccaagtaatctagaacaggagtatcctctcttgcttttccttgttgcaggtgtgacgcttgtcagctttttaacaggtctcttggtcttgcctcatctttctgatgaagaggaagaaagcaaggattatctcatgcatatcgccattttgaatgaagtaacgctagagttggaaaaagagttggaagacaccagaaataaacttcccctctatgcggctattgacaattatcatggacgtattgaaaatctcattttaagccaagaaaaccaggatgatcaagaagattgggctgctttgaaactcttgattcttagtattgaaagtgatggtttggagcaggcctatgaagaggggaacattagcaatcgtgtttaccgagtttaccaacgttatctgaaaaatatagaacaaggaatcaatcgtaaacttgcctcaagactgacctattatttccttgtttctttgcggattttacgttttctccttcatgaagtttttactctcggaaagaccttccgtagctggaagaacaaggagcaaagccgtctccgtgctcttgattatgaccaaattgcagagctctatcttgccaatacggagatgattattgaaagtttggaaaacctgaagggagtctacagccgctctttgattagttttatgcaggagtctcgtcttcgagaaacaactattattagcagtggtgcctttgtcgaacgggttatcaatcgtgtcaaacccaacaatatcaatgaaatgctgagaggctattatctggagcgcaagttgattttcgaatacgaagaaaaacgattgattacgactaagtatgccaagaaattacgacaaaatgtaaataacttagagaactattccttgaaggaagctgccaataccctgccgtatgatatggtggaattggtaagaagaaattag

SEQ ID NO: 2595 - DNA, 192 bp, Streptococcus pneumoniae
ttgctcttgaaatggaacggtgccagagaaaaattgagcacaaagactgttccaagattgaccaaaaaatcaaagagcagaaggagatatttgaatcctgttgtaaaaaagattaaggaggacgtgcgtggaattactgatttacctcatcctatttttactggttttgattgtctcaagtacaaccaataa

SEQ ID NO: 2596 - DNA, 255 bp, Streptococcus pneumoniae
atggataaacaatacctacacgaaaagctggatgccatgcgccagaattttgttgaatcaacccaccacgaacgagcggtgggcgtgctagaccaagcgcatatgagcaaaaaaatgcttaaaatcaagaaaaaattagttgctcttgaaatggaacggtgccagagaaaaattgagcacaaagactgttccaagattgaccaaaaaatcaaagagcagaaggagatatttgaatcctgttgtaaaaaagattaa

SEQ ID NO: 2597 - DNA, 189 bp, Streptococcus pneumoniae
gcatttttttgctcatatgcgcttggtctagcacgcccaccgctcgttcgtggtgggttgattcaacaaaattctggcgcatggcatccagcttttcgtgtaggtattgtttatccatgtctgtatctctctaatttttcaatcatcactaaaaacggcgggttgttgacttggtttaaagttcggtaa

SEQ ID NO: 2598 - DNA, 564 bp, Streptococcus pneumoniae
ttgaaaatgaaaagaccacttgagatggcacatgattttttggctgaggtcgtgacaaaagaggatgtcgtagtggatgcgactatgggaaatggtcatgacacgctttttttagccaagctagccaagcaagtctatgcctttgatattcagaagcaagccttggaaaagacccaagagcgtttgcatcaggctgacttgacaaatgcccagttaatcttgcaaggccatgagacactggaccagtttgtgataaaagctaaggcagggatttttaatctgggctatttgccgtcagctgataagtctgtcatcacccgaccgcagacaacgattgaggcattagaaaagctatgtggcttacttgtcaaaggtggacgaattgctattatgatttactatggtcatgaaggaggcgatctcgagagagatgctgtcttggattttgtgatccagttgaaccaacaagagtacacagctgccatttaccgaactttaaaccaagtcaacaacccgccgtttttagtgatgattgaaaaattagagagatacagacatggataa

SEQ ID NO: 2599 - DNA, 447 bp, Streptococcus pneumoniae
gtggaaacggtcaagcgtttgagaaagtatcccaagattgagattgtttcccatttgatcaatggtttgcctggtgaaacccatgagatgatggttgaaaatgtccgccgttgtgtcacgaataacgatattcaagggattaaactgcatttgctccatcttatgacaaatactcgtatgcaacgagattaccatgagggacgtttacaattgatgagtcaggacgaatatgtcagggtcatctgtgaccaactggaaattattcccaaacatatcgtcatccatcgaattacaggagatgcgcctagggatatgctgcttgggcctatgtggagcctcaataaatgggaagctctcaacagcattgagatggagatgcgacgtcgtggaagtgttcaaggatgcaaggctgtaaaacaggagtttgaaaatgaaaagaccacttga

SEQ ID NO: 2600 - DNA, 252 bp, Streptococcus pneumoniae
ttttataaggaaattgactttattcaccgtaagtggccagatgttcagaagtatctggtttattttcaaaattttaccaacacccgtgaaaaggtggaagttattcgagagcgttatgaacaggctatcaatgagccaggtgtggtaggaatcaatattggaacgcgcccagactgtttaccagacgaaaccatcgaatatttggctgagttatcggagtgcatgcatgtgacggttgaattgggcttgtag

SEQ ID NO: 2601 - DNA, 438 bp, Streptococcus pneumoniae
tactcaaataccaagactggaaaagccaaatccgcaaagtttcgtcctagtttttttaatctaaaaagtttggttaggataatgcagacgactaaggtcagtatcaataataaaatagatgctaatttcattaaaatcatacccatattgtatcataaaaaaaggctaatggaaacgagaaacagaggaatttataggaaagtcaggcttttgagattgtgggtgatttttgttataatgaaagttataaaatcttataataccttgaatgattattatcgaaaactctttggagaaaagacttttaaagtccctattgatgcgggatttgactgtcccaatcgtgatggaactgtggctcatggaggctgtactttttgtacggtttccggttctggagatgccattgtggcaccagatgcgcctatccgtgagtaa

SEQ ID NO: 2602 - DNA, 360 bp, Streptococcus pneumoniae
atgggtatgattttaatgaaattagcatctattttattattgatactgaccttagtcgtctgcattatcctaaccaaactttttagattaaaaaaactaggacgaaactttgcggatttggcttttccagtcttggtatttgagtattacttgattacagctaaaacctttacccataatttcctccctagactggggctagccctctcgttcctagccattattctcgtctttttcttccttttgaaaaaacgcagcttttactatcctaaattcatcaaattcttctggcgtgcaggattcttattaacccttatcatgtatatagaaatgattgttgaattgttcttaatgaaatag

SEQ ID NO: 2603 - DNA, 246 bp, Streptococcus pneumoniae
atgcatattcactataacacaaatcaaacaactttaccactagaaatcagttccttcttgccacaagatcatctcgtttttactattgaaaaagtggtgaataccttggaggattgtcacttccacgccttctatcatgcctttgatcgcccgtcttatcaccctaaaatgcttgtatctactcttctatttgcctattcacaagggattttctctggtcgaaaaattgaaaaatggaagagttag

SEQ ID NO: 2604 - DNA, 624 bp, Streptococcus pneumoniae
atggaagagttagtgaccttagattgtttgtttattgacggaactaagattgaagccaatgccaacaagtatagttttgtgtggaagaaaacgacagagaaattctccgccaaacttcaagaacagatacaagtctattttcaagaagaaatcactccccttctgattaaatatgccatgtttgataaggaacaaaagagaggctataaacagtcagctagaaacttagcgaattggcactataatgacaaggaggatagctacacacatcctgatggctggtgctatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgagagggaagtgtcaagtgagaattgacatgggattggtacttatggccaataacctcctaaaatatagtgaaatgaaataa

SEQ ID NO: 2605 - DNA, 6519 bp, Streptococcus pneumoniae
atgatagtagaagaaaaggctgataaagctttggaaactaaaaatgtagttgaaaggacagaacaaagtgaacctagttcaactgaggctattgcatctgagaagaaagaagatgaagccgtaactccaaaagaggaaaaagtgtctgctaaaccggaagaaaaagctccaaggatagaatcacaagcttcaagtcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctatatggattctcaagtttatgtcaatggtcagttagtggggcattatccaaatggttataaccagttctcatacgatatcaccaaataccttcacaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggaccgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccatgggaatgtggttccaactgctaataatctggttcgcttccaattgcatggccaaggtcaactggtcggtgtagataacggagaacaagccagtcgtgaacgctataaggcgcaagcagatggttcttggattcgtaaagcatttaatggtaaaggtgttgccattgtcaaatcaactgaacaagcagggaaattcacccttactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgactgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaagctgtcacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactttgaacgctgaatatgagggagctaaaggccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtactcaattaacaactaaacttcatgttcgcgtatctgctcaaactgagcaaggtgcaaacatttctgaccaatggaccggttcagaattgccacttgcctttgcttcagattcaaatccaagcgacccagtttcaaatgttaatgacaagctcatttcctacaataaccaaccagccaatcgttggacaaactggaatcgtagtaatccagaagcttcagtcggtgtcctattcggagattcaggtattttgagcaaacgttcagttgataacttaagcgttggcttccatgaagaccatggagttggtgcaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggtgagagcagacaacaaactaggaacgtctatcacagaggtacaaatctttgcgaaacaagttgcggcagccaagcaaggacaaacaagaatccaagttgacggtaaagacttagcaaacttcaaccctgatctgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagaacttactttctcataaaccagttgctgcggttaaacaagctcgcttgctacaagtaggtcaagcacttgaattgccgactaaggttccagtttacttcacaggtaaagacggctacgaaacaaaagatttgtcagttgaatgggaagaagttccagcagaaaatctgacaaaagcaggtcaatttaccgttcgaggccatgtccttggtagtgatcttgttgctgaggtcactgtacgagtgacagacaaactaggcgaagctctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtctccaacaccatcttctaatccagaagtatcagcgggtgtgatcttccgtgaaaatggtaagattgtagaacggactgttgcgcaagccaaacttcacttctttgcagatagtggtacggatgcaccaactaaactcgttttagaacgctatgtcggtccagagtttgaagtgccaacctactattcaaactaccaagcctacgacgcagaccatccattcaacaatccagaaaattgggaagctgtgccttatcgtgcggataaagacatcgcagctggtgatgaaatcaacgtaacatttaaagctgtcaaagccaaagctatgagatggcgtatggagcgtaaagcagataagagcggtgttgcgatgattgagatgaccttccttgcaccaagtgaattgcctcaagaaagcacgcaatcgaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagccttccagtacttgttcgcctcgtttcagaaagtggaaaacaagtcaaggaataccgtatccacttgactaaggaaaaaccagtttctgagaagacagttgctgctgtacaagaagatcttccaaaactcgaatttgttgaaaaagatttggcctacaagacagttgagaaaaaagattcaacactgtatctaggtgaaactcgtgtagaacaagaaggaaaaactggtaaagaacgtatctttacagcgattaatcctgatggaagtaaggaagaaaaactccgtgaagtggtagaagctccgacagaccgcatcgtcttggttggaaccaaaccagtagctcaagaagctaaaaaaccacaagtgtcagaaaaagcagatacaaaaccaattgattcaagtgaagctagtcaaactaataaagcccagttaccaaatacaggtagtgcggcaagccaagcagcagtagcagcaggtttagctcttctaggtttgagtgcaggattagtagttactaaaggtaaaaaagaagactag

SEQ ID NO: 2606 - DNA, 186 bp, Streptococcus pneumoniae
ttgaattggattttcgcagagtgtaaattgttgaaactaggttgtcataccatgtataccacttgggctttagtagtagctaactgcactaaatataatataaggagggttttatggggaaaggccattggaatcggaaaagagtttatagcattcgtaagtttgctgtgggagcttgctcagtaa

SEQ ID NO: 2607 - DNA, 192 bp, Streptococcus pneumoniae
atgaaaatcaaagagcaaactaggaagctagccgcaggttgctcaaaacacagttttgaggttgtagataagactgacgaagtcagctcaaaacatggttttgaggttgtagatgaaactgacgaagtcagtaatcatatctacggcaaggcgacactgacgaagtttgaattggattttcgcagagtgtaa

SEQ ID NO: 2608 - DNA, 432 bp, Streptococcus pneumoniae
ttactgacttcgtcagtttcatctacaacctcaaaaccatgttttgagctgacttcgtcagtcttatctacaacctcaaaactgtgttttgagcaacctgcggctagcttcctagtttgctctttgattttcattgagtttatattttataggagcgcattattttgcttttgctgcgtactcttcgttacgtttgatcatttgttttctgtaccaagcaaagataccgatatagaatacaaggaaggctactgcaccaaggattgctttgatatcaccagttgtagtgttaccaattgtccaaccaagaagtttttcgattggtccttcaagagtagagtgagtaatcaattgagtttggctcacaccttctgggaaggcacctacacctttagcaagttctgttgcaaatggtgcaataagtgtacctga

SEQ ID NO: 2609 - DNA, 786 bp, Streptococcus pneumoniae
ttgaacaagaaaatcggtttctggggatctaaattcttcatcggtttcatccttggtatcgttattggtattatgggaactccacatccaattgcaggtgttgcagatgcagataaatggcgtcttgttatcaaaggatggttgtctcttggtttgactgccggtgtatctttggaactcttctcacttatcggttcatggttcatcgcagccgtagaaccactatcacaaggtattacaaacgttgctactaaacgtcttcaaggacgtaaattcaatatcggtcttgactggccattcatcgctggtcgtgctgaaatctgggcttgtgccaacgtacttgcaccaatcatgttgattgaagcagtgcttctttcaaaagttggaaatggtatcttgccacttgcaggtatcatcgctatgggtgttactccagctctcttggttgtaactcgtggtaaattgctccgtatgattatcttcggaacactcttgttgccactcttccttctttcaggtacacttattgcaccatttgcaacagaacttgctaaaggtgtaggtgccttcccagaaggtgtgagccaaactcaattgattactcactctactcttgaaggaccaatcgaaaaacttcttggttggacaattggtaacactacaactggtgatatcaaagcaatccttggtgcagtagccttccttgtattctatatcggtatctttgcttggtacagaaaacaaatgatcaaacgtaacgaagagtacgcagcaaaagcaaaataa

SEQ ID NO: 2610 - DNA, 693 bp, Streptococcus pneumoniae
  unsure (667): n at each above location is unknown.
atggatgcaatctttgacctaatcggaaaggttttcaatcccatcttagaaatgggtggacctgtcatcatgttaatcattttgacagtattggctttactttttggagtgaaattctccaaagcgcttgaaggtggtatcaaacttgccatcgctcttacaggtatcggtgctatcatcggtatgctaaatggtgctttctcagcatcacttgcaaaattcgttgaaaacactggtatacaattgagtattaccgacgttggttgggcaccactcgcaacaatcacttggggttctgcttggacactatacttcttgctcatcatgttgattgtcaacgtagtgatgcttgctatgaagaaaaccgatacacttgatgtcgatatctttgatatctggcacttgtctatcacaggtctcttgattaaatggtatgctgataacaatggtgtgagtcaaggggtttcactctttattgctacagcagctatcgtccttgtcggtgtgttgaaaattatcaactctgacttgatgaaacctacatttgatgaccttcttaacgccccaagttcatcaccaatgacatcaactcacatgaactacatgatgaacccagttatcatggttttggataagatttttgaaaaatcttcccaggccttgatanatatgactttgatgctgctaaattga

SEQ ID NO: 2611 - DNA, 306 bp, Streptococcus pneumoniae
atgattaaaattcttgctgcctgcggtgcaggtgttaactcaagtcaccaaattaaaagtgctctagaagaagaactttcaaaccgtggttatgatgttcactgtgatgcagtcatggtgaaagatgtaaacgaagaccttatgaaaggttacgatatctttacaccaatcgctgcaacagaccttggttttgaaccaggtatcccagttatcgaagctggaccaatcttattccgtatcccagcaatgagcgctccagtatttgacaatattgaagcagctattaaagaacacggattaagctaa

SEQ ID NO: 2612 - DNA, 477 bp, Streptococcus pneumoniae
atggtattagattatttctttgacaaaaaccttgtgttttgcttagaagcggataatcaagaacaactctttgatcaggttgcaactttattggaagaacgagaaattgtcactccaacttatcgtgaagccttgatcacgcgtgaaaagtcatttccaactggtttagatatggaatttctaggaaaggacttgccaaatgtagcgattcctcatacagatattgttcataatctagctgagaaagtggtggttgttcgattagaaaaaccagtaacttttcacaatatgatagctcctgataaggaagtagaagtatccttgctcttctttatcatcaataactcaagttcaagtcaaacaaatattctggctcagttgatggactttttcacaggaaatggacatcttgaagacctatcaaaaatttccgaaccagaaaaactttatgcttacattgctgaagcaaccgcttaa

SEQ ID NO: 2613 - DNA, 6417 bp, Streptococcus pneumoniae
atgaaaaaaagtacagtattgtcattaaccacagctgcagttattttagcagcctatgcccctaatgaggtagtcttagcagacacatctagctctgaagatgctttaagcatctctgataaagaaaaagtagtagtagataaggaaacagaaaataaagagaaacataaagatatccatagtgctatggaaacttcacaggattttaaagagaagaaaatagcagtcattaaggaaaaagaagttgttagtaaaactcctgtgatagacactaaaactagcaatgaagaaaattccaataaatcccaaggagatcatacggactcatttgtgaataaaaacacagaaaatcccaaaaaagaagataaagttgtctatattgctgaatttaaagataaagaatctggagaaaaagcaatcaaggaactatccagtcttaagaatacaaaagttttatatacttatgatagaatttttaacggtagtgccatagaaacaattccagataacttggacaaaattaaacaaatagaaggtatttcatcggttgaaagggcacaaaaagtccaacccatgatgaatcatgccagaaaggaaattggagttgaggaagctattgattacctaaagtctatcaatgctccatttgggaaaaattttgatggtagaggtatggtcatttcaaatatcgatactggaacagattataggcataaggctatgagaatcgatgatgatgctaaagcctcaatgagatttaaaaaagaagacttaaaaggaactgataaaaatttctggttgagtgataaaatccctcatgcgttcaattattataatggtggcaaaatcactgtagaaaaatatgatgatggaagggattattttgacccacatgggatgcatattgcagggattcttgctggaaatgatactgaacaagatatcaaaaactttaacggcatagatggaattgcgcctaatgcacaaattttctcttataaaatgtattctgacgcaggatctgggtttgcgggtgatgaaacaatgtttcatgctattgaagattctatcaaacacaacgttgatgttgtttcggtatcatctggttttacaggaacaggtcttgtaggtgagaaatattggcaagctattagggcattaagaaaagcaggcattccaatggttgtcgctacgggtaactatgcgacttctgcttcaagttcttcatgggatttagtagcaaataatcatctgaaaatgaccgacactggaaatgtaacacgaactgcagcacatgaagatgcgatagcggtcgcttctgctaaaaatcaaacagttgagtttgataaggttaacattggaggacaaagttttaaatacagaaatataggggcctttttcgataagaataaaatcacaacaaatgaagatggaacaaaagctcctagtaaattaaaatttgtatatataggcaaggggcaagaccaagatttgataggtttggatcttaggggcaaaattgcagtaatggatagaatttatacaaaggatttaaaaaatgcttttaaaaaagctatggataagggtgcacgcgccattatggttgtaaatactgtaaattactacaatagagataattggacagagcttccagctatgggatatgaagcggatgaaggtactaaaagtcaagtgttttcaatttcaggagatgatggtgtaaagctatggaacatgattaatcctgataaaaaaactgaagtcaaaagaaataataaagaagattttaaagataaattggagcaatactatccaattgatatggaaagttttaattccaacaaaccgaatgtaggtgacgaaaaagagattgactttaagtttgcacctgacacagacaaagaactctataaagaagatatcatcgttccagcaggatccacatcttgggggccaagaatagatttacttttaaaacccgatgtttcagcacctggtaaaaatattaaatccacgcttaatgttattaatggcaaatcaacttatggctatatgtccggaactagtatggcgactccaatcgtagcagcttctactgttttgattcgaccaaaattgaaggaaatgcttgaaaaacccgtattaaaaaatcttaaaggtgatgataaaatagaccttacaagtcttacaaaaatagccctacaaaatactgcaagacctatgatggatgcaacttcttggaaagaaaaaagtcaatactttgcatcacctagacagcagggggcggggctaattaatgtggccaacgctttgagaaatgaagttgtagcgactttcaaaaacacggattctaaaggtttggtaaattcatatggttccatttctcttaaagaaataaaaggtgataaaaaatactttacaattaagcttcacaatacatccaacaggcctttaacctttaaagtttcagcatcagcggtaactacagattctctaactgacagactaaaactggatgaaacatataaagatgaaaaatctccagatggtaagcaaattgttccagaaattcatccagaaaaagtcaaaggggcaaatattacatttgagcatgacactttcactataggggcaaattctagctttgatttaaatgcggttataaatgttggggaggctaaaaataaaaataaatttgtagaatcatttattcattttgagtcagtagaagaaatggaagcattaagctccaatggcaagaaaaccgacttccaaccatctttatcaatgcccctaatgggatttgctgggaattggaaccacgaaccaatccttgataaatgggcttgggaagaaggatcaaaatcaaaaacaatggaaggttatgatgatgacggtaaaccaaaaattccaggaaccttaaataaggggattggtggagaacatggtatagataaatttaatccagcaggagttatccaaaatagaaaagataaaaatagaacatctctagatcaagatccagacttatttgcctttaacaaccaaggtgttcatgcagaatccactagtggttctaagattgctaacatttatcctttagattcaaatggaaatcctcaagatgctcaactagaaagaggactaactccatctccacttgttctaagaagtgcagaagaaggactaatttcaattgtaaacaccaacaaagaaggagaaaaccaaaaagaccttaaagttgtatcaagagagcacttcataagaggaattctaaattctaagggaaatgacgctaagggtatcaaatcatccaaactaaaagtttggggtgacttgaaatgggatggactcatctataacccaagaggtagagaagaaaatgccccagaaagtaaggataaccaagatccagctactaagatacgaggacaatttgaaccgattgcggaaggtcaatatttctataaatttaaatatagattaactaaagattacccatggcaggtttcctatattcctgtaaaaattgataacacagcccctaagattgtttcggttgatttttcaaatcctgaaaaaattaagctaatcacaaaggatacttatcacaaggtaaaagatcaatacaagaatgaaactttatttgctagagatcaaaaagaacatcctgaaaaatttgatgagattgcaaatgaggtgtggtatgcaggagctgctcttgttaatgaagatggagaggttgagaaaaatcttgaagtaacttatgcaggtgagggtcaaggaagaaataggaagcttgataaagatgggaatactatctatgaaattagcggagcaggagatctaagaggaaaaatcatcgaagtaatcgccctagatggagcaagcaactttaccaaaatccataggattaaatttgctaatcaagctgatgaaaaagggatgatttcctattatctagtagatcctgatcaggattcatctaaataccaaaagcttggcgaaattcctgaatctaaatttaagaatttaaaaaatgttaaagatgatagcctaaacaaagagacagctgaggtggaaaataaccttttagtagataatcagtctatcgaaggaaaatctctctttaatattcataaaactatttcaacaattagagactttgaaaataaagacctaaagaaactcattaaaaagaaatataagcaagaagacgactttgtaaatggtggaacaagaacagtagagcgtgattataaatacgatgataaaggaaatataatagcctacgatgatgggactgatctagaatatgaaactgagaaacttgacgaaatcaaatcaaaaatttatggtgttctaagtccgtctaaagatggacactttgaaattcttggaaagataagtaatgtttctaaaaatgccaaggtatattatgggaataactataaatctatagaaatcaaagcgaccaagtatgatttccactcaaaaacgatgacatttgatctatacgctaatattaatgatattgtggatggattagcttttgcaggagatatgagattatttgttaaagataatgatcagaaaaaagctgaaattaaaattagaatgcctgaaaaaattaaggaaactaaatcagaatatccctatgtatcaagttatgggaatgtcatagaattaggggaaggagatctttcaaaaaacaaaccagacaatttaactaaaatggaatctggtaaaatctattctgattcagaaaaacaacaatatctgttaaaggataatatcattctaagaaaaggctatgcactaaaagtgactacctataatcctggaaaaacggatatgttagaaggaaatggagtctatagcaaggaagatatagcaaaaatacaaaaggccaatcctaatctaagagccctttcagaaacaacaatttatgctgatagtagaaatgttgaagatggaagaagtacccaagctgtattaatgtcggctttggacggctttaacattataaggtatcaagtgtttacatttaaaatgaacgataaaggggaagctatcgataaagacggaaatcttgtgacagattcttctaaacttgtattatttggtaaggatgataaagaatacactggagaggataagtccaatgtagaagctataaaagaagatggctccatgttatttattgataccaaaccagtaaacctttcaatggataagaactactttaatccatctaaatctaataaaatttatgtacgaaatccagaattttatttaagaggtaagatttctgataagggtggttttaactgggaattgagagttaatgaatcggttgtagataattatttaatctacggagatttacacattgataacactagagattttaatattaagctgaatgttaaagacggtgacatcatggactggggaatgaaagactataaagcaaacggatttccagataaggtaacagatatggatggaaatgtttatcttcaaactggctatagcaatttgaatgctaaagcagttggagtccactatcagtttttatatgataatgttaaacccgaagtaaacattgatcctaagggaaatactagtatcgaatatgctgatggaaaatctgtagtctttaacatcaatgataaaagaaataatggattcgatggtgagattcaagaacaacatatttatataaatggaaaagaatatacatcatttaatgatattaaacaaataatagacaagacactaaacattaagattgttgtaaaagattttgcaagaaatacaaccgtaaaagaattcattttaaataaagatacgggagaggtaagtgaattaaaacctcatagggtaactgtgaccattcaaaatggaaaagaaatgagttcaacgatagtgtcggaagaagattttattttacctgtttataagggtgaattagaaaaaggataccaatttgatggttgggaaatttctggtttcgaaggtaaaaaagacgctggctatgttattaatctatcaaaagatacctttataaaacctgtattcaagaaaatagaggagaaaaaggaggaagaaaataaacctacttttgatgtatcgaaaaagaaagataacccacaagtaaaccatagtcaattaaatgaaagtcacagaaaagaggatttacaaagagaagatcattcacaaaaatctgattcaactaaggatgttacagctacagttcttgataaaaacaatatcagtagtaaatcaactactaacaatcctaataagttgccaaaaactggaacagcaagcggagcccagacactattagctgccggaataatgtttatagtaggaatttttcttggattgaagaaaaaaaatcaagattag

SEQ ID NO: 2614 - DNA, 204 bp, Streptococcus pneumoniae
tggtatgaatgtgcttataatgtatcccggttaacgaaagttttggacttatactcttcgaaaatctcttcaaaccacgtcaacgtcgccttgccgtgcgtatggttactgactacgtcagttctatccacaacctcaaaacagtgttttgagcaatctgcggctagtttcctagtttgctctttgattttcattgagtactaa

SEQ ID NO: 2615 - DNA, 198 bp, Streptococcus pneumoniae
ttgcttgctactttagagagtgaagctcgtaaaaaagttggttatctgcaggtcaaaacagtggcagaaggttctaataaagattatgatcgaacaaatgacttttatcgaggtcttggctttaaaaagttagagatttttcttcaactatggaatccgcaaaatccttgtcagattttgattaaaaagcttgaataa

SEQ ID NO: 2616 - DNA, 786 bp, Streptococcus pneumoniae
atgaaaaaatatcaacgaatgcatctgatttttatcagacaatacatcaaacaaatcatggaatataaggtggattttgtggttggtgtcttgggagtctttctggctcaaggcttgaatctcttgtttctcaatgtcatctttcaacatattccattcctagaaggctggacctttcaagagatagctttcatttatggattttccttgattcccaagggaatggaccatctcttttttgacaatctctgggcactagggcaacgcctagtccgaaaaggagagtttgacaagtatctgactcgtcccatcaatcctctctttcacatcctagttgaaacctttcagattgatgccttgggtgaactcttagtcggtggtattttattgggaacaacagtgaccagcattgtttggactcttccaaaattcctgcttttcctagtttgtattccttttgcgaccttgatttatacttctcttaaaatcgcaacagccagtatcgccttttggactaagcagtcaggcgccatgatttacatcttctatatgttcaatgactttgctaagtatccgatttctatttacaattctcttcttcgttggttgattagctttatcgtgcctttcgcctttacagcctattatccagctagctatttcttacaggaaaaggatgtgttctttaacgtaggaggtttgatgttgatttctctggttttctttgttatttcccttaaactttgggataagggcttagattcctacgaaagtgcgggttcgtaa

SEQ ID NO: 2617 - DNA, 861 bp, Streptococcus pneumoniae
ttgaggatattatccgtcgcttctaccgaaaggagctctaggatgatcaaattgtggagacgttataaaccctttatcaatgcaggggttcaggagttgattacttaccgagtcaactttattctctatcggattggcgatgtcatgggggcttttgtggccttttatctctggaaggctgtctttgattcttcgcaagagtctttgattcagggcttcagtatggcggatatcaccctctacatcatcatgagttttgtgaccaatcttctgactagatccgattcgtcctttatgattggggaggaggtcaaggatggctccattatcatgcgtttgttgcgaccagtgcattttgcggcctcctatcttttcaccgagcttggttccaagtggttgatttttatcagcgttggccttccatttttaagtgtcattgtcttgatgaaaatcatatcgggtcaaggtattgtagaggtgctaggattaactgtcctttatctttttagcttaacgctcgcctatctgattaactttttctttaatatttgctttggattttcagcctttgtgtttaaaaatctttggggttccaacctacttaagacttccatagtggcttttatgtcggggagtttgattcccttggcattctttccaaaggttgtttcagatattctttcctttttgcctttttcatccttgatttatactccagttatgatcattgttggaaaatacgatgccagtcagattcttcaggcactccttttgcagttcttctggctcttagtgatggtgggattgtctcagttgatttggaaacgggtccagtcctttatcaccattcaaggaggttag

SEQ ID NO: 2618 - DNA, 954 bp, Streptococcus pneumoniae
gtgaagattgttaaggaaccgggcttgaagggggctttgcgctcctttattcatcctgaaaagcagacctttgaagcggtcaaggatttgacctttgaggttccaaaagggcagattttaggatttatcggggcaaatggtgctgggaagtcgacaaccattaaaatgctgacaggaattttgaaaccaacatctggtttttgtcggattaacggcaagattccccaggacaatcggcaagattatgtcaaagatattggcgtagtctttggacaacgcacccagctatggtgggatttggctctgcaagagacctacactgtcttaaaagagatttatgatgtgccaaactcgctctttcataagcgcatggactttttgaatgaagtcttggatttgaaggactttatcaaggatcccgtgcggactctttcactgggacaacggatgcgggcggatattgcggcctccttgctccacaatcccaaggttctttttttagatgagccgaccattggtttggacgtttcggttaaggataatattcgtcgggcaattactcagatcaatcaagaggaagaaactaccattcttttgaccactcacgatttgagtgatattgagcaactttgtgatcggattttcatgattgacaaggggcaagagatttttgatggaacggtgagccaactcaaggagacctttggtaagatgaagactctctcttttgaactgctaccaggtcaaagtcatctcgtctctcactatgaaggtctgtctgatatgaccattgatagacaaggaaacagcctcaacattgaatttgatagttctcgctaccagtcagctgacattatcaagcaaaccctgtctgattttgaaatccgcgatttgaagatggtggatacggatattgaggatattatccgtcgcttctaccgaaaggagctctag

SEQ ID NO: 2619 - DNA, 249 bp, Streptococcus pneumoniae
attaccaacctactcatcttctcaccagagggcggtattaactttgatcataaaatcggatactccctctatccagaaaatatgctcagaatgattgtctctaaacaatacctgctcttttacctcattcatgaaaaagaagtccataccctgagaattatcaactcacgcaccgactacctaaaccaactcgaccacctctttcgtacatgtaggaaactattttcctcacaaataatctcattataa

SEQ ID NO: 2620 - DNA, 396 bp, Streptococcus pneumoniae
tacgaaacaattgctaaaacatttatagaaattaattttactttcccaatcgatttgttctcatcttatttcaatccgctatatattatggtatcgaatcttcatcagaatgataaaattaatcaattaatatctgattacaaacagaatatgaaagctttttatatcactattgaaaaatttatacgagatgatgaaagccttaagtgttattttacaaaggttatttcaagtcgttccaaggtaacaagtctagatcagattgaagctgataaaacgatacaaagaaaatattcaagtgagctaaaaaaatttattggattttataatgagattatttgtgaggaaaatagtttcctacatgtacgaaagaggtggtcgagttggtttaggtag

SEQ ID NO: 2621 - DNA, 474 bp, Streptococcus pneumoniae
gtgcgtatggttcatactacgtcagatctatccacaacctcaaaacagtgttttgagcaacctgaggctagtttcctagtctgctctttggttttcattgagtataacacattgttagaagttggtttaaattccctaatcagtttgttcacatttaccttcgatatattatatcccatagttaaggttggtcatacagatgattatagtcatggagccgtaaaacttagtgtttctttagttgacaaagatgtcatgaaaaaaatatctgtaactgtaataggatattttgaaataaatatagatgaaaatatcaccgatattctatacgtaaatggtactgctattctttatccttatttacgttctattgtttcaatagtttcggcaattgatagcagtgaagcaatgttgctacctaccattaatgttttagagttactagataaatctcaaccttttgaagaagaataa

SEQ ID NO: 2622 - DNA, 690 bp, Streptococcus pneumoniae
atggctaaaaaaagcaaacaacttcgtgctgctcttgagaaaatcgacagcacaaaagcatacagcgtagaagaagctgtagcacttgcaaaagaaactaactttgcaaaatttgatgcaactgtagaagttgcttacaacttgaacatcgatgttaaaaaagctgaccaacaaatccgtggagcaatggtattgccaaacggtactggtaaaacttcacgcgttcttgttttcgcacgtggtgcaaaagctgaagaagcaaaagctgctggtgcagactttgttggtgaagatgaccttgttgctaaaatcaacgacggttggttggacttcgacgtagttatcgctacacctgatatgatggctcttgttggacgtcttggacgtgtccttggaccacgtaacttgatgccaaaccctaaaactggtactgtaacaatggatgttgctaaagcagttgaagagtctaaaggtggtaaaatcacttaccgtgctgaccgtgcaggtaacgttcaagcaatcatcggtaaagtatcatttgaagctgaaaaattggttgaaaacttcaaagctttcaacgaaacaatccaaaaagcaaaaccagctacagctaaaggaacttacgtaacaaacttgactatcacaactactcaaggtgttggtatcaaagttgacgtaaactcactttaa

SEQ ID NO: 2623 - DNA, 426 bp, Streptococcus pneumoniae
atggctaaaaaagtcgaaaaacttgtaaaattgcaaatccctgctggtaaagctacaccagctccaccggttggacctgctcttggtcaagctggtatcaacatcatgggattcacaaaagagttcaacgctcgtacagctgaccaagctggtatgatcattccagttgttatctcagtttacgaagataaatcatttactttcatcactaaaacaccaccagctgctgttcttttgaaaaaagctgcaggtgttgaaaaaggatcaggtacacctaacaaaactaaagttgctacagttactcgtgcgcaagtacaagaaattgcagaaactaagatgccagatttgaacgcagcaaacgtagagtctgcaatgcgtatgatcgaaggtactgctcgttctatgggattcactgttgttgactaa

SEQ ID NO: 2624 - DNA, 225 bp, Streptococcus pneumoniae
aattgcaagagaaaagtttattttttatactcaatgaaaatcaatgagcaaactaggaagctagccgcaggctactcaaagtatagctttgaggttgcaaataaaactgacgaagtcagctcaaaacactgttttgagattgtggatagaactgacgaagtcagtaaccatacgcacggtaaggcgacgttgacgtggtttgaagagattttcgaagagtattaa

SEQ ID NO: 2625 - DNA, 717 bp, Streptococcus pneumoniae
atgaaaaaaagataccttgtcttgacagctttgctagccttgagtctagcagcttgttcacaagaaaaagcaaaaaatgaagacggagaagctaagacagaacagacagccaaagctgatggaacagtcggaagtaagtctcaaggagctgcccagaagaaagcagaagtggtcaataaaggtgattactacagcattcaaggcaaatacgatgaaatcatcgtagccaacaaacactatccattgtctaaagactataatccaggggaaaatccaacagctaaggcagagttggtcaaactcatcaaagcgatgcaagaggcaggtttccccattagcgaccattacagtggctttagaagttatgaaactcagaccaagctctatcaagattatgtcaaccaagatgggaaggcagcagctgaccgctactctgctcgacctggttatagcgaacaccagacaggcttggcctttgatgtgattgggactgatggtgatttggtgacagaagaaaaagcagcccaatggcttttggaccatgcagctgattatggctttgttgtccgttatctcaaaggcaaggaaaaggaaacaggctatatggctgaagaatggcacttgcgttatgtaggaaaagaagctaaagaaattgctgagagtggtctcagtttggaagaatactatggctttgaaggcggagattacgtcgattaa

SEQ ID NO: 2626 - DNA, 180 bp, Streptococcus pneumoniae
caaagctgtcaagacaaggtatctttttttcatttctactcctttatttctaatagtttatctacttctgacgataaacattcgactaatcttttaatctcttccggttttacttggcaagtttctgctgtcatttcttcaaagggaacccaccaaactggcccacgtcccttgagaccg

SEQ ID NO: 2627 - DNA, 510 bp, Streptococcus pneumoniae
ttgttgatgcttatcttaagagcgaggcggtatcatagaatgtgcttaatctgtcagagaatcgaactcattaaagctgggcaaaatccctactttgtcaaagagttggaaacaggctatcttgtgattggagaccaccagtattttgcaggatatagtctttttctagctaaggaacacgttaccgaattgcaccatttgaaaaaggaaacaagactccgttttctcgaagaaatgagtctagtccaagaggcagttgccaaggcatttgctgctgagaaaatgaatatcgaactgctaggaaatggcgatgcccatcttcattggcatctgtttcctagacgaagaggtgatatgaatggtcacggtctcaagggacgtgggccagtttggtgggttccctttgaagaaatgacagcagaaacttgccaagtaaaaccggaagagattaaaagattagtcgaatgtttatcgtcagaagtagataaactattagaaataaaggagtag

SEQ ID NO: 2628 - DNA, 216 bp, Streptococcus pneumoniae
ttggcgaaagagcaagatattccatttaagctcgacatctatccattttacggatcggacgcttcagcagcgatgtcagcaggtgcagaggtcaagcatgcacttcttggagctggtattgagtccagtcactcttatgagcggacccacatcgattcagtagtagcgactgagcgtattgttgatgcttatcttaagagcgaggcggtatcatag

SEQ ID NO: 2629 - DNA, 528 bp, Streptococcus pneumoniae
atgaatcaaacagtagaatatatcaaagaactgacagccatcgcatcgccaacgggctttactcgtgaaatttcgaattatttagtcaagactctagaaggttttggttaccagccagttcgcacagctaagggtggtgtcaatgtgaccatcaaaggtcaaaatgatgagcaacatcgctatgtgactgctcatgtggatacgctgggtgctattgttcgtgctgtcaaaccagatggtcgtcttaaattggaccgtatcggtggttttccttggaacatgattgaaggtgaaaactgtaccgttcatgtggctagcacaggtcaaaaggtatcaggaaccatcctcatccaccaaacttcttgccatgtctacaaggatgcaggaactgcagagcgcacgcaggacaatatggaagtgcgtttggatgtaaaagtaagcaatgaaaaagaaactcgtgctcttgggattgaggtcggtgattttatcagcttcgatccacgaactgttgtgactgatacaggtttt

SEQ ID NO: 2630 - DNA, 342 bp, Streptococcus pneumoniae
ttggatattgccaatttgggtcttgatgcgattatcaagtactcaattccagtattggttatcttgtacccaatcacgattgctatcgttatgattgtcattgtcaacaaatttgttgccctttcaaaaccaggtatgcagttgccaattgctgtggtaacagttattgccattgcaagcgtacaaggaagctcgtttaaggttgagtttcttgcaaatcttgttagcgttcttccttttgccaaggcatctctcccatggttggtgccagccattgttggaatcttgctctcattggttctaccaaacaagcaagaaagcgatgtttttgaaatggaataa

SEQ ID NO: 2631 - DNA, 945 bp, Streptococcus pneumoniae
atgaaggaaatttttatggctaaaaaaggtaccctaacaggtttgctcctgtttggaatattttttggtgcggggaacttgatttttccgccttctctaggtgctctatctggagaacattttcttcctgccatcgcaggttttgtcttttcaggcgttggtatcgccgtcttgacccttattattggaacgctaaatcctaaaggatatatctacgagatttcaacgaagatagcgccttggtttgcgactctttacctctcagttctttacttgtcaatcggtccattctttgctaccccacgtactgctacaacagcttacgaagtagggattagcccccttttgtcggatgcaaataaaggacttggcttgattgtatttacggttctgtattttgcggcagcctatttgatttcgcttaatccatcaaaaatcttagaccgcattggacgtattttaacgccagtctttgcaattttgattgttatcttggtcgttctgggagctatcaaatatggtggaacaagtcctcaaactgcttcagctgcttatcaagcttctgcctttggtacaggtttcctagaaggttacaataccttggacgcccttgcctcagtggcctttagcgtaatcgcagttcaaaccttgaaacaacttggattttcaagtaagaaaaaatacatttcaactatttgggttgttggtatcgttgttgcccttgccttcagcgctctttacatcggtttaggttttcttggaaatcatttcccagtaccagctgaagcgatgaagggtggaacaccaggtgtttacatcttgtcacaagccactcaagaaatctttggctcaacagctcaactcttccttgcagctatggttaccgtaacctgcttcacaaagaatgttggtttaattgtgtcaacaagttgagttcttaatgaa

SEQ ID NO: 2632 - DNA, 189 bp, Streptococcus pneumoniae
ttgaagagattttcgaagagtattagaagaaaaagaatgaaagaaatagcctttgacgcattttaccagctttaccaaaacgaccagctttctttagtggatgtgagagaagtggatgagtttgcagctcttcatttagaaggtgcccacaacctaccgcttagtcaattggctgatagttatgattaa

SEQ ID NO: 2633 - DNA, 240 bp, Streptococcus pneumoniae
ctttttcttctaatactcttcgaaaatctcttcaaaccacgtcagcgtcgccttaccgtgcgtatgttaccgacttcgtcagttttatctgcaacttcaaagctgtactttgagcagcctacgactagcttcctagtttgctctttgattttcattgactataaaatggttttaattctttttttcaaatctggcactacttctgcctcaaaccaaggatttttggccatccagatttga

SEQ ID NO: 2634 - DNA, 579 bp, Streptococcus pneumoniae
atgtctcaaatcgaaagaatcaaacaggctatcatggcggattcgcagaatgccagctatacagagcgtggcattgagcctctctttgcagcgccaaaaactgctcgcatcaatatcatcggtcaggctccgggacttaaaactcaagaagcaggcctttactggaaagataaaagtggtgaccgcttgcgggactggctaggtgtggatgaagataccttttacaattcaggttattttgctgttttgcctatggatttctactttccaggacatggcaagtcgggtgatcttccgcctcgtacaggttttgcagaaaaatggcatccgcaggtcttacaggaattgcctgatattcagttaaccctcttgattgggcaatatgcccaagcctactatttacaggagaaaatcagtgggaaggtaacggagagggtgaaacactataaagactatctgccagcctattttccgctagttcacccatcaccacgaaatcaaatctggatggccaaaaatccttggtttgaggcagaagtagtgccagatttgaaaaaaagaattaaaaccattttatag

SEQ ID NO: 2635 - DNA, 1401 bp, Streptococcus pneumoniae
atgacagcaattgattttacagcagaagtagaaaaacgcaaagaagacctcttggctgacttgtttagccttttggaaatcaattcagaacgtgatgacagcaaggctgatgcccagcatccatttgggcctggtccagtaaaagccttggagaaattccttgaaatcgcagaccgcgatggctacccaactaagaatgttgataactatgcaggacattttgagtttggtgatggagaagaagttctcggaatctttgcccatatggatgtggtgcctgctggtagcggttgggacacagacccttacacaccaactatcaaagatggtcgcctttatgcgcgcggggcttcggacgataagggtcctacaacagcttgttactatggtttgaaaatcatcaaagaattgggtcttccaacttctaagaaagttcgcttcatcgttggaacagacgaagaatcaggctgggcagacatggactactactttgagcacgtaggacttgccaaaccagatttcggtttctcaccagatgctgaatttccaatcatcaatggtgaaaaaggaaatatcacggaatacctccactttgcaggagaaaatacaggtgttgcccgtcttcacagctttacaggtggtttacgtgaaaatatggtaccagaatcagcaacagcagtcgtttcaggtgacttggctgacttgcaagctaaactagatgcctttgttgcagaacacaaacttagaggagaactccaagaagaagctggcaaatacaaggtgacgatcattggtaaatcagcccacggtgctatgcctgcttcaggtgtcaatggcgcaacttaccttgccctcttcctcagccagtttggctttgctggtccagccaaagactaccttgacatcgcaggtaaaattctcttgaacgatcatgagggtgaaaatcttaagattgctcatgtggatgaaaagatgggtgctctttctatgaatgccggcgtcttccacttcgatgaaacaagtgctgataataccattgccctcaacatccgctatccaaaaggaacaagtccagaacaaatcaagtcaatccttgaaaacttgccagttgtttctgttagcctgtctgaacacggtcacacgcctcactatgtgccaatggaagatccacttgtgcaaaccttgttgaatatctatgaaaaacaaactggctttaaaggtcatgaacaagtcatcggtggtggaacctttggtcgcttgctagaacgcggagttgcctacggtgctatgttcccagactcgattgataccatgcaccaagccaatgaatttatcgccttggatgatcttttccgagcagcagcaatttatgccgaagctatttacgaattgatcaaataa

SEQ ID NO: 2636 - DNA, 606 bp, Streptococcus pneumoniae
atgaaatttcttgaattaaataaaaaacgtcatgcgactaagcattttactgataagcctgttgatcccaaagatgtgcgtacggctatcgaaattgcaaccttggcgccaagcgcccacaacagccagccttggaaatttgtggtggtacgtgagaaaaatgctgaactggcaaagttagcttatggttccaattttgaacaggtatcatcagcgcctgtaaccattgccttgtttacagatacggacttagccaaacgtgctcgtaagattgcccgtgttggtggtgctaataacttttctgaagagcaacttcaatattttatgaaaaatctgccagctgagtttgcccgttacagtgagcaacaagtcagcgactacctagctctcaatgcaggtttggttgccatgaacttggttcttgcattgacagaccaaggaattggttctaacattattcttggttttgacaaatcaaaagttaatgaagttttggaaatcaaagaccgtttccgcccagaactcttgatcacagtgggttatacagacgaaaaattggaaccaagctaccgcttgccagtagatgaaatcatcgagaaaagatag

SEQ ID NO: 2637 - DNA, 240 bp, Streptococcus pneumoniae
ttctcacaggcaaccaaaaatggtaggatagctagtaataggctaaattttttcatactgtctccattcaaatgtaaagtacttgctagtttatcagaaactttcctgataaaccaatatatatcttttatgtctgtgatagaaaaacttaatcatgaaaaatccctgcaagctctttcaaattatggtagaatggaagcagtagaattagaaaaggaaatcgattatgaaatttcttga

SEQ ID NO: 2638 - DNA, 801 bp, Streptococcus pneumoniae
atgaaaaaatttagcctattactagctatcctaccatttttggttgcctgtgagaatcaagctacacccaaagagactagcgctcaaaagacaatcgtccttgctacagctggcgacgtgccaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggcagataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaataa

SEQ ID NO: 2639 - DNA, 834 bp, Streptococcus pneumoniae
atgaaccataaaatcgcaattttatcagatgttcatggcaatgcgacggcgctagaagcagtgattgcagatgctaaaaatcaaggggccagtgaatattggcttctgggagatatttttcttcctggtccaggcgcaaatgacttagtcgccctgctaaaggaccttcctatcacagcaagtgttcgaggcaattgggatgatcgtgtccttgaggtcttggatggcgaatatggtttggaatatccgaaagaaatccagtcaatgcgcatgacccagtttttgatggagcgaatggatcctgcaacgattgtctggctacgaagcttgcctttgctggaaaagaaagaaattgacggattgcgcttttctatctctcataatttacctgacaaaaactatggtggtgacttgctagttgagaatgatacagagaaatttgaccaactgctagatgcggaaacggacgtggcagtttatggtcatgttcacaagcagttgcttcgttatggaagtcaagggcaacaaatcatcaatccagggtcgattggcatgccctattttaattgggaggcgttaaaaaatcaccgtgcccagtatgccgtgatagaggttgaagatggggaattggtaaatatcctatttcgtaaagtcgcttatgattacgaggctgagttagaatttgccaaatccaagaggcttccctttatcgaaatgtatgaagaactgcgtcgtgaagataactatcagaggcacaatctggaactattagcaagcttaatagaaaagcataggtatgtagaggatgtgaagaatttttttgattttttgtaa

SEQ ID NO: 2640 - DNA, 1845 bp, Streptococcus pneumoniae
atgaacaacttgattaaatcaaaactagagctcttgccgaccagccctggttgctacattcataaggataaaaatggcaccattatctatgtaggaaaggctaaaaatctgcgtaatcgagtacggtcctattttcgtggaagtcataataccaagacagaggctctggtgtctgaaattgtggattttgaatttattgttacggagtctaatattgaggcacttctcctagaaattaacctgatcaaggaaaacaagcccaagtacaatatcatgctcaaggatgacaagtcctatcctttcatcaaaatcaccaatgagcgctatccacgcttgattatcactcgtcaggtcaaaaaggacggaggtctttattttggaccctatcccgatgtgggggcagccaatgaaatcaagcggttgctggatcggatattcccttttcgtaagtgtaccaacccgccctctaaggtctgtttttattaccatatcggtcaatgcatggcccacaccatctgtaagaaggatgaggcttatttcaagtctatggctcaggaggtgtctgattttctgaaaggtcaggatgacaaaatcatcgatgatctcaagagtaaaatggcagtagcagcacaaagtatggagtttgaacgtgcggcggaataccgtgacctgattcaggctattggaacgcttcgaaccaagcaacgggtcatggcgaaagatttgcaaaatcgcgatgtctttggctactatgtggataagggctggatgtgtgtgcaggttttctttgtccgtcagggtaagcttatcgagcgcgatgtcaatctcttcccctacttcaatgatccagatgaggattttttgacctatgtaggacaattctatcaagaaaaatctcatctagttcccaatgaggtactgattccgcaggatattgacgaagaggctgtcaaggccttggtggattccaagattcttaagcctcaacgtggagagaaaaaacaactggtcaatctagccataaaaaatgctcgtgttagtctagagcagaagttcaatctgctagaaaaatctgtcgaaaagactcaaggagctattgaaaatctagggcgtttgctccaaatcccgaccccagtacgtatcgagtccttcgataactctaatatcatgggaactagccctgtttcggctatggtggtctttgtcaacggtaaaccgagtaagaaggattaccgtaagtacaagataaaaacggttgttggaccagacgactatgccagcatgagagaggtcattcgcagacgctatggtcgagtacagcgtgaggctttgactcctccagatttgattgtgattgatggggggcaaggtcaagtcaatatcgctaagcaggttatccaagaggaactgggcttggatattccaattgctgggctgcaaaagaatgataagcaccaaacccatgaattgctctttggagatccgcttgaggtggtggacttgtctcgcaattctcaggaatttttcctcctccaacgcatccaagatgaggtgcaccgctttgctatcactttccaccgccaactgcgctccaaaaattctttctcatctcaattggatgggattgacggtctgggacctaaacgcaagcagaatcttatgaagcatttcaagtctttgaccaaaatcaaggaagccagtgtggatgagattgtcgaagttggggtacctagagtcgttgcagaggctgtgcaaagaaagttgaacccgcagggagaagccttgcctcaagtagcagaagaaagagtagattaccaaacggaaggaaaccacaatgaaccataa

SEQ ID NO: 2641 - DNA, 723 bp, Streptococcus pneumoniae
ttgctagaaaggtggagagacatgcgctggctttttcgtttgataggggctttcttttcttttgtgtggcgtttgttttggcgtctggtttggatagttgtgctcttatgtgtgcttgctttcggacttctctggtatctgaacggggattttcaaggagcgctaaagcaagcagaacggtcagtaaaaattggtcaacaaagtattgaccaatgggagaaaacagggcaactgcctaagttaagccagacagatagtcaccagcattctgaaggaaggtggccacaggcctctgctcgtatttacctggatccgcagatggattcacgctttcaagaggcttatttagaagcaatccagaactggaatcaaactggtgcttttaactttgaactcgtgactgagtctagtaaggcggatattaccgctacggagatgaacgacggaggcactcctgtggcaggagaggcggaaagtcaaactaatctcttaacagggcaattcttgtccgtaacggtgcggttgaatcattattatttgtccaatccatactatggctactcctatgaacgccttgtccatacggcagaacatgagttaggtcatgcgattggcttggaccatacagatgagaagtctgtcatgcaaccagcaggttccttttatggtatccaggaagaggatgttgcaaacctccgaaaaatatatgagactagtgagtag

SEQ ID NO: 2642 - DNA, 1233 bp, Streptococcus pneumoniae
atggcactaacaacactcacgaaagaagagtttcagacttattctgatcaggtttcttctcgttcctttatgcaatctgtccagatgggggatttgctagaaaaaagaggggctcgaattgtttatcttgctttgaaacaagaaggagaaattcaagttgcagctctggtttatagcttgcccatgctgggtggtctgcatatggaactcaattcggggccgatttatacccaacaagatgctcttccagttttttatgcagagttaaaagaatatgccaagcaaaatggtgtattagagttgcttgtaaaaccttatgaaacttatcaaacttttgatagccaaggtaatccaatagatgctgagaaaaaaagtattattcaaggtttgactgatttaggttatcaatttgatggcttaacaacaggttacccaggtggagaaccagattggttatactataaagatttaactgaattaactgaaaagagtttgcttaaaagttttagcaaaaagggtaaacccttggtgaaaaaggctgaaacctttggcattcggttgaaaaagttaaaacgtgaagaactatcgatttttaagaatataacaaaagaaacctctgaacgtagagaatatagtgataaaagtttagaatattatgagcatttttatgatacttttggagaacaagcggagtttctcatagcaagcttgaatttttcggagtatatgagcaaattgcaaggtgaacaaagtaaactagaagaaaaattggacaagttgcgacttgatttgagtaaaaatcctcattctgagaaaaaacaaaatcaactgagagaatattctagtcaatttgaaacgtttgaagttcgaaaagcagaagcgcgagacttgattgaaaaatatggagaagaagatattgttttagctgggagtttatttgtttatatgcctcaggaaacgacttatctctttagtggttcctacactgagtttaataagttctatgcccctgcactgcttcaaaaatatgttatgttggaaagcataaaacgtggaatacctaaatacaacttcctaggcattcaagggatttttgatggaagtgatggtgttttgcgttttaaacagaattttaatggctatattgtacgcaaagcaggtactttccgttaccatccatcgcctttaaaatacaaagctatccagttactcaaaaaaatagtaggacgttaa

SEQ ID NO: 2643 - DNA, 1221 bp, Streptococcus pneumoniae
atgtaccgttatcaaattggcattcccacattagaatatgatcagtttgtcaaagaacatgaattagccaatgtattacaaagtagtgcttgggaggaagttaagtctaattggcaacatgagaagtttggtgtttacagggaagaaaaattactggcgacagctagtattttgattagaactcttccgctaggctataaaatgttttacatcccaagaggacctatattggattatggggataaagaactcttgaattttgccattcagtctattaagtcctatgctcgcagtaagagagcggtttttgtgacttttgacccaagtatttgcctatctcaaagtttaatcaatcaggaaaagacagaatttcctgaaaatctggctattattgatagtttgcaacaaatgggagtaaggtggtcaggaaaaacggaggaaatgggagacaccattcaacctcgtattcaggcgaaaatatacaaggaaaattttgaagaagataaactttccaagtcaacaaaacaggctattcgaacagcacgaaacaaagggcttgagattcaatatggtggactggaactattagattcattttcggagttgatgaaaaaaactgagaagcgaaaagagattcatttgaggaatgaagcctattataaaaaattgttagataattttaaggacaaggcctatatcaccttggccaccttggatgtttctaaacgttcgcaagaattagaagaacagttagcgaaaaatagagccttggaagagacctttactgagtcgactcgaacttcaaaagtagaagcgcagaagaaggaaaaagaacgtttgttagaggaattgaccttcttgcaggaatatatagatgtaggtcaagcgagagttcctttagcggctactttgagtttggaatttggtactacctctgtcaatatatatgctggtatggatgatgattttaaacgttacaatgcaccaattttaacatggtatgaaacggctcgctatgcctttgagcgaggtatggtctggcaaaatttaggtggtgttgaaaactctctcaatggtggactttatcattttaaggaaaaatttaatccaacgattgaagaatacttgggtgaatttacaatgcccactcatcctctctatcctctgttaagacttgctcttgatttccgtaaaacattaagaaaaaaacatagaaagtaa

SEQ ID NO: 2644 - DNA, 780 bp, Streptococcus pneumoniae
atgccagtaatgaaaatcgagtattactcacaagtattggatatggagtgggggatgaatgtcctctaccctgatgccaatcgagtgagagaaccagagtgtgaagatattcccgtcttgtaccttttgcacgggatgtctggaaatcataatagttggcttaagcggaccaatgtagaacgcttgcttcgaggaactaatctcatcgttgttatgcccaataccagcaatggttggtacaccgatacccagtatggttttgactactacacggctctagcagaggaattgccacaggttctgaaacgcttcttccctaatatgactagcaagcgtgaaaagacctttatagctggtctttctatgggaggctacggctgtttcaaactggctcttgcgacaaatcgtttttctcatgcagctagtttttcaggtgccctcagctttcaaaacttttctcctgaaagtcaaaatctgggaagtccagcctactggagaggtgtttttggagagattagagactggacaactagtccctattctcttgaaagtctggctaaaaaatcggataaaaagaccaaactttgggcgtggtgtggcgaacaggatttcttgtacgaagccaataatctcgcagtgaaaaatctcaaaaaactaggttttgatgtgacctatagccatagcgctggaactcacgagtggtactactgggaaaaacaattggaagtttttttaacaactctaccaattgatttcaaattagaagagagactgacttag

SEQ ID NO: 2645 - DNA, 1662 bp, Streptococcus pneumoniae
atgagtaatatcagtttaacaacacttggtggtgtgcgtgagaatggaaaaaatatgtacattgctgaaattggagagtccatttttgttttgaatgtagggttaaaatatcctgaaaatgaacaattaggggtcgatgtggtgattccaaacatggattacctttttgaaaatagcgaccgtattgctggggttttcttgacccacgggcatgcggatgcgattggtgctctaccttatctcttggcagaggctaaagttcctgtatttgggtctgagttgaccattgagttggcaaagctctttgtcaaaggaaatgatgccgttaagaaatttaatgatttccatgtcattgatgagaatacggagattgattttggtgggacagtggtttccttcttccctacgacttactccgttccagagagtctgggaattgtcttgaagacatcggaaggaagcatcgtttatacaggtgacttcaaatttgaccaaacggctagtgaatcttatgcaactgattttgctcgtttggcagagattggtcgtgacggcgtcctggctctcctcagtgattcggccaatgcagacagcaatattcaggtggctagtgaaagtgaagttagggatgaaattacccaaactattgctgactgggaaggtcgtatcatcgttgcagctgtttccagtaatctttctcgtattcagcagatttttgacgctgcggataaaacaggtcgacgtatcgtcttgacaggatttgatattgaaaatatcgtccgcacagcgattcgtcttaagaagttgtctttagccaacgaaattctcttgattaagcctaaagatatgtctcgctttgaagaccatgagttgattattcttgagacaggtcgtatgggtgaacctatcaatggacttcgtaagatgtcgattggtcgccatcgttatgtagaaatcaaggatggggacctggtctatattgctacggctccgtctattgctaaagaagcctttgttgcgcgtgtagaaaatatgatttatcaggcaggtggggttgtcaaattgattacccaaagtttacatgtatcagggcacggaaatgtgcgtgatttgcagctgatgatcaatcttttgcaacctaagtacctcttccctgtccaaggggagtatcgtgagttggatgctcacgctaaggctgccatggcagttgggatgttgccagaacgcatcttcattcctaaaaaggggacgaccatggcttacgagaatggagactttgttccagctggatcggtttcagcaggagatatcttaattgatgggaatgccattggtgatgttggaaatgttgttcttcgtgaccgtaaggtcttgtcagaggatggaattttcatcgtggctattacagtcaaccgtcgtgagaagaaaattgtggctagagctcgtgttcacacgcgtggatttgtttatctcaagaagagtcgcgatattctccgtgaaagttcagaattgattaaccaaacggtagaagattatcttcaaggagatgactttgactgggcagatcttaaagggaaggttcgagataatttgaccaagtatctctttgaccaaaccaagcgtcgtccagctattttaccagtagtcatggaagcaaaataa

SEQ ID NO: 2646 - DNA, 1941 bp, Streptococcus pneumoniae
atgacttcggcttctattgtgaaggaaagtttggaacaacttggtgctgagtgccgagtttacctgccaaatcgttttaccgatggctatggccctaatgctagtgtttataaatactttatcgagcaagatagaatttccttgattgtgacggtggacaatggggttgctggtcatgaggctattgcattggctcagtctatgggagtagatgtcattgtgacagaccatcattccatgcctgaaaccctgccagatgcttatgctattgtccatcctgaacatccagatgcggattatccttttaaatatttggctggttgtggagttgctttcaagttggcttgtgccctgttagaagaagtgcaagtggaattgcttgatttggtcgctattggaactattgcagatatggtgagtctgacggatgaaaatcgtatcttagttcaatatggtctggaaatgttgggtcatacccagcgcattggtctgcaagaaatgctggacatggctgggattgctgccaacgaagtaacagaagaaacggttggtttccagattgctcctcgtttgaatgccttgggccgcttggatgatcccaatcctgccattgatttgttgactggatttgatgatgaggaagcgcatgagattgcccttatgattcaccagaaaaacgaagagcgcaaggaaatcgttcagtctatctatgaagaagccaagaccatggtggatcctgagaagaaggttcaggtcttggccaaggaaggctggaatcctggggttctaggaatcgtggctggtcgtttattggaagaattgggacagacagtcattgttcttaatataaaagacggtcgtgccaagggcagtgctcgtattgtggaaccggtcgatatttttgaagctctggatccccatcgagacctcttcatcgcctttggaggtcatgcaggtgcagcgggtatgacgctggaagttgagcaactctcagatttatctcaggttttggaagattatgttcgtgaaaaaggtgcagatgctggtggcaagaataagttaaacctagatgaagagttggatttggaggcacttagcttggaaacggtcaaaagttttgaacgtttagctccttttggaatggataatcagaaacctattttttatatcaagaattttcaggtcgaaagtgctcgtactatgggggcaggtaatgcccatctaaagctgaaaatttccaagggtgaggcgagttttgaagtggtagcctttggtcaaggcagatgggcgacagagttttctcaaaccaagaatctagagttagcggttaaattgtctgtcaaccaatggaatggccaaactgccctccagttgatgatggtggatgcgcgagtggaaggtgttcaactttttaacattcgtggaaaaaatgcagtcttgccagaaggtgttccagtcttggattttcctggagaactgccaaatcttgcggctagtgaagctattgtcgtaaaaaacattccagaggatattactcagctgaagaccatttttcaggaacagcatttctctgctgtctatttcaaaaatgatattgacaaggcctattatctgacaggttatgggactagagatcagtttgccaaattgtacaagactatttaccagttcccagagtttgatattcgctacaagctgaaagatttggctgcatatcttaatattcaacaaatcttgctggtcaagatgattcaagtatttgaagaactaggctttgtgacgataaaagatggtgtgatgacagtcaataaagaggcgccaaagcgggagataggagaaagtcaaatttaccaaaatctcaaacaaaccgttaaagaccaagaaatgatggcgctgggtacggtgcaagaaatttatgattttttgatggaaaaagagtag

SEQ ID NO: 2647 - DNA, 1980 bp, Streptococcus pneumoniae
gaaaatattctcgtttatggagactatgatgcggatggcatgacttcggcttctattgtgaaggaaagtttggaacaacttggtgctgagtgccgagtttacctgccaaatcgttttaccgatggctatggccctaatgctagtgtttataaatactttatcgagcaagatagaatttccttgattgtgacggtggacaatggggttgctggtcatgaggctattgcattggctcagtctatgggagtagatgtcattgtgacagaccatcattccatgcctgaaaccctgccagatgcttatgctattgtccatcctgaacatccagatgcggattatccttttaaatatttggctggttgtggagttgctttcaagttggcttgtgccctgttagaagaagtgcaagtggaattgcttgatttggtcgctattggaactattgcagatatggtgagtctgacggatgaaaatcgtatcttagttcaatatggtctggaaatgttgggtcatacccagcgcattggtctgcaagaaatgctggacatggctgggattgctgccaacgaagtaacagaagaaacggttggtttccagattgctcctcgtttgaatgccttgggccgcttggatgatcccaatcctgccattgatttgttgactggatttgatgatgaggaagcgcatgagattgcccttatgattcaccagaaaaacgaagagcgcaaggaaatcgttcagtctatctatgaagaagccaagaccatggtggatcctgagaagaaggttcaggtcttggccaaggaaggctggaatcctggggttctaggaatcgtggctggtcgtttattggaagaattgggacagacagtcattgttcttaatataaaagacggtcgtgccaagggcagtgctcgtattgtggaaccggtcgatatttttgaagctctggatccccatcgagacctcttcatcgcctttggaggtcatgcaggtgcagcgggtatgacgctggaagttgagcaactctcagatttatctcaggttttggaagattatgttcgtgaaaaaggtgcagatgctggtggcaagaataagttaaacctagatgaagagttggatttggaggcacttagcttggaaacggtcaaaagttttgaacgtttagctccttttggaatggataatcagaaacctattttttatatcaagaattttcaggtcgaaagtgctcgtactatgggggcaggtaatgcccatctaaagctgaaaatttccaagggtgaggcgagttttgaagtggtagcctttggtcaaggcagatgggcgacagagttttctcaaaccaagaatctagagttagcggttaaattgtctgtcaaccaatggaatggccaaactgccctccagttgatgatggtggatgcgcgagtggaaggtgttcaactttttaacattcgtggaaaaaatgcagtcttgccagaaggtgttccagtcttggattttcctggagaactgccaaatcttgcggctagtgaagctattgtcgtaaaaaacattccagaggatattactcagctgaagaccatttttcaggaacagcatttctctgctgtctatttcaaaaatgatattgacaaggcctattatctgacaggttatgggactagagatcagtttgccaaattgtacaagactatttaccagttcccagagtttgatattcgctacaagctgaaagatttggctgcatatcttaatattcaacaaatcttgctggtcaagatgattcaagtatttgaagaactaggctttgtgacgataaaagatggtgtgatgacagtcaataaagaggcgccaaagcgggagataggagaaagtcaaatttaccaaaatctcaaacaaaccgttaaagaccaagaaatgatggcgctgggtacggtgcaagaaatttatgattttttgatggaaaaagagtag

SEQ ID NO: 2648 - DNA, 759 bp, Streptococcus pneumoniae
atggctttagtagaatttaaaaacgtcgaaaaatattacggagactaccacgcactccgcaacatcaatctccgttttgaaaaaggacaagttgttgtcctgcttggaccttctggctctgggaagtccactcttatccgtacgatcaatggtttagagactgttgacaaaggaagtctcctagtcaatgggcaccaagttgctggtgccagccagaaagatttggtacctcttcgcaaggaagtcggcatggtttttcaacattttaacatttatccacacaaaactgtgttagaaaacgtaacacttgcacccattaaagttctaggaattgataaaaaagaagctgaaaaaaccgcccaaaaatatctggaatttgtaaatgtgtgggacaagaaagattcctatcccgccatgctatctggtggacaaaaacagcggatcgccatcgctcgtggtcttgctatgcatccggaactcctcctctttgatgaaccaacatctgctcttgatcctgagactatcggagatgttctagcagttatgcagaaactggcgcatgatgggatgaacatgatcatcgttacccacgaaatgggctttgctcgagaggttgcggaccgcattatctttatggccgacggagaagttttagtagatacgacagatgtcgataacttttttgacaatccaagcaaacctcgtgcccaacaattcctcagcaaaattatcaaccacgaaagtgacaaagtcaaataa

SEQ ID NO: 2649 - DNA, 195 bp, Streptococcus pneumoniae
ttgcgaagaggtaccaaatctttctggctggcaccagcaacttggtgcccattgactaggagacttcctttgtcaacagtctctaaaccattgatcgtacggataagagtggacttcccagagccagaaggtccaagcaggacaacaacttgtcctttttcaaaacggagattgatgttgcggagtgcgtggtag

SEQ ID NO: 2650 - DNA, 219 bp, Streptococcus pneumoniae
atgcggtccgcaacctctcgagcaaagcccatttcgtgggtaacgatgatcatgttcatcccatcatgcgccagtttctgcataactgctagaacatctccgatagtctcaggatcaagagcagatgttggttcatcaaagaggaggagttccggatgcatagcaagaccacgagcgatggcgatccgctgtttttgtccaccagatagcatggcggga

SEQ ID NO: 2651 - DNA, 795 bp, Streptococcus pneumoniae
atgaaaaaaaaattctttttatcagcattattgattagccttttcggccttgctgctgccaaaccagtccaggctgatactagtatcgcagacattcaaaaaagaggcgaactggttgtcggtgtcaaacaagacgttcccaattttggttacaaagatcccaagaccggtacttattctggtatcgaaaccgacttggccaagatggtagctgatgaactcaaggtcaagattcgctatgtgccggttacagcacaaacccgcggcccccttctagacaatgaacaggtcgatatggatatcgcgacctttaccatcacggacgaacgcaaaaaactctacaacttcaccagtccctactacacagacgcttctggatttttggtcaataaatctgccaaaatcaaaaagattgaggacctaaacggcaaaaccatcggagtcgcccaaggttctatcacccaacgcctgattactgaactgggtaaaaagaaaggtctgaagtttaaattcgtcgaacttggttcctacccagaattgattacttccctgcacgctcatcgtatcgatgccttttccgttgaccactctattctatctggctacactagtaaacggacagcactactagatgatagtttcaagccatctgactacagtattgttaccaagaaatcaaatacagagctcaacgactatcttgataacttggttactaaatggagcaaggatggtagtttgcagaaactttatgaccgttacaagctcaaaccatctagtcataccgcagattaa

SEQ ID NO: 2652 - DNA, 678 bp, Streptococcus pneumoniae
atgacagatttatcatcttggacagcctattttcaggattttggacaatttttcaatggtttcctctttactcttgccctagcgattggatcctttatcctcgccatggtcttaggaatcttctttggtgccatgtcaaccagtaaacgtccaattttacgcattttagctcgcatcttcgtggaattttaccaaaacactcccctcttggtgcagtttgttattgttttttatggcctacctcttatcagtgaccacatcatcatgattccaatttattggacagccgttctctgcgtgggactctatcacggcgcttatatcgctgaggttattcgttcagggattcagtctattcctagtggtcagatggaggccgccttgtcgcaaggttttacctatatcagtgccatgcgcttgattatcttgcctcaggccttccgcatcattctccctccattgaccaaccaaattgttaacctcatcaagaacacatctactgtagctatcatctctggagtagacttgatgtttgtgactaagtcttggtcggctctcaacggaaactatatcccagcctttttaggtgctgctcttctctactttgccctatgcttccctgttgcccagtttggtcgcaagatggagcaagccaataaaaaagcctattcactttag

SEQ ID NO: 2653 - DNA, 660 bp, Streptococcus pneumoniae
atggaatctattttagaaattttaaccccagataacctagtctttatctttaaaggatttggcttgaccctctatatttctctgattgccatcatcctctctactatcatcggtaccgtgcttgccgtcatgcgaaatggaaaaaatcctatcttacgcattatttccagtatttatatcgagtttgtgcgcaacgttcccaaccttctctggatttttactatctttttggtgttcaaaatgaaatccacaccagcaggtattacagcctttactctctttacatcagcagccttggctgagattattcgaggcggtctcaatgccgtagacaagggacaatacgaagcaggaatgtcacaaggcttcacctcagcccaaatcctctactacatcattctcccacaagccatccgcaaaatgctaccagccatcatttctcagtttgttaccgtgattaaggataccagtctcctctactctgttatcgccctacaagaactctttggagccagccaaattctcatgggccgttatttcgaaccagagcaggtcttcagtctttacatcctgattgccctcatctacttcagctttaacctagcaatttctaacctgtctcatatgctagcaaaacgttggcaacaagctgcagaataa

SEQ ID NO: 2654 - DNA, 1203 bp, Streptococcus pneumoniae
atggaattttctatgaaatcagtcaaaggactactctttatcatagctagttttatcttgactcttttgacttggatgaacacttctccccaattcatgattccaggactagctttaacaagcctatctctgacttttatcctagccactcgtctcccactactagaaagctggtttcacggtttggagaaggtctacaccgtccacaaattcacagcctttctctccatcatcctactaatctttcataactttagtatgggcggtttgtggggctctcgcttagctgctcagtttggtaatcttgccatctatatctttgccagcatcatccttgtcgcctatttaggcaaatacatccaatacgaagcttggcgatggattcaccgcctggtttacctagcctatattttaggactctttcacatctacatgataatgggcaatcgtctccttacatttaatcttctaagttttcttgttggtagctatgcccttttaggcttactagctggtttttatatcatttttctatatcaaaagatttccttcccctatctagggaaaattacccatctcaaacgcttaaatcacgatactagagaaattcaaatccatcttagcagacctttcaactatcaatcaggacaatttgcctttctaaagattttccaagaaggctttgaaagtgctccacatcccttttctatctcaggaggtcatggtcaaactctttactttactgttaaaaattcaggcgaccataccaagaatatctatgataatcttcaagccggcagcaaagtaaccctagacagagcttacggacacatgatcatagaagaaggacgagaaaatcaggtttggattgctggaggtattgggatcacccccttcatctcttacatccgtgaacatcctattttagataaacgggttcacttctactatagcttccgtggagaagaaaatgcagtctaccttgatttactccgtgactatgctcagaaaaatcctaattttgaactccatctaatcgacagtacaaaagacggctatcttaattttgaacaaaaagaagtgcccgaacatgcaaccgtctatatgtgtggtcctatttctatgatgaaggcacttgccaaacagattaagaaacaaaatccaaaaacggagcttatttacgaaggattcaagttcaaataa

SEQ ID NO: 2655 - DNA, 882 bp, Streptococcus pneumoniae
atggcaatcgtttcagcagaaaaatttgtccaagcagcccgtgacaacggttatgcagttggtggatttaacacaaacaatcttgagtggactcaagctatcttgcgcgcagcagaagctaaaaaagctccagttttgatccaaacttcaatgggtgctgctaaatacatgggtggttacaaagttgctcgcaacttgatcgctaaccttgttgaatcaatgggtatcactgtaccagtagctatccaccttgaccacggtcactacgaagatgcacttgagtgtatcgaagttggttatacttcaatcatgtttgacggttcacaccttccagttgaagaaaatcttaaattggctaaagaagttgttgaaaaagcacacgctaaaggtatctcagtagaagctgaagttggtactatcggtggtgaagaagacggaatcatcggtaaaggtgaattggctccaatcgaagacgctaaagcaatggttgaaactggtatcgacttcttggcagctggtatcggtaacatccacggtccttacccagtaaactgggaaggtcttgaccttgaccacttgcaaaaattgacagaagctcttccaggattcccaatcgtattgcacggtggatcaggtattcctgatgagcaaatccaagcagctatcaaacttggtgttgccaaagttaacgttaacacagaatgccaaatcgcattcgctaacgcaactcgtaaatttgctcgtgactacgaagcaaacgaagcagaatacgacaagaaaaaactcttcgacccacgtaaattcttggctgacggtgtaaaagctatccaagcatcggttgaagaacgtatcgacgtattcggttcagaaggtaaagcataa

SEQ ID NO: 2656 - DNA, 1329 bp, Streptococcus pneumoniae
atgaaacgaacaggtttatttgcaaagatatttatctataccttctcgatatttagtgttctggttatctgccttcatttagctatttattttctttttccttcgacttatctgagtcatcgtcaggaaaccattggtcaaaaggcaacagccattgcccagtccctagaagggaaagataggcagagtatcgagcaagtgttagacttgtattcccagactagtgatatcaaggggaccgtcaaaggtgagatgaccgaggacaagttagaagtcaaggacagtcttcctctggacacagaccgccagacaacctctctctttattgaggagcgcgaggtgaaaacgcaagacggtggtactatgattctccagtttctagcttccatggatttacaaaaggaagcggagcaaatcagtctccagtttcttccctataccttgctggcctcctttctgatttccctcttggtggcctacatctacgctcggactattgttgcaccgattttggaaatcaagcgggtgacccgtcggatgatggacctggattcccaagtgcgattgcgcgtggattctaaggatgagataggtaatctcaaggaacaaatcaatagcctttaccagcatctcttgactgttattgcggacttgcatgaaaagaatgaagccattctccagctggagaagatgaaggtcgaattcctacgaggagcttctcatgaattgaaaacaccgctggctagtttgaaaatcctaatcgaaaatatgagagagaatatcggtcgttataaggatagagaccagtatctgggagttgccttggggattgtggatgaactcaatcaccatgttctgcagatactttccctctcttctgtgcaggaattgcgagatgatagggaaacaattgacctcctccagatgacgcaaaatctggtcaaagattatgccttgctagccaaggaaagagagctccagatagacaatagtttgacccatcagcaggcttatctaaacccatcagttatgaagttgattctttctaatctcatcagcaatgccattaagcactctgttccaggtggcttagttcgaattggagaaagagaaggagaactttttatcgaaaatagctgtagctcagaggaacaagaaaaactagcccagtctttttctgacaatgctagtcgcaaggtcaaggggtctggtatggggctctttgtggttaagagtctattagaacatgaaaaattagcttatcgtttcgagatggaggagaatcgtttaaccttctttatagattttccaaaagtcgcccaagactag

SEQ ID NO: 2657 - DNA, 657 bp, Streptococcus pneumoniae
atgaaaattttaattgtagaagatgaagagatgatccgtgagggggtcagtgattatttgacggattgtggctatgaaactattgaggcagcggacggtcaggaagctctggagcaattttctagctatgaggtggccctggttttactggatatccagatgcccaagcttaacggcttagaagttctagctgagattcgtaaaaccagtcaggttcctgtcttgatgttgacagcttttcaggatgaggaatacaagatgagtgcctttgcctctttggcagatggctatctggaaaaacctttctccctctccctcttaaaagtgagggtggacgcgattttcaagcgctactacgatacaggacgaatcttttcttacaaggataccaaggtggactttgaaagctacagtgcaagcctcgcaggtcaagaagtgcctatcaatgccaaagagttggaaattctggactatctagtgaaaaatgaaggccgggccttgactcggtctcagattatcgatgccgtctggaaagcgacagatgaggttccctttgaccgtgttattgatgtttatatcaaggaattgcggaaaaagctagacttggattgtatcctcactgtgcgcaatgttggttataaattggagcgaaaatga

SEQ ID NO: 2658 - DNA, 1380 bp, Streptococcus pneumoniae
atgttacacaacgcatttgcctatgttacaaggaagtttttcaaatcgattgtcatcttcctgattattctcctcatggcgagcttgagtttggtcggcttgtcaatcaagggagctactgccaaggcttctcaggagacctttaaaaatatcaccaatagcttctccatgcaaatcaatcgtcgcgtcaaccaaggaacgcctcgcggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaaacgttttggaagtagcttgatgattacaggtgtcaatgactcctctaaagaagacaagtttgtctctggttcttataaactagtcgaaggagagcacttaaccaacgacgacaaggataaaatcctcttgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacagctattacagacattcacactgctgcaaaactttatggatacacagaagacacagccatttatggggacgcaaccttctttgtaacagcagacaagaacttggatgatgttatgaaagagttgaatggcatcagtggtatcaactggaagagctacacactcgtcaagagctcctctaactacccagctcttgagcaatctatatctggtatgtacaagatggccaacctcctcttctggggtagtttgagcttctcagttctcctccttgccctcttgctcagcctttggatcaacgcccgtcgcaaggaagtgggaattctcctctctatcggcctcaagcaggcaagtatcttgggtcaattcatcaccgaatctatcttgattgctatccctgctctagtttctgcttacttcctagctaattacactgcccgtgcaattggaaacactgtccttgccaatgtgacttcaggtgttgccaaacaggctagtaaggcggctcaagcctctaaccttggtggtggtgcagaagtagatggctttagcaagaccttgtcgagcctagacatttctattcagacatcagactttatcatcatttttgtccttgccttggttctagtggttctcgttatggcgcttgcttcaagcaatctccttagaaaacaaccaaaagagctcttgctggatggtgaataa

SEQ ID NO: 2659 - DNA, 648 bp, Streptococcus pneumoniae
atgactttattacaattacaagatgttacctaccgttataagaatactgctgaagcagtcctatatcagatcgattataattttgaacccggaaaattttacagtattattggggaatcaggagcaggaaaatccacactcttgtccctacttgctggtctagatagtcctgttgaaggttctatcctttttcaaggagaggatattcgtaagaagggctattcttaccatcgcatgcaccatatttccctggtctttcaaaattataacttgatagattatctttctccgctggaaaatatccgcttggtcaacaaaaaggcaagcaagaatacacttcttgagcttggtttggatgaaagccagatcaagcggaatgttctccagttatcaggtggtcaacagcaacgtgttgccattgctcgcagtttggtctcagaagctccagttattctagctgatgagccaacaggaaatctggatcctaaaactgctggagatattgtcgaactactcaaatcacttgcccagaaaacaggtaaatgtgtgattgtcgtaactcacagtaaagaagtggcacaagcgtcagatattacacttgaattaaaggataagaaactgactgaaacgcgcaatactagtaaataa

SEQ ID NO: 2660 - DNA, 1278 bp, Streptococcus pneumoniae
atgaatccaatccaaagatcttgggcttatgtcagcagaaagcgactgagaagttttattttatttctgattttattggtcttattggccggaatttcagcctgtttgactctgatgaagtccaacaaaacagtagaaagcaatctttataaatcactcaatacatctttttctattaagaagatagagaatggtcagacattcaagttgtcagacctagcatctgtaagcaagattaaggggctggaaaatgtctctcctgaacttgagacggtcgcaaaactaaaagacaaggaagcagtgactggcgagcagagcgtggagcgtgatgatttatcagctgcagacaataacttggttagcttaacggctcttgaggattcatccaaggatgtaacctttaccagttcggctttcaatctaaaagaagggcgacaccttcaaaaaggggattccaagaaaatccttatccacgaagaattggctaagaagaacggtctttcacttcatgacaagattggcttggatgctggtcagtctgaatctggaaaaggacaaacagtagagtttgagattattggcatcttttctggtaaaaaacaagagaaattcacaggcttgtcttctgacttcagtgaaaatcaagtctttacagactatgaaagtagccaaacccttttgggcaatagtgaagctcaagtcagtgcagcacgcttctatgtagaaaatcctaaggaaatggacggactcatgaagcaggtagaaaacttggccttggaaaatcaaggctaccaagtcgaaaaggaaaacaaggcttttgaacaaatcaaagactcagttgcaactttccaaaccttcctgaccatcttcctttatgggatgttgatagcaggagctggagccttaattctggttttgtctctctggttgagagaacgggtctatgaagtggggattttacttgcacttggaaaaggcaagagctcgatcttcctacaattctgtttagaggtagttttggtatctcttggagctttgcttccagcatttgttgcaggaaatggaatcacaacttacctactccaaactctactagcaagtggagatcaggcaagcttacaagatacactagccaaagcaagcagtttatcaactagcatcttatcttttgcagaatcctatgtttttctagttctgcttagttgcttatctgtagccctttgtttcctattcttatttagaaaatcaccgaaagaaattttatcatctattagttaa

SEQ ID NO: 2661 - DNA, 255 bp, Streptococcus pneumoniae
gaggggctagagattatcccctactcgatatttttttttttcgtatttcataaacatttcatatttgggttttataatagtcttacaaatatggaggtgacaaatgaatccaatccaaagatcttgggcttatgtcagcagaaagcgactgagaagttttattttatttctgattttattggtcttattggccggaatttcagcctgtttgactctgatgaagtccaacaaaacagtagaaagcaatctttataa

SEQ ID NO: 2662 - protein, 110 aa, Streptococcus pneumoniae
LKHHYQIYQLLLFHFQNKDPEKFFGLIEDTLKQVHPIFQTVFKTFLKNKEKIVNALQLPYSNAKLEATNNLIKLIKRNAFGFRNFENFKKRIFIALNIKKERTNFVLSRA

SEQ ID NO: 2663 - protein, 172 aa, Streptococcus pneumoniae
MEQLHFITKLLDIKDPNIQILDIINKDTHKEIIAKLDYDAPSCPECGNQLKKYDFQKPSKIPYLETTGMPTRILLRKRRFKCYHCSKMMVAETSIVKNNHQIPRIINQKIAQKLIEKISMTDIAHQLSISTSTVIRKLNDFHFKHDFSCLPEIMSWDVETVRGVTVSIGRWR

SEQ ID NO: 2664 - protein, 108 aa, Streptococcus pneumoniae
NSPGSDCFNREMEMSFIAQDFNNLNIITVLEGRTQAIIRNHFLRYDRAVRCRVKIITMDMFSPYYGLAKQLRFQISRLRLKQSPRLFHSRMLKSFLIAFTLCNILAVL

SEQ ID NO: 2665 - protein, 189 aa, Streptococcus pneumoniae
VLDRFHIVQHLSRAMSRVRVQIMNQFHRKSHEYKAIKRYWKLIQQDSRKLSDKRFYRPTFRMHLTNKEILDKLLSYSQDLKHHYQLYQLLLFHFQNKEPEKFFGLIEDNLKQVHPLFQTVFKTFLKDKEKIVNALQLHYSNAKLEATNNLIKLIKRNAFGFRNFENFKKRIFIALNIKKERTKFVLSRA

SEQ ID NO: 2666 - protein, 121 aa, Streptococcus pneumoniae
VHLLKYCQVSMDLFTYHKFHTNGLKIQKKLLKLVKKFKLKFLKLTQMQNACHFLLKLLKNVQPKKKDKKKKNVLLVHVVQDVKKSVISNFQKHKQDFQWLICLVISNFNQIENSQNPLFTK

SEQ ID NO: 2667 - protein, 400 aa, Streptococcus pneumoniae
MNEFEDLLNSVSQVETGDVVSAEVLTVDATQANVAISGTGVEGVLTLRELTNDRDADINDFVKVGEVLDVLVLRQVVGKDTDTVTYLVSKKRLEARKAWDKLVGREEEVVTVKGTRAVKGGLSVEFEGVRGFIPASMLDTRFVRNAERFVGQEFDTKIKEVNAKENRFILSRREVVEAATAAARAEVFGKLAVGDVVTGKVARITSFGAFIDLGGVDGLVHLTELSHERNVSPKSVVTVGEEIEVKILDLNEEEGRVSLSLKATVPGPWDGVEQKLAKGDVVEGTVKRLTDFGAFVEVLPGIDGLVHVSQISHKRIENPKEALKVGQEVQVKVLEVNADAERVSLSIKALEERPAQEEGQKEEKRAARPRRPRRQEKRDFELPETQTGFSMADLFGDIEL

SEQ ID NO: 2668 - protein, 78 aa, Streptococcus pneumoniae
NTLRYFAFYLDYYLRTGVAGFEPTHEGVKVPCLTAWLYPINEMEREGFEPPNPKERIYSPPRLASSLSLLQSTWTIIS

SEQ ID NO: 2669 - protein, 76 aa, Streptococcus pneumoniae
MSKKDKKIEIQVADAKVNVGKDSFEGYTLTIGKKVIGEIAELDGQFAIIKNGNVDSFYKKLEKAVEILIENYNLAK

SEQ ID NO: 2670 - protein, 214 aa, Streptococcus pneumoniae
MKILVTGFNPFGGEKINPALEAVKLLPSEINGAEVRWVEIPTVFYKSSEVLEAEILRYQPDAVLCIGQAGGRTGLTPERVAINQDDARIPDNEGNQPIDTPIRIDGASAYFSSLPIKAMVQAIKKQGLPAVVSNSAGTFVCNHLMYQALYLVDKKFPNMRAGFMHIPYMMEQVVNKPNTAGMSLCDIVRGIEVAIEAIVDYKDKDLQLVGGETH

SEQ ID NO: 2671 - protein, 307 aa, Streptococcus pneumoniae
MTELAKQLLELTYIVIGCQFLHTAYCSYKDKTNPVRLGTSAFWTLLSITFIGGSYMPNMSIGIIVILLSLLTLFKQVRIGTLPSLDEMKANIESNRLKNKIFIPVMLMAILALVLAQMIPEFSKISISLAALFATISVLVITNSHPKSLLSENNRMTQQVSTSGIVPQLLGALGAIFTVAGVGDVISHLISGIVPSDSRFIGVLAYVLGMVLFTMIMGNAFAAFTVITAGVGVPFVFALGANPIVAGALAMTAGYCGTLLTPMAANFNALPAALMDMKDQNGVIKAQAGVALVMIVIHIFLMYFLAF

SEQ ID NO: 2672 - protein, 236 aa, Streptococcus pneumoniae
LNIKEFDMEWIRLIGIAIIVVGFILKFDTIATVVLAGLVTALVSGVSLVEFLEILGKEFSNQRVLTIFMVTLPLVGLSETFGLKQRSIDLIRKIKGLTVGNFYTVYFFIRELAGFFSIRLGGHPQFVRPLVQPMGEAAAESQLGRKLTEVEDETIKARAAANENFGNFFAQNTFVGAGGVLLIGGTLDQLGYESNYAGIASTSIIVAVITLIVVGIYNYLFDKKLISKKTRGGEQK

SEQ ID NO: 2673 - protein, 234 aa, Streptococcus pneumoniae
VVLSTSAILVACGKTDKEADAPTTFSYVYAVDPASLGYSIATRTSRTDVIGNVIDGLMENDKYGNVAPSQKDYDLNSTGWAPSYQDPASYLNIMDPKSGSAMKHLGITKGKDKDVVAKPGLDKYKKLLEDAVSEITDLEKRYEKYAKAQAWSTDSSLLMPTASSGGFPVVSNVVPFSKPYSQVGIKGEPYIFKGMKLQKDIVTTKEYNEVFKKWQKEKLESNSKYQKELEKYIK

SEQ ID NO: 2674 - protein, 340 aa, Streptococcus pneumoniae
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPPYGTGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 2675 - protein, 823 aa, Streptococcus pneumoniae
MSNIQNMSLEDIMGERFGRYSKYIIQDRALPDIRDGLKPVQRRILYSMNKDSNTFDKSYRKSAKSVGNIMGNFHPHGDSSIYDAMVRMSQNWKNREILVEMHGNNGSMDGDPPAAMRYTEARLSEIAGYLLQDIEKKTVPFAWNFDDTEKEPTVLPAAFPNLLVNGSTGISAGYATDIPPHNLAEVIDAAVYMIDHPTAKIDKLMEFLPGPDFPTGAIIQGRDEIKKAYETGKGRVVVRSKTEIEKLKGGKEQIVITEIPYEINKANLVKKIDDVRVNNKVAGIAEVRDESDRDGLRIAIELKKDANTELVLNYLFKYTDLQINYNFNMVAIDNFTPRQVGIVPILSSYIAHRREVILARSRFDKEKAEKRLHIVEGLIRVISILDEVIALIRASENKADAKENLKVSYDFTEEQAEAIVTLQLYRLTNTDVVVLQEEEAELREKIAMLAAIIGDERTMYNLMKKELREVKKKFATPRLSSLEDTAKAIEIDTASLIAEEDTYVSVTKAGYIKRTSPRSFAASTLEEIGKRDDDRLIFVQSAKTTQHLLMFTSLGNVIYRPIHELADIRWKDIGEHLSQTITNFETNEEILYVEVLDQFDDATTYFAVTRLGQIKRVERKEFTPWRTYRSKSVKYAKLKDDTDQIVAVAPIKLDDVVLVSQNGYALRFNIEEVPVVGAKAAGVKAMNLKEDDVLQSGFICNTSSFYLLTQRGSLKRVSIEEILATSRAKRGLQVLRELKNKPHRVFLAGAVAEQGFVGDFFSTEVDVNDQTLLVQSNKGTIYESRLQDLNLSERTSNGSFISDTISDEEVFDAYLQEVVTEDK

SEQ ID NO: 2676 - protein, 647 aa, Streptococcus pneumoniae
VSKKEININNYNDDAIQVLEGLDAVRKRPGMYIGSTDGAGLHHLVWEIVDNAVDEALSGFGDRIDVTINKDGSLTVQDHGRGMPTGMHAMGIPTVEVIFTILHAGGKFGQGGYKTSGGLHGVGSSVVNALSSWLEVEITRDGAVYKQRFENGGKPVTTLKKIGTAPKSKTGTKVTFMPDATIFSTTDFKYNTISERLNESAFLLKNVTLSLTDKRTDEAIEFHYENGVQDFVSYLNEDKEILTPVLYFEGEDNGFQVEVALQYNDGFSDNILSFVNNVRTKDGGTHETGLKSAITKVMNDYARKTGLLKEKDKNLEGSDYREGLAAVLSILVPEEHLQFEGQTKDKLGSPLARPVVDGIVADKLTFFLMENGELASNLIRKAIKARDAREAARKARDESRNGKKNKKDKGLLSGKLTPAQSKNPAKNELYLVEGDSAGGSAKQGRDRKFQAILPLRGKVINTAKAKMADILKNEEINTMIYTIGAGVGADFSIEDANYDKIIIMTDADTDGAHIQTLLLTFFYRYMRPLVEAGHVYIALPPLYKMSKGKGKKEEVAYAWTDGELEELRKQFGKGATLQRYKGLGEMNADQLWETTMNPETRTLIRVTIEDLARAERRVNVLMGDKVEPRRKWIEDNVKFTLEEATVF

SEQ ID NO: 2677 - protein, 213 aa, Streptococcus pneumoniae
MITIVLLILAYLLGSIPSGLWIGQVFFQINLREHGSGNTGTTNTFRILGKKAGMATFVIDFFKGTLATLLPIIFHLQGVSPLIFGLLAVIGHTFPIFAGFKGGKAVATSAGVIFGFAPIFCLYLAIIFFGALYLGSMISLSSVTASIAAVIGVLLFPLFGFILSNYDFLFIAIILALASLIIIRHKDNIARIKNKTENLVPWGLNLTHQDPKK

SEQ ID NO: 2678 - protein, 409 aa, Streptococcus pneumoniae
MGQLHFITKLLDIKDTNIQIIDVVNRDSHKEIIAKLDYDAPSCPGCGNQLKKYDFQKPSKIPYLETTGMPTRILLRKRRFKCYQCSKIAVAETSLVKKNHQIPRIINQKIAQKLIEKISMTDIAHQLSISTSTVIRKLNDFHFKHDFSCLPEIMSWDEYAFTKGKMSFIAQDFNNLNIITVLEGRTQAIIRNHFLRYDRVVRCRVKIITMDMFSPYYGLAKQLRFHIVQHLSCAMSRVRVQIMNQFHRKSHEYKAIKRYWKLIQQDSRKLSDKRFYRPTFRIHLTNKEILDKLLSYSQDLKHHYQLYQLLLFHFQNKEPEKFFGLIEDNLKQVHPIFQTVFKTFLKDKEKIVNALQLHYSNVKLEATNNLIKLIKRNAFGFRNFENFKKRIFIALNIKKERTKFVLSRA

SEQ ID NO: 2679 - protein, 277 aa, Streptococcus pneumoniae
MTEFLLVLLLKSIKLARWTYYYHLKQLDKTDKDQELKAEIQSIFIEHKGNYAYRRVHLELRNRAYLVNHKRVQGLIKVLNLQAKMRQKRKYSSHKGDVGKKAENLIQGQFEGSKTMEKCYTDVTEFAIPASTQKLYLSPVLDGFNSEIIAFNLSCSPNLEQVQTMLEQAFKEKHYENTILHSDQGWQYQHDSYHRFLESKGIQASMSRKGNSPDNGMMESFFGILKSEMFYGYEKSFQSFKQLEQAIIDYIDYYNNKRIKVKLKGLIPVQYRTKSFG

SEQ ID NO: 2680 - protein, 190 aa, Streptococcus pneumoniae
MNCTPKVRQKKSNFWGVFIMKLTYDDKVQIYELRKQGYSLEKLSNKFGINNSNIRYMIKLIDRYGIEFVKKGKNRYYSPDLKQEMIHKVLHEGWTKDRVSLEYGLPSRTILLNWLAQYRKNGYTIVEKTRGRVPKMGRKPKTRPEERTELERLQAENEYLRAEKAILKKLRELRLKEEKEKEERQKLFKN

SEQ ID NO: 2681 - protein, 33 aa, Streptococcus pneumoniae
MIKLIDRYGIEFGKKGKNRYYSPDLKQEMIYKV

SEQ ID NO: 2682 - protein, 318 aa, Streptococcus pneumoniae
MSIITLLPLLVSSMLIYSAPLIFTSIGGVFSERGGVVNVGLEGIMVMGAFSGVVFNLEFAEQFGAATPWLSLLVAGLVGSVFSIIHAAATVHFRADHVVSGTVLNLMAPALAVFLVKVLYNKGQTDNLSQTFGRFDFPVLANIPVIGDIFFKSTSLLGYLAIAFSFLAWFILFKTQFGLRLRSVGEHPQAADTLGINVYKMRYLGIIISGFLGGIGGAIYAQSISVNFSVTTIVGPGFIALAAMIFGKWNPIGAMLSSLFFGLSQSLAVIGSQLPFLQGVPAVYLQIAPYVLTILVLAAFFGKAVAPKADGINYIKSK

SEQ ID NO: 2683 - protein, 361 aa, Streptococcus pneumoniae
VETWERRRVMSKKLQQISVPLISVFLGILLGAIVMWIFGYDAIWGYEELFYTAFGSLRGIGEIFRAMGPLVLIGLGFAVASRAGFFNVGLPGQALAGWILSGWFALSHPDMPRPLMILATIVIALIAGGIVGAIPGILRAYLGTSEVIVTIMMNYIVLYVGNAFIHAFPKDFMQSTDSTIRVGANATYQTPWLAELTGNSRMNIGIFFAIIAVAVIWFMLKKTTLGFEIRAVGLNPHASEYAGISAKRTIILSMIISGALAGLGGSVEGLGTFQNVYVQGSSLAIGFNGMAVSLLAANSPIGILFAAFLFGVLQVGAPGMNAAQVPSELVSIVTASIIFFVSVHYLIERFVKPKKQVKGGK

SEQ ID NO: 2684 - protein, 511 aa, Streptococcus pneumoniae
MAHENVIEMRDITKVFGGFVANDKINLHLRKGEIHALLGENGAGKSTLMNMLAGLLEPTSGEIAVNGQVVNLDSPSKAASLGIGMVHQHFMLVEAFTVAENIILGSELTKNGVLDIAGASKEIKALSERYGLAVDPSAKVADISVGAQQRVEILKTLYRGADILIFDEPTAVLTPSEIDELMAIMKNLVKEGKSIILITHKLDEIRAVSDRVTVIRRGKSIETVEIAGATNADLAEMMVGRSVSFKTEKQASKPKEVVLSIKDLVVNENRGVPAVKNLSLDVRAGEIVGIAGIDGNGQSELIQAITGLRKVESGSIELKGDSIVGLHPRQITELSVGHVPEDRHRDGLILEMMISENIALQTYYKEPHSKNGILNYSNITSYAKKLMEEFDVRAASELVPAAALSGGNQQKAIIAREIDRDPDLLIVSQPTRGLDVGAIEYIHKRLIEERDNGKAVLVVSFELDEILNVSDRIAVIHDGKIQGIVSPETTNKQGLGVLMAGGNLGKEKSDV

SEQ ID NO: 2685 - protein, 139 aa, Streptococcus pneumoniae
PFPSIPAIPTISPARTSKDRFLTAGTPRFSLTTKSLIDKTTSFGLEACFSVLKETERPTIISAKSALVAPAISTVSIDFPRRITVTRSETARISSNLWVIKIIDFPSLTRFFIIAINSSISDGVKTAVGSSKIRISAPL

SEQ ID NO: 2686 - protein, 363 aa, Streptococcus pneumoniae
LQHRCTSYLGGSVMNKKQWLGLGLVAVAAVGLAACGNRSSRNAASSSDVKTKAAIVTDTGGVDDKSFNQSAWEGLQAWGKEHNLSKDNGFTYFQSTSEADYANNLQQAAGSYNLIFGVGFALHNAVEEAAKEHTDLNYVLIDDVIKDQKNVASVTFADNESGYLAGVAAAKTTKTKQVGFVGGIESEVISRFEAGFKAGVASVDPSIKVQVDYAGSFGDAAKGKTIAAAQYAAGADIVYQVAGGTGAGVFAEAKSLNESRPENEKVWVIGVDRDQEAEGKYTSKDGKESNFVLVSTLKQVGTTVKDISNKAEKGEFPGGQVIVYSLKDKGVDLAVTNLSEEGKKAVEDAKAKILDGSVKVPEK

SEQ ID NO: 2687 - protein, 129 aa, Streptococcus pneumoniae
MATTELIELAIETSKHAYVPYSHFPIGAVLVAKDGNVYTGVNIENVSYPLTNCGERTAIFKAISEGQREFSELIVYGQTEKPISPCGACRQVMVEFFEQDLKVTLVAKDKSTVEMTVGELLPYSFTDLN

SEQ ID NO: 2688 - protein, 99 aa, Streptococcus pneumoniae
KSLLQACLLTDQEKIVVCQLAQKAGADFVNTSTGFSTGGATIADVRLMRETVGSDMGVKAAGGARSYADALAFVEAGATRIGTSAGVAILKGELADGDY

SEQ ID NO: 2689 - protein, 60 aa, Streptococcus pneumoniae
LTPISDPTVSRINLTSAIVAPPVEKPVDVLTKSAPAFWANWQTTIFSWSVRRQACNNDFH

SEQ ID NO: 2690 - protein, 118 aa, Streptococcus pneumoniae
MKLNKYIDHTLLEQDAKKEQIDSLLSEAREYDFASVCVNPTWVEHAKKGLEGTDVKVCTVVGFPLGATTSAVKAFETKEAIQNGADEIDMVINVGALKSGNLALVESDIRAVVEASGA

SEQ ID NO: 2691 - protein, 425 aa, Streptococcus pneumoniae
MRAVDLIQKKRDGQELTSSEIEWLVEGYVSGTVPDYQMSAFAMAVYFKGMTTREISDLTMNMVKTGQEFDLSAIDGVKVDKHSTGGVGDKVTLILAPLVASFGVPVAKMSGRGLGHTGGTIDKLESIKGYQVERSQEDFIRQVQDIGVSVIGQSDQLVKADKLLYALRDVTATVDTIPLIASSVMSKKIAAGADAILLDVTVGEGAFMKTVDEARELAQTMVDLGKVVGRKTVAVITDMSQPLGRAIGNRLEILEALEILQGQGRQDITHFICELAQIMLGLANVNKTVEEVHQHLENGQALAKFEEMVQAQGGDLEDLYRPVNVAHVVEIPAQETGVISALPAMDFGLYAMRLGAGRAVKSDVLDYETGIVFEKKIGDSVQKGEIVAKVYTNEKIPPQLVTDFQKCVKISDEVKKIREIVEIIS

SEQ ID NO: 2692 - protein, 196 aa, Streptococcus pneumoniae
MSKMYYAENPDAAHDIHELRVDLLGQKMTFLTDAGVFSKKIVDFGSQLLLKCLEVNQGETVLDVGCGYGPLGLSLAKAYGVQATMVDINTRALDLARRNAEKNNAKATIFQSNIYEQVEGHFDHVISNPPIRAGKQVVHEIIEKSKDFLETGGDLTIVIQKKQGAPSAKSKMEDVFGNCEILKKDKGYYILRSVKE

SEQ ID NO: 2693 - protein, 72 aa, Streptococcus pneumoniae
MTLFYHNLTQIVNRLQIDNKTKKTEESESRSHFLQSLSTLINNKPFRTINITVQIKTKSLSSIIRQIIISIA

SEQ ID NO: 2694 - protein, 99 aa, Streptococcus pneumoniae
ILLIYKLIKGAFWFTTYRRCTMKILKCYILELCFILSFALPFIKGANADNGRCFVETYYGFTFLMEHAIVTAVFICSFLIAFLLKNDGRNGLLRVVIAF

SEQ ID NO: 2695 - protein, 316 aa, Streptococcus pneumoniae
MIDKIPRGKQMTNEFLHFEKISRQTWQSLHRKTTPPLTEEELESIKSFNDQISLQDVTDIYLPLAHLIQIYKRTKEDLAFSKGIFLQRESKSQPFIIGVSGSVAVGKSTTSRLLQILLSRTFTDATVELVTTDGFLYPNQTLIEQGILNRKGFPESYDMEALLNFLDRIKNGQDVDIPVYSHEVYDIVPKKKQSVKAADFVIVEGINVFQNPQNDRLYITDFFDFSIYVDAGVDDIESWYLDRFLKMLSLAQNDPDSYYYRFTQMPIGEVESFAHQVWTSINLTNLQNYIEPTRNRAEVILHKSKNHEIDEIYLKK

SEQ ID NO: 2696 - protein, 78 aa, Streptococcus pneumoniae
LANIKSAIKRAELNVKQNEKNSAQKSAMRTAIKAFEANPSEELFRAASSAIDKAETKGLIHKNKASRDKARLSAKLAK

SEQ ID NO: 2697 - protein, 174 aa, Streptococcus pneumoniae
MKIAIIGYSGSGKSTLAEKLSNYYSIPKLHMDTLQFQPGWQDSDHEWMLTEIKNFLTKHKAWVIDGNYSWCYYQERMQEADQIIFLNFSPLTCLFRAFKRYLKYRGKVRESMAADCPERFDWEFIRWILWDGRSKTQKENYQKLCQEYSHKVTILRNQRELDQFLDKKRKSYNS

SEQ ID NO: 2698 - protein, 236 aa, Streptococcus pneumoniae
MSIHIAAQQGEIADKILLPGDPLRAKFIAENFLGDAVCFNEVRNMFGYTGTYKGHRVSVMGTGMGMPSISIYARELIVDYGVKKLIRVGTAGSLNEEVHVRELVLAQAAATNSNIVRNDWPQYDFPQIASFDLLDKAYHIAKELGMTTHVGNVLSSDVFYSNYFEKNIELGKWGVKAVEMEAAALYYLAAQYHVDALAIMTISDSLVNPDEDTTAEERQNTFTDMMKVGLETLIAE

SEQ ID NO: 2699 - protein, 170 aa, Streptococcus pneumoniae
VSAQITINHKKARYVRIELEGYNALSLAEVEVFRFIATNGETAIQVSKPVQPISQTPVKDKTLTIQHSGAYIARYSITWEEVPVDKDGNQVVRSHSWEGNGRNQTAGFVLNLPIKENMRNLRVKIEKKTGLLWNRWQTIYENRPILAQPHRKITHWGTILNSKVSDDDVL

SEQ ID NO: 2700 - protein, 191 aa, Streptococcus pneumoniae
LESRKLAVSGKIKHYVVDNDNVVTPLIHNNRDIVTFTGNSRFKHRSRGYFESPMNDIPNFNIGKQAILDKHGYRDPKLDKVRFFKKQALPRSSSQPSAEPMENIALGKQVTQSSTVFGGDARRAVDGKVDGNYGHNSVTHTNFQSKPWWQVDLAKEETIRQINIYNRTDTAQDRLANFDVILLDSSGKEIE

SEQ ID NO: 2701 - protein, 135 aa, Streptococcus pneumoniae
VVIGVLDSKEELKESENDAPKLETPLREEPRLAPQTLPEASEVLENKREESKVEITEPAQADDIRKVVGELAKDISITKLYMTGHSLGGYLAQIAAVEDYQKYPDFYNHVLRKVTTFSAPKVITSRTVWDAKNGF

SEQ ID NO: 2702 - protein, 269 aa, Streptococcus pneumoniae
MTFLNKIHETATFLKEKGIAAPEFGLILGSGLGELAEEIENPVVVDYAEIPNWGRSTVVGHAGKLVYGELAGRKVLALQGRFHFYEGNPLEVVTFPVRVMKVLGCEGVIVTNAAGGIRFGPGTLMAISDHINMTGQNPLMGENLDDFGPRFPDMSRAYTPEYRATAHEVAKKLNIKLDEGVYIGVTGPTYETPAEIRSYKTLGADAVGMSTVPEVIVAAHSGLKVLGISCITNFAAGFQEELNHEEVVEVTERVKGDFKGLLKAILAEL

SEQ ID NO: 2703 - protein, 180 aa, Streptococcus pneumoniae
MTRYALLVRGINVGGKNKVVMAELRQELTNLGLEKVESYINSGNIFFTSIDSKAQLVEKLETFFAVHYPFIQSFSLLSLEDFEAELENLPAWWSRDLARKDFLFYTEGLDVDQVIATVESLELKDEVLYFGKLGIFWGKFSEESYSKTAYQKYLLKVPFYRHITIRNAKTFDKIGQMLKK

SEQ ID NO: 2704 - protein, 403 aa, Streptococcus pneumoniae
MSKFNRIHLVVLDSVGIGAAPDANNFVNAGVPDGASDTLGHISKTVGLNVPNMAKIGLGNIPRETPLKTVAAESNPTGYATKLEEVSLGKDTMTGHWEIMGLNITEPFDTFWNGFPEEILTKIEEFSGRKVIREANKPYSGTAVIDDFGPRQMETGELIIYTSADPVLQIAAHEDIIPLDELYRICEYARSITLERPALLGRIIARPYVGEPGNFTRTANRRDLAVSPFSPTVLDKLNEAGIDTYAVGKINDIFNGAGINHDMGHNKSNSHGIDTLLKTMGLAEFEKGFSFTNLVDFDALYGHRRNAHGYRDCLHEFDERLPEIIAAMRENDLLLITADHGNDPTYAGTDHTREYIPLLAYSPAFKGNGLIPVGHFADISATVADNFGVETAMIGESFLDKLV

SEQ ID NO: 2705 - protein, 246 aa, Streptococcus pneumoniae
LNKKRFHSKIRTENDGGKSVENLKKMAGIKAAEFVSDGMVVGLGTGSTAYYFVEEIGRRIKEEGLQITAITTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 2706 - protein, 61 aa, Streptococcus pneumoniae
KYAFYFYQTNKNEFIFDVFDLFISFQLRKQTLNFDTSSLALKQAHFKNHKLREGSRCICLF

SEQ ID NO: 2707 - protein, 290 aa, Streptococcus pneumoniae
MKVINQTLLEKVIIERSRSSHKGDYGRLLLLGGTYPYGGAIIVAALAAVKSGAGLVTVGTDRENIPALHSHLPEAMAFALQDKQLLKEQLEKAEVVLLGPGLGDDASGEDLVKQVFAGLKQNQILIVDGGALTILARTSLSFPSSQLILTPHQKEWEKLSGITIEKQKEDTTASALTSFPKGTILVEKGPATRVWQAGQSDYYQLQVGGPYQATGGMGDTLAGMIAGFVGQFRQASLYERVAVATHLHSAIAQELSQENYVVLPTEISRYLPKIMKIICQQERVSKDKLV

SEQ ID NO: 2708 - protein, 306 aa, Streptococcus pneumoniae
VLEGTCSFWYNGRYLKEKRSDMTQIIDGKALAAKLQGQLAEKTAKLKEETGLVPGLVVILVGDNPASQVYVRNKERSALAAGSRSEVVRVPETITQEELLDLIAKYNQDPAWHGILVQLPLPKHIDEEAVLLAIDPEKDVDGFHPLNMGRLWSGHPVMIPSTPAGIMEMFHEYGIDLEGKNAVVIGRSNIVGKPMAQLLLAKNATVTLAHSRTHNLAKVAAKADILVVAIGRAKFVTADFVKPGAVVIDVGMNRDENGKLCGDVDYEAVAPLASHITPVPGGVGPMTITMLMEQTYQAALRTLDRK

SEQ ID NO: 2709 - protein, 71 aa, Streptococcus pneumoniae
SATSRANPISCVTITIVIPDLARSCITANTSPTISGSKAEVGSSKSKTSGSIANPRAMAIRCCCPPDRLCG

SEQ ID NO: 2710 - protein, 244 aa, Streptococcus pneumoniae
MTETLIKIENLHKSFGKNEVLKGINLEIKRGEVVVIIGPSGSGKSTLLRSMNLLEEATKGKLIFEGVDITDKKNDLFAMREKMGMVFQQFNLFPNMTVMENITLSPIKTKGESREVAEKRAQELLEKVGLPDKADAYPQSLSGGQQQRIAIARGLAMEPDVLLFDEPTSALDPEMVGEVLAVMQDLAKSGMTMVIVTHEMGFAREVADRVIFMADGVVVEDGTPEQIFEQTQEQRTKDFLSKVL

SEQ ID NO: 2711 - protein, 127 aa, Streptococcus pneumoniae
LIGDKVIFSITVILGKRLNCWKTMPIFSRMANRSFFLSVISTPSKISFPLVASSNKFIERSKVDFPLPEGPMITTTSPLLISRLMPFNTSFFPKDLCKFSIFIKVSVIISYLLVPYVFQKLSRLLSE

SEQ ID NO: 2712 - protein, 227 aa, Streptococcus pneumoniae
MNFSFLPKYLPYFNYGAVVTILISICVIFLGTILGVVLAFGQRSKFKPLVWLANLNVWIFRGTPMMVPIMIAFALMHINAPTIQIGILGVDFSRLIPGILIISMNSGAYVSETVRAGINAVPKGQLEAAYSLGIRPKNAMRYVILPQAVKNILPALGNEFITIIKDSSLLSAIGVMELWNGATTVSTTTYLPLTPLLFAAFYYLIMTSILTVALKAFEKHMGQGDKK

SEQ ID NO: 2713 - protein, 76 aa, Streptococcus pneumoniae
MESHLVRIINRLEAMANDGGNLKRNFEREGVVVAEVAYSHDEENGPIFTLRDVEDRETYTFDSIDLIAMEIYELLY

SEQ ID NO: 2714 - protein, 752 aa, Streptococcus pneumoniae
MLCQNCKINDSTIHLYTNLNGKQKQIDLCQNCYKIIKTDPNNSLFKGMTDLNNRDFDPFGDFFNDLNNFRPSSNTPPIPPTQSGGGYGGNGGYGSQNRGSAQTPPPSQEKGLLKEFGINVTEIARRGDIDPVIGRDDEIIRVIEILNRRTKNNPVLIGEPGVGKTAVVEGLAQKIVDGDVPHKLQGKQVIRLDVVSLVQGTGIRGQFEERMQKLMEEIRKREDIILFIDEIHEIVGAGSASDGNMDAGNILKPALARGELQLVGATTLNEYRIIEKDAALERRMQPVKVDEPTVDETITILKGIQKKYEDYHHVQYTDAAIEAAATLSNRYIQDRFLPDKAIDLLDEAGSKMNLTLNFVDPKVIDQRLIEAENLKSQATREEDFEKAAYFRDQIAKYKEMQKKKITDQDTPIISEKTIEHIIEQKTNIPVGDLKEKEQSQLIHLAEDLKSHVIGQDDAVDKIAKAIRRNRVGLGTPNRPIGSFLFVGPTGVGKTELSKQLAIELFGSADSMIRFDMSEYMEKHSVAKLVGAPPGYVGYDEAGQLTEKVRHNPYSLILLDEVEKAHPDVMHMFLQVLDDGRLTDGQGRTVSFKDAIIIMTSNAGTGKTEASVGFGATREGRTNSVLGELGNFFSPEFMNRFDGIIEFKALSKDNLLQIVELMLADVNKRLSSNNIRLDVTDKVKEKLVDLGYDPKMGARPLRRTIQDYIEDTITDYYLENPSEKDLKAVMTSKGNIQIKSAKKAEVKSSEKEK

SEQ ID NO: 2715 - protein, 82 aa, Streptococcus pneumoniae
EVNGLVRQEAILDVAIGKSCSCFNRSIGILNVVVIFVFLLNPFENSDCFIHRWFIDFNRLHTTLEGSILFNDTVFIEGSSTD

SEQ ID NO: 2716 - protein, 60 aa, Streptococcus pneumoniae
MLLAKMMQSIRLPRLFAVIVSDLVPLTAQSEASSSLGQLVSVRQNFPNNWLSNFLVLLIV

SEQ ID NO: 2717 - protein, 69 aa, Streptococcus pneumoniae
MYSLISKRIILSAEPKSSIASCLESSVLPTPVGPTKRKLPIGRLGVPSPTRLRRIALAILSTASSWPIT

SEQ ID NO: 2718 - protein, 113 aa, Streptococcus pneumoniae
LVAGLTNGELIAPITYEEMMTSDFFEAWFQKFLLPTLTTPSVIIMDNARFHRMGKLELLCEEFGHKLLPLPPYSPEYNPIEKTWAHIKKHLKKVLPSCCNTFYEALLSCSCFN

SEQ ID NO: 2719 - protein, 115 aa, Streptococcus pneumoniae
MWYNLFMAYSIDFRKKVLSYCERTGSITEASHVFQISRNTIYGWLKLKEKTGELNHQVKGTKPRKVDRDRLKNYLTDNPDAYLTEIASEFGCHPTTIHYALKAMGYTRKKEPQLL

SEQ ID NO: 2720 - protein, 140 aa, Streptococcus pneumoniae
VNTDYIARYGVYAVIPNPEQKQIVLVQEPNGAWFLPCGKIEAGENHQEALKRELIEELGFTAEIGTYYGQADEYFYSRHRDAYYYNPAYLYEATPFKEVQKPLENFNHIAWFPIDEAIKNLKRGSHKWAIESWKKQHKID

SEQ ID NO: 2721 - protein, 99 aa, Streptococcus pneumoniae
MKLINTTNSHSQLVKSQLESTDATLVEVYSAGNTDVIFTQAPLHYEILISNKHRAIREPEIETIQEFFLKRKIDKASVDEANIKTLYSEKLIGISIPIK

SEQ ID NO: 2722 - protein, 197 aa, Streptococcus pneumoniae
KYSIYKLKCDRNENKGDVGKKAENLIQGQFEGSKTMEQCYIDVTEFAIPASTQKLYLSPVLDGFNSEIIAYNLSTSPNLEQVQTMLEQAFKEKHYENTILHSDQGWQYRHDSYHRFLESKGIQASMSRKGNSPDNGMMESFFGILKSEMFYGYEKSFQSLKQLEQAIVDYIDYYNNKRIKVKLKGLSPVQYRTKSFG

SEQ ID NO: 2723 - protein, 87 aa, Streptococcus pneumoniae
FSLDLLLKAIKLARSTYYYHLKQLDKTDKDQELKAEIQSIFIEHKGNYAYRRIYLELRNRAYLVNYKRVQGLMKVLNLQAKMRQKRK

SEQ ID NO: 2724 - protein, 33 aa, Streptococcus pneumoniae
MIKLIDRYGIEFGKKGKNRYYSPDLKQEMIHKV

SEQ ID NO: 2725 - protein, 116 aa, Streptococcus pneumoniae
MIIQLSDLGQVHLVCSKIDMRQGIDSLAYVVKTHFELDPFSGQVFLFCGGRKDRFKALYWDGQGFWLLYKRFENGRLTWPSTEKDVKALTPEQVDWLMKGFSITPKINPSESRDFY

SEQ ID NO: 2726 - protein, 101 aa, Streptococcus pneumoniae
LLWTHTGESFFLIAGGCNTEWMNVFLEELSQAYPDDYLLFVMDNAIWHKSSTLKIPTNIGFAFIPPYTPEMNPIEQVWKEIRKRGFKNKAFQTLEDVMNQL

SEQ ID NO: 2727 - protein, 88 aa, Streptococcus pneumoniae
MTVGEEKAFLARHLKATEAGEFVTIDALFQAYKKELGRSYTRDAFYQLLKRHGWRNIMPRPEHPRKTDAQTIVASKNKISIQEEKKAL

SEQ ID NO: 2728 - protein, 575 aa, Streptococcus pneumoniae
MSNGQLIYLMVAIAVILVLAYVVAIFLRKRNEGRLEALEERKEELYNLPVNDEVEAVKNMHLIGQSQVAFREWNQKWVDLSLNSFADIENNLFEAEGYNHSFRFLKASHQIDQIESQITLIEEDIAAIRNALADLEKQESKNSGRVLHALDLFEELQHRVAENSEQYGQALDEIEKQLENIQSEFSQFVTLNSSGDPVEAAVILDNTENHILALSHIVDRVPALVTTLSTELPDQLQDLEAGYRKLIDANYHFVETDIEARFHLLYEAFKKNQENIRQLELDNAEYENGQAQEEINALYDIFTREIAAQKVVENLLATLPTYLQHMKENNTLLGEDIARLNKTYLLPETAASHVRRIQTELESFEAAIVEVTSNQEEPTQAYSVLEENLEDLQTQLKDIEDEQISVSERLTQIEKDDINARQKANVYVNRLHTIKRYMEKRNLPGIPQTFLKLFFTASNNTEDLMVELEQKMINIESVTRVLEIATNDMEALETETYNIVQYATLTEQLLQYSNRYRSFDERIQEAFNEALDIFEKEFDYHASFDKISQALEVAEPGVTNRFVTSYEKTRETIRF

SEQ ID NO: 2729 - protein, 648 aa, Streptococcus pneumoniae
MTEEIKNLQAQDYDASQIQVLEGLEAVRMRPGMYIGSTSKEGLHHLVWEIVDNSIDEALAGFASHIQVFIEPDDSITVVDDGRGIPVDIQEKTGRPAVETVFTVLHAGGKFGGGGYKVSGGLHGVGSSVVNALSTQLDVHVHKNGKIHYQEYRRGHVVADLEIVGDTDKTGTTVHFTPDPKIFTETTIFDFDKLNKRIQELAFLNRGLQISITDKRQGLEQTKHYHYEGGIASYVEYINENKDVIFDTPIYTDGEMDDITVEVAMQYTTGYHENVMSFANNIHTHEGGTHEQGFRTALTRVINDYARKNKLLKDNEDNLTGEDVREGLTAVISVKHPNPQFEGQTKTKLGNSEVVKITNRLFSEAFSDFLMENPQIAKRIVEKGILAAKARVAAKRAREVTRKKSGLEISNLPGKLADCSSNNPAETELFIVEGDSAGGSAKSGRNREFQAILPIRGKILNVEKASMDKILANEEIRSLFTAMGTGFGAEFDVSKARYQKLVLMTDADVDGAHIRTLLLTLIYRYMKPILEAGYVYIAQPPIYGVKVGSEIKEYIQPGADQEIKLQEALARYSEGRTKPTIQRYKGLGEMDDHQLWETTMDPEHRLMARVSVDDAAEADKIFDMLMGDRVEPRREFIEENAVYSTLDV

SEQ ID NO: 2730 - protein, 190 aa, Streptococcus pneumoniae
MKGMKYHDYIWDLGGTLLDNYETSTAAFVETLALYGITQDHDSVYQALKVSTPFAIETFAPNLENFLEKYKENEARELEHPILFEGVSDLLEVISNQGGRHFLVSHRNDQVLEILEKTSIAAYFTEVVTSSSGFKRKPNPESMLYLREKYQISSGLVIGDRPIDIEAGQAAGLDTHLFTSIVNLRQVLDI

SEQ ID NO: 2731 - protein, 184 aa, Streptococcus pneumoniae
MVKVAVILAQGFEEIEALTVVDVLRRANITCDMVGFEEQVTGSHAIQVRADHVFDGDLSDYDMIVLPGGMPGSAHLRDNQTLIQELQSFEQEGKKLAAICAAPIALNQAEILKNKRYTCYDGVQEQILDGHYVKETVVVDGQLTTSRGPSTALAFAYELVEQLGGDAESLRTGMLYQDVFGKNQ

SEQ ID NO: 2732 - protein, 416 aa, Streptococcus pneumoniae
LYESIRLVYMKRSLDSRVDYSLLLPVFFLLVIGVVAIYIAVSHDYPNNILPILGQQVAWIALGLVIGFVVMLFNTEFLWKVTPFLYILGLGLMILPIVFYNPSLVASTGAKNWVSINGITLFQPSEFMKISYILMLARVIVQFTKKHKEWRRTVPLDFLLIFWMILFTIPVLVLLALQSDLGTALVFVAIFSGIVLLSGVSWKIIIPVFVTAVTGVAGFLAIFISKDGRAFLHQIGMPTYQINRILAWLNPFEFAQTTTYQQAQGQIAIGSGGLFGQGFNASNLLIPVRESDMIFTVIAEDFGFIGSVLVIALYLMLIYRMLKITLKSNNQFYTYISTGLIMMLLFHIFENIGAVTGLLPLTGIPLPFISQGGSAIISNLIGVGLLLSMSYQTNLAEEKSGKVPFKRKKVVLKQIK

SEQ ID NO: 2733 - protein, 816 aa, Streptococcus pneumoniae
MKTIGNRYVVVDLEATSTGSKAKIIQVGIVVIEDGEIVDHYTTDVNPHEPLDAHIKELTGLTDQRLAQAPDFSQVARKIFDLVEDGIFVAHNVQFDANLLAENLFFEGYELRNPRVDTVELAQVFFPELEKYSLPILCRELGIPLKHAHTALSDAQATAELLLFLREKMTQLPKGLLERLLEMADALLYESYLVIEETYRNQSILSSPDLVQVQGLYFKKTAASLELRKLSQDFSKNISLLNLEVREEQESFAKEVGLLLKDEPVFLIQAPTGIGKTYGYLLPALSQSKERQIVLSVPTKILQNQIMEEEGKRLKEVFHTDIHSLKGPQNYLKLDAFYHSLQENDENRLFRRFKMQVLVWLTETETGDLDEIGQLYRYQHFLADLRHDGNLSSQSLFVTEDFWKRSQERAETCKLLVTNHAYLVTRLEDNPEFVSDRLLIIDEVQKILLALENLLQETYDIQSIIDLIDKALVGEENRVQQRILESIRFECLYLIEQFQSGKSRKNILDSLDNLHQYFSELEVEGFDELVRYFTAEGDYWLEVTETSQKKIQISSTKSGRTLLSSLLPESCQVLGVSATLEISQRVSLADLLGYPEAKFVKIESRGKQEQEVVMVKDFPLVTETSLEVYAREVAALLVEIQAFQQPILVLFTAKDMLLAVSDLLTVSHLAQYKNGDVHQLKKRFEKGEQQILLGAASFWEGVDFSSHPFVIQVVPRLPFQNPQEPLTKKINQELNQEGKNAFYDYQLPMAIIRLKQALGRSMRREYQRSLTLILDRRIVGKRYGKQIVASLAEEATVKTISRSEVDEAIDRFFNEL

SEQ ID NO: 2734 - protein, 309 aa, Streptococcus pneumoniae
MEKIVITATAESIEQVEQLLEAGVDRIYVGEKDFGLRLPTTFSYDQLREIAKLVHDAGKELIVAVNALMHQDMMDRIKPFLDFLEEIKTDYITIGDAGVFYVVNRDGYSFKTIYDASTMVTSSRQINFWGQKAGASEAVLAREIPSAELFKMPEILEIPAEVLVYGASVIHHSKRPLLQNYYNFTHIDDEKTHKRDLFLAEPSDPESHYSIFEDNHGTHIFANNDLDLMIKLTELVEHGFTRWKLEGLYTPGQNFVEIAKLFIQARNLIQEGNFSHDQVFLLDEEVRKLHPKNRFLDTGFYDYDPDMVR

SEQ ID NO: 2735 - protein, 95 aa, Streptococcus pneumoniae
MPVRKLQSYEVDYQEELNQQLPHYQAYTPEAQSDANLKEILFFINIAVFCICIAIFSFIFLALKLSTALAFAAAIGFSLLVLKVQRSIIKRKRRR

SEQ ID NO: 2736 - protein, 444 aa, Streptococcus pneumoniae
MFSKLKKTWYADDFSYFIRNFGVFTLIFSTMTLIILQVMHSSLYTSVDDKLHGLSENPQAVIQLAINRATEEIKDLENARADASKVEIKPNVSSNTEVILFDKDFTQLLSGNRFLGLDKIKLEKKELGHIYQIQVFNSYGQEEIYRVILMETNISSVSTNIKYAAVLINTSQLEQASQKHEQLIVVVMASFWILSLLASLYLARVSVRPLLESMQKQQSFVENASHELRTPLAVLQNRLETLFRKPEATIMDVSESIASSLEEVRNMRFLTTSLLNLARRDDGIKPELAEVPTSFFNTTFTNYEMIASENNRVFRFENRIHRTIVTDQLLLKQLMTILFDNAVKYTEEDGEIDFLISATDRNLYLLVSDNGIGISTEDKKKIFDRFYRVDKARTRQKGGFGLGLSLAKQIVDALKGTVTVKDNKPKGTIFEVKIAIQTPSKKKK

SEQ ID NO: 2737 - protein, 224 aa, Streptococcus pneumoniae
MIKILLVEDDLGLSNSVFDFLDDFADVMQVFDGEEGLYEAESGVYDLILLDLMLPEKNGFQVLKELREKGITTPVLIMTAKESLDDKGHGFELGADDYLTKPFYLEELKMRIQALLKRSGKFNENTLTYGNIVVNLSTNTVKVEDTPVELLGKEFDLLVYFLQNQNVILPKTQIFDRLWGFDSDTTISVVEVYVSKVRKKLKGTTFAENLQTLRSVGYLLKDVQ

SEQ ID NO: 2738 - protein, 848 aa, Streptococcus pneumoniae
MQAVEHFIKQFVPEHYDLFLDLSRETKTFSGKVTITGQAQSDRISLHQKDLEITSVEVAGQARPFTVDHDNEALHIELAEAGQVELVLAFSGKITDNMTGIYPSYYTVDGVKKEVLSTQFESHFAREAFPCVDEPEAKATFDLSLRFDQAEGELALSNMPEIDVENRKETGIWKFETTPRMSSYLLAFVAGDLQGVTAKTKNGTLVGVYSTKAHPLSNLDFSLDIAVRSIEFYEDYYGVKYPIPQSLHIALPDFSAGAMENWGLVTYREVYLVVDENSTFASRQQVALVVAHELAHQWFGNLVTMKWWDDLWLNESFANMMEYVCVDTIEPSWNIFEDFQTGGVPLALERDATDGVQSVHVEVKHPDEINTLFDGAIVYAKGSRLMHMLRRWLGDADFAKGLHAYFEKHQYSNTIGSDLWDALGQASGRDVAAFMDSWLEQPGYPVLTVKVENDVLKISQKQFFIGENEDKNRLWVVPLNSNWKGLPDTLETESIEIPGYAALLAENEGALRLNTENTAHYITDYQGDLLEAVLAELETLDNTSKLQIVQERRLLAEAGHISYADLLPVLDKLAKEESYLVVSAVSQVISALERFIDEGTDAETAFKGLVAKLARHNYDRLGFEAKDGESDEDELVRQLAVSMMIRSNDAEARQVASQIFATHKENLAELPAAIRSQVLINEMKHHETKDLLALYLDTYTHATDAVFKRQLTAALAYSTDADNIQNLITSWKDKFVVKPQDLSAWYYQFLAHQATQKTAWSWARENWAWIKAALGGDMSFDSFVILPAHVFKTQQRLAEYKEFFEPQLSDLALSRNIGMGIKEIAARVDLISREKAAVEAVVLQYGNA

SEQ ID NO: 2739 - protein, 146 aa, Streptococcus pneumoniae
MIPQEMWNKYKQINPLIGDEIDAWAFGVEPDLLADLVFKGEKTATASAYDLYVLEDEPLPQVGTFDIILDSQNQSVCIVEITKVSVELFNQVSAQHAFKEGEGDKSLAYWRQVHEDFFTDCLGEVGLTFTSESKVVLEEFRKVYPL

SEQ ID NO: 2740 - protein, 291 aa, Streptococcus pneumoniae
MAMRNQLALSGEKILEKIYPQLFHHVGMIRGEYLLRELNQNIILASCQQFVKDYLETICSLYSDEEVWYRFSELTNTEANCLVGTREFFDEGHPLFGYRGTRRLLACLDEFQAEAHVVTEVYQTNPNLSVIFPFVNDDDQLKQAITVLRQQGFTGKVGTMIELPSAYFDLSSILETGISKIVVGMNDLTSFVFATMRNSQWHDMESPIMLDMLRDMQDKARKNKIDFAVAGYLNTSFIQKMNQLGIKCIIHYSSIPEIFDLEIDHPDHLKHIKEESKKLQRSTHDTARNVE

SEQ ID NO: 2741 - protein, 242 aa, Streptococcus pneumoniae
MELFKTWKKNMVLYGLKSQIGTVYRNNDRTTSFYDVGNFLYLAGELDSRFWEDFVRKYGLDYKIIISENTNWQDFLHRKVGLNSFTRYSFKDKANFQVEFLNNLVTHLEEGYNIVPIDNHIYNCFSTEEWSQDLQGDFESYQDFVLKGGFGFVILKNNELIAGISSGLVYRKAVEVEVATRPNEQGNGFAKKLGAAMILESLNRDMFPLWDAHNEASKKVAEFLGYELSEPYEAFELEEILI

SEQ ID NO: 2742 - protein, 159 aa, Streptococcus pneumoniae
MEIKNHFGVYCVCFENGKLLCIEKTRGPYQHRYDLPGGSQQLGEGLTETLTREVMEETGFTVRSYSNPRIYDVFVREELKNFMVHHVMALYDVEMNESAPQVTISEAVSDGANDSLGYIWMDIQEITEENASPLVLKVKSELLGFPELDKTSYMNWKVK

SEQ ID NO: 2743 - protein, 75 aa, Streptococcus pneumoniae
SFFSKWKSERHARTNLDNRWWLVFEVGGVGWKSKITLGSTVFALKMESYFVLKKREALINIGMIYLEAVSNLVKD

SEQ ID NO: 2744 - protein, 232 aa, Streptococcus pneumoniae
MTKRVLITGVSSGIGLAQARLFLEKGYQVYGVDQGEKPLLEGDFHFLQRDLTLDLEPIFDWCPQVDVLCNTAGVLDDYKPLLEQTAQDIQEIFEINYIIPVELTRYYLTQMLENKKGIIINMCSIASSLAGGGGHAYTSSKHALAGFTKQLALDYAEAGIQVFGIAPGAVKTAMTAADFEPGGLADWVASETPIKRWIEPEEIAELSLFLASGKASAMQGQILTIDGGWSLK

SEQ ID NO: 2745 - protein, 88 aa, Streptococcus pneumoniae
MKNVELKEKNMTFEEILPGLKAKRKYVRTGWGGAENYVQLFDTIEQNGLALEMTPYFLINVSGEGEGFSMWSPTVCDVLATDWVEVHD

SEQ ID NO: 2746 - protein, 308 aa, Streptococcus pneumoniae
MRYITLGQDDKELSEIVLGMMRIKDKSVKEVEELVETALSVGINAFDLADIYGRGRCEELLGLVLKNRPDLREKMWIQSKCGIRIEEFTYFDFSKDYIIKSVDGILQRLKIDHLDSLLLHRPDALMESDQVAEAFDLLYKQGKVRDFGVSNQNPMMMELLKKDVKQPLAVNQLQLSAAFTPGFESAFHVNMEDSQAAMRDGSIFEYCKLHDVVIQAWSVLQFGYFKGNFVGNEKFQALNQVLDRLAIKYGVTSSTIAISWILRYPAKMQAVVGTTNPKHLREVSQAANFSLTRKEWYEIYLAAGNNLP

SEQ ID NO: 2747 - protein, 271 aa, Streptococcus pneumoniae
MKKMKYYEETSALLHEFSEENQKYFEELWESFNLAGFLYDEDYLREQIYLMMLDFSEAERDGMSAEDYLGKNPKKIMKEILKGAPRSSIKESLLTPILVLVVLRYYQLLSDFSKGPLLTVNLLTFLGQLLIFLIGFGLVATILRRSLVQDSPKMKIGTYIVVGTIVLLVVLGYVGMASFIQEGAFYIPAPWDSLSVFTISLVIGIWNWKEAVFRPFVSMIIAHLVVGSLLRYYEWMGISNVFLTKVIPLAVLFIGIFVLFRGFKKIKWSEV

SEQ ID NO: 2748 - protein, 71 aa, Streptococcus pneumoniae
VMKETQLLKGVLEGCVLDMIGQKERYGYELVQTLREAGFDTIVPGTIYPLLQKLEKNQWIRGDMRRRRWSR

SEQ ID NO: 2749 - protein, 78 aa, Streptococcus pneumoniae
MKIKEQTRKLAAGCSKHCFEVVDRTDEVSSKHVFEVVDETDEVSSKHCFEVVDETDEVSNHTYGRATLTWFEEIFEEY

SEQ ID NO: 2750 - protein, 81 aa, Streptococcus pneumoniae
YSSKISSNHVSVALPYVWLLTSSVSSTTSKQCFELTSSVSSTTSKTCFELTSSVLSTTSKQCFEQPAASFLVCSLIFIEYK

SEQ ID NO: 2751 - protein, 679 aa, Streptococcus pneumoniae
VLEKQVSFAWKGKIMSEKNFYITTPIYYPSGKLHIGSAYTTIACDVLARYKRLMGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAHGWFVMKDGKMSKSKGNVVYPEMLVERYGLDPLRYYLMRNLPVGSDGTFTPEDYVGRINYELANDFGNLLNRTFSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFCLDAGDGEDRQILSGIAKYYPNEQELVGKKVQIVANLKPRKMMKKYVSQGMILSAEHDGKLTLLTVDPAVPNGSVIG

SEQ ID NO: 2752 - protein, 419 aa, Streptococcus pneumoniae
MQNLKFAFSSIMAHKMRSLLTMIGIIIGVSSVVVIMALGDSLSRQVNKDMTKSQKNISVFFSPKKSKDGSFTQKQSAFTVSGKEEEVPVEPPKPQESWVQEAAKLKGVDSYYVTNSTNAILTYQDKKVENANLTGGNRTYMDAVKNEIIAGRSLREQDFKEFASVILLDEELSISLFESPQEAINKVVEVNGFSYRVIGVYTSPEAKRSKIYGFGGLPITTNISLAANFNVDEIANIVFRVNDTSLTPTLGPELARKMTELAGLQQGEYQVADESVVFAEIQQSFSFMTTIISSIAGISLFVGGTGVMNIMLPSVTERTREIGLRKALGAQRANILIQFLIESMILTLLGGLIGLTIASGLTALAGLLLQGLIEGIEVGVSIPVALFSLAVSASVGMIFGVLPANKASKLDPIEALRYE

SEQ ID NO: 2753 - protein, 233 aa, Streptococcus pneumoniae
MKQLISLKNIFRSYRNGDQELQVLKNINLEVNEGEFVAIMGPSGSGKSTLMNTIGMLDTPTSGEYYLEGQEVAGLGEKQLAKVRNQQIGFVFQQFFLLSKLNALQNVELPLIYAGVSSSKRRKLAEEYLDKVELTERSHHLPSELSGGQKQRVAIARALVNNPSIILADEPTGALDTKTGNQIMQLLVDLNKEGKTIIMVTHEPEIAAYAKRQIVIRDGVISSDSAQLGKEEN

SEQ ID NO: 2754 - protein, 399 aa, Streptococcus pneumoniae
MKKKNGKAKKWQLYAAIGAASVVVLGAGGILLFRQPSQTALKDEPTHLVVANEGSVASSVLLSGTVTAKNEQYVYFDASKGDLDEILVSVGDKVSEGQALVKYSSSEAQAAYDSASRAVAKADRHINELNQARNEAASAQAPQLPAPVGGEDATVQSPTPVAGNSVASIDAQLGDARDARADAAAQLSKAQSQLDATTVLSTLEGTVVEVNSNVSKSPTGASQVMVHIVSNENLQVKGELSEYNLANLSVGQEVSFTSKVYPDKKWTGKLSYISDYPKNNGEAASPAAGNNTGSKYPYTIDVTGEVGDLKQGFSVNIEVKSKTKAILVPVSSLVMDDSKNYVWIVDEQQKAKKVEVSLGNADAENQEITSGLTNGAKVISNPTSSLEEGKEVKADEATN

SEQ ID NO: 2755 - protein, 448 aa, Streptococcus pneumoniae
MREYDIIAIGGGSGGIATMNRAGEHGAKAAVIEEKKLGGTCVNVGCVPKKIMWYGAQIAETFHQFGEDYGFKTTDLNFNFATLRRNREAYIDRARSSYDGSFKRNGVDLIEGHAEFVDSHTVSVNGELIRAKHIVIATGAHPSIPNIPGAELGGSSDDVFAWEELPESVAILGAGYIAVELAGVLHTFGVKTDLFVRRDRPLRGFDSYIVEGLVKEMERTNLPLHTHKVPAKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTSSEEFVTMR

SEQ ID NO: 2756 - protein, 178 aa, Streptococcus pneumoniae
LKKAHVYAIPAIGAALIAVLAQISLPIGPVPFTLQNFAIGLIATVFRPREAVLSAGLYLLLGAIGLPVFAGGGAGFQALVGPTAGYLWFYLVYSGLTSSLTNSKSGVVKIFLANLLGDALVFVGGILSLHFLAGMAFEKALVVGVLPFIIPDLGKLLAISFISRPLLQRLKNQTYFTN

SEQ ID NO: 2757 - protein, 111 aa, Streptococcus pneumoniae
LKKLLLWGFFPLSFQTLANFWLLVLLAVPYFNALKIRLTLLTKKGYRVIMTQYPFFYFENLYSMKIKEQTRKLAAGCSKHCFEVVDETDEVSNHTYGKAKLMRFEEIFEEY

SEQ ID NO: 2758 - protein, 79 aa, Streptococcus pneumoniae
MKLKKEKKMAEFTFEIEEHLLTLSENEKGWTKEINRVSFNGAPAKFDIRAWSPDHTKMGKGITLSNEEFQTMVDAFKGN

SEQ ID NO: 2759 - protein, 106 aa, Streptococcus pneumoniae
MRHKFQQVLDKIHDFLNGHDQPDQTETNSLTATIEEAIQKQTAVHLILSETSFTGDIIKYDQQGQQIIVKNFSKNVSRIIRISDIQRLRFVPSTVQTAQKNRFKKE

SEQ ID NO: 2760 - protein, 112 aa, Streptococcus pneumoniae
MQVIKRNGEIAEFNPDKIYQAILKAAQTVYVLTDDLRQNLAQVTKKVVLDLQEAKVERATISMIQSMVEHRLLGAGYITIAEHYISYRLQRDLERSGYGDHIAVHLHFEQIR

SEQ ID NO: 2761 - protein, 239 aa, Streptococcus pneumoniae
MKIDILTLFPEMFSPLEHSIVGKAREKGLLDIQYHNFRENAEKARHVDDEPYGGGQGMLLRAQPIFDSFDAIEKKNPRVILLDPAGKQFDQAYAEDLAQEEELIFICGHYEGYDERIKTLVTDEISLGDYVLTGGELAAMTMIDATVRLIPEVIGKESSHQDDSFSSGLLEYHQYTRPYDYRGMVVPDVLMSGHHEKIRQWRLYESLKKTYERRPDLLEHYQLTVEEEKMLAEIKENKE

SEQ ID NO: 2762 - protein, 172 aa, Streptococcus pneumoniae
MNYFNVGKIVNTQGLQGEMRVLSVTDFAEERFKKGAELALFDEKDQFVQTVTIASHRKQKNFDIIKFKDMYHINTIEKYKGYSLKVAEEDLNDLDDGEFYYHEIIGLEVYEGDSLVGTIKEILQPGANDVWVVKRKGKRDLLLPYIPPVVLNVDIPNKRVDVEILEGLDDED

SEQ ID NO: 2763 - protein, 266 aa, Streptococcus pneumoniae
VDFFMKRFEVSTEIGSLSVAYQKQKKVLVCLNGAGLLPSYENFSLILEKPPPTIGYLTIDFPNTGRSPIYDQAGKNLDNLADVVYEALEELGISEYILCVHSWSGILACKLLEKPIKCQTLVVIEPTTKKVMFADFSENPYPEMEEQMRLIDECGPELYFKNLTQATFSPETNKKIWELMQEKGLELENQDPEFQISGEITEEDFENLSIESHVPVFIFCQTYREKEYRESEYWTSNTKLILGGNHHYLQWSESEKIAAIIRELSE

SEQ ID NO: 2764 - protein, 79 aa, Streptococcus pneumoniae
MDTIENLIIAIVKPLISQPDALTIKIEDTPEFLEYHLNLDQSDVGRVIGRKGRTISAIRTIVYSVPTEYKKVRIVIDEK

SEQ ID NO: 2765 - protein, 90 aa, Streptococcus pneumoniae
MAVKIRLTRMGSKKKPFYRINVADSRSPRDGRFIETVGTYNPLVAENQVTLKEDRVLAWLANGAQPSDTVRNILSKEGVLKKFHDSKFSK

SEQ ID NO: 2766 - protein, 69 aa, Streptococcus pneumoniae
MLSVNTILEKFYKEHQVKPFISPERELDTWLLSPKPVPKRNMDLLVDDSLAGDIILLWRIQFGTFTTET

SEQ ID NO: 2767 - protein, 134 aa, Streptococcus pneumoniae
FLAFRELASFTSFLKIWFPKYFEYTYGIDAPKHLKTLVEKGYALVETSFDSLDHLNTTMKKNILKKKGVTGLSKMKSCDLDQALHEHFSEEELAGHFHVLLWTFLQWHCYHTQYLSKRLVRKLYCSSSSKFPNC

SEQ ID NO: 2768 - protein, 70 aa, Streptococcus pneumoniae
MSFYGLFYNGIAITPNTYLSAWFVNFIAALPLNFLIVEPIARFILSSFQKPFTGEEVEDFQDDDEIPTII

SEQ ID NO: 2769 - protein, 267 aa, Streptococcus pneumoniae
MKKLATLLLLSTVALAGCSSVQRSLRGDDYVDSSLAAEESSKVAAQSAKELNDALTNENANFPQLSKEVAEDEAEVILHTSQGDIRIKLFPKLAPLAVENFLTHAKEGYYNGITFHRVIDGFMVQTGDPKGDGTGGQSIWHDKDKTKDKGTGFKNEITPYLYNIRGALAMANTGQPNTNGSQFFINQNSTDTSSKLPTSKYPQKIIEAYKEGGNPSLDGKHPVFGQVIGGMDVVDKIAKAEKDEKDKPTTAITIDSIEVVKDYDFKS

SEQ ID NO: 2770 - protein, 120 aa, Streptococcus pneumoniae
TRVSTFFVGFDNFLWILACREFRRGICRVLVDEELAAIGVWLTSISHSKSTADVIQIRSNLVLETSSFVFSLILVMPDGLTTCTVPFWISSLDHKAIDDTVEGNTVIVAFFGVSEEIFNR

SEQ ID NO: 2771 - protein, 513 aa, Streptococcus pneumoniae
MSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMEMAEDGADVDALMEEVGELQDRLESRDFYTLDAKIDEVARALGIMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYDRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPTNHLDVDAKDELKRALKEYRGSILMVCHEPDFYEGWIDQIWDFNNLT

SEQ ID NO: 2772 - protein, 160 aa, Streptococcus pneumoniae
MMKKTYNHILVWGVIFYSICIVYFCFTPQEQSTVGVGTPDIQHLGRLVFLLTPFNSLWKLGEVSDIGQLCWIFLQNILNVFLFFPLIFQLLYLFPNLRKTKKVLLFSFLVSLGIECTQLILDFFFDFNRVFEIDDLWTNTLGGYLAWLLYKRLHKNKIRN

SEQ ID NO: 2773 - protein, 361 aa, Streptococcus pneumoniae
MKPSIHSLAHQTMQEWVLEQGEKKFRADQIWEWLYRKRVQSFEEMTNLSKDLIAKLNDQFVVNPLKQGIVQESADGTVKYLFELPDGMLIETVLMRQHYGLSVCVTTQVGCNIGCTFCASGLIKKQRDLNNGEIVAQIMLVQKYFAERGQDERVSHIVVMGIGEPFDNYNNVLNFFRTINDDKGMAIGARHITVSTSGLAHKIRDFADEGVQVNLAVSLHAPNNELRSSIMKINRAFPIEKLFAAIEYYIETTNRGVTFEYIMLNEVNDGVEQALELTELLKNIKKLSYVNLIPYNPVSEHDQYSRSPKERVLAFYDTLKKKGVNCVVRQEHGTDIDAACGQLRSNTMKRDRQKAVAAVNP

SEQ ID NO: 2774 - protein, 176 aa, Streptococcus pneumoniae
MRKEIAPELYNYNKFPGPEFHLHGDKVETEGIAFSLVENIKDAFDVTTFNQRFSEVLTKFDYIVGDWSNEQLRLRGFYKDDRTEEKLEKISRLQDYLLEYCSYGCAYFVLENEAPKRASFDKKMRKTEEETPSRKGKKPTQTKRKSNADKKNRRRQKDQHSQKEDKGQRHFVIRQK

SEQ ID NO: 2775 - protein, 201 aa, Streptococcus pneumoniae
MAIILPELPYAYDALEPYIDAETMHLHHDKHHQTYVNNANAALEKHPEIGEDLEALLADVESIPADIRQALINNGGGHLNHALFWELMTPEKTAPSAELAAAIDATFGSFEEFQAAFTAAATTRFGSGWAWLVVNKEGKLEVTSTANQDTPISEGKKPILGLDVWEHAYYVKYRNVRPDYIKAFFSVINWNKVDELYAAAK

SEQ ID NO: 2776 - protein, 345 aa, Streptococcus pneumoniae
MLAIEESQKLTLSNLPSLSLFTGTDQGQFEVMKSQVLKQIGYDSADLNFAYFDMKEVVYKDVELELVSLPFFADEKIVILDYFMDITTAKKRFLTDDELKSFEEYLDNSSPTTKLIIFAEGKLDSKRRLVKLLKRDAKVFDAVEVKEQELRQYFQKWSQKQGLQFTNHSFENLLIKSGFQFSEIQKNLLFLQSYKANSVIEEEDIVNAIPKTLQDNIFDLTQFILTKKMDQARDLVRDLTLQGEDEIKLIAVMLGQFRTFTQVKILAESGQTESQIASSLGSYLGRNPNPYQIKFALRDSRGLSLSFLKQAISYLIETDYQIKTGLYEKGFLFEKALLQIASQVN

SEQ ID NO: 2777 - protein, 311 aa, Streptococcus pneumoniae
MVSTKTQIAGFEFDNCLMNAAGVACMTIEELEEVKNSAAGTFVTKTATLDFRQGNPEPRYQDVPLGSINSMGLPNNGLDYYLDYLLDLQEKESNRTFFLSLVGMSPEETHTILKKVQESDFRGLTELNLSCPNVPGKPQIAYDFETTDRILAEVFAYFTKPLGIKLPPYFDIVHFDQAAAIFNKYPLKFVNCVNSIGNGLYIEDESVVIRPKNGFGGIGGEYIKPTALANVHAFYQRLNPQIQIIGTGGVLTGRDAFEHILCGASMVQVGTTLHKEGVSAFDRITNELKAIMVEKGYESLEDFRGKLRYID

SEQ ID NO: 2778 - protein, 396 aa, Streptococcus pneumoniae
MSERKLFTSESVSEGHPDKIADQISDAILDAILAKDPEAHVAAETAVYTGSVHVFGEISTNAYVDINRVVRDTIAEIGYTNTEYGFSAETVGVHPSLVEQSPDIAQGVNEALEVRGNADQDPLDLIGAGDQGLMFGFAVDETEELMPLPIALSHKLVRRLAELRKSGEISYLRPDAKSQVTVEYDENDRPVRVDTVVISTQHDPEATNEQIHQDVIDKVIKEVIPSSYLDDKTKFFINPTGRFVIGGPQGDSGLTGRKIIVDTYGGYSRHGGGAFSGKDATKVDRSASYAARYIAKNIVAAGLAKKAEVQLAYAIGVAQPVSVRIDTFGTGTVAESQLEKAARQIFDLRPAGIIQMLDLKRPIYRQTSAYGHMGRTDIDLPWERLDKVDALKEAVK

SEQ ID NO: 2779 - protein, 447 aa, Streptococcus pneumoniae
MSFTKFQFKNYIREALKELKFTTPTEVQDKLIPIVLAGRDLVGESKTGSGKTHTFLLPIFQQLDEASDSVQAVITAPSRELATQIYQVARQISAHSDVEVRVVNYVGGTDKARQIEKLASNQPHIVIGTPGRIYDLVKSGDLAIHKAKTFVVDEADMTLDMGFLETVDKIAGSLPKDLQFMVFSATIPQKLQPFLKKYLSNPVMEKIKTKTVISDTIDNWLISTKGHDKNAQIYQLTQLMQPYLAMIFVNTKTRADELHSYLTAQGLKVAKIHGDIAPRERKRIMNQVQNLDFEYIVATDLAARGIDIEGVSHVINDAIPQDLSFFVHRVGRTGRNGLPGTAITLYQPSDDSDIRELEKLGIKFSPKMVKDGEFQDTYDRDRRANREKKQDKLDIEMIGLVKKKKKKVKPGYKKKIQWAVDEKRRKTKRAENRARGRAERKAKRQTF

SEQ ID NO: 2780 - protein, 271 aa, Streptococcus pneumoniae
MKFLTLNTHSWMEKEAEEKFQILLEDILEKDYDLICFQEINQEMTSSEVEVNDLYQALPAAEPIHQDHYVRLLVEKLLEQGKNYYWTWAYNHIGYDRYHEGVAILSKTPIEAREILVSDVDDPTDYHTRRVALAETVVDGKELAVASVHLSWWDKGFQEEWARFEAVLKKLNKPLLLAGDFNNPAGQEGYQAILASPLDLQDAFEVAQEKSGSYTVPPEIDGWKGNTEPLRIDYVFTTKELAVENLHVVFDGNKSPQVSDHYGLNAMLNWK

SEQ ID NO: 2781 - protein, 87 aa, Streptococcus pneumoniae
LSVKNFILFSQNKRLEYSFQPQVYYNSTLATAVLAAREPVFSNLTDLIASPFVKTTTVDVSRPAARIASKSAVTRRSPAATFCPSAT

SEQ ID NO: 2782 - protein, 726 aa, Streptococcus pneumoniae
MMKDTFKNVLSFEFWQKFGKALMVVIAVMPAAGLMISIGKSIVMINPTFTPLVITGGILEQIGWGVIGNLHILFALAIGGSWAKERAGGAFAAGLAFILINRITGTIFGVSGDMLKNPDAMVTTFFGGSIKVADYFISVLEAPALNMGVFVGIISGFVGATAYNKYYNFRKLPDALSFFNGKRFVPFVVILRSAIAAILLAAFWPVVQTGINNFGIWIANSQETAPILAPFLYGTLERLLLPFGLHHMLTIPMNYTALGGTYDILTGAAKGTQVFGQDPLWLAWVTDLVNLKGTDASQYQHLLDTVHPARFKVGQMIGSFGILMGVIVAIYRNVDADKKHKYKGMMIATALATFLTGVTEPIEYMFMFIATPMYLVYSLVQGAAFAMADVVNLRMHSFGSIEFLTRTPIAISAGIGMDIVNFVWVTVLFAVIMYFIANFMIQKFNYATPGRNGNYETAEGSEETSSEVKVAAGSQAVNIINLLGGRVNIVDVDACMTRLRVTVKDADKVGNAEQWKAEGAMGLVMKGQGVQAIYGPKADILKSDIQDILDSGEIIPETLPSQMTEAQQNTVHFKDLTEEVYSVADGQVVGLEQVKDPVFAQKMMGDGFAVEPANGNIVSPVSGTVSSIFPTKHAFGIVTEAGLEVLVHIGLDTVSLEGKPFTVHVAEGQKVAAGDLLVTADLDAIRAAGRETSTVVVFTNGDAIKSVKLEKTGSLAAKTAVAKVEL

SEQ ID NO: 2783 - protein, 311 aa, Streptococcus pneumoniae
MDTMISRFFRHLFEALKSLKRNGWMTVAAVSSVMITLTLVAIFASVIFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANTPNDVKTIAEDAKKIEGVSEVQDGGANTERLFKLASFIRVWGLGIAALLIFIAVFLISNTIRITIISRSREIQIMRLVGAKNSYIRGPFLLEGAFIGLLGAIAPSVLVFIVYQIVYQSVNKSLVGQNLSMISPDLFSPLMIALLFVIGVFIGSLGSGISMRRFLKI

SEQ ID NO: 2784 - protein, 68 aa, Streptococcus pneumoniae
TTTRTLFSISVASFAVLKITDANIATKVKVIMTELTAATVIQPFRFKLFKASNKWRKNLLIIVSILSF

SEQ ID NO: 2785 - protein, 230 aa, Streptococcus pneumoniae
MSIIEMRDVVKKYDNGTTALRGVSVSVQPGEFAYIVGPSGAGKSTFIRSLYREVKIDKGSLSVAGFNLVKIKKKDIPLLRRSVGVVFQDYKLLPKKTVYENIAYAMEVIGENRRNIKRRVMEVLDLVGLKHKVRSFPNELSGGEQQRIAIARAIVNNPKVLIADEPTGNLDPDNSWEIMNLLERINLQGTTILMATHNSQIVNTLRHRVIAIENGRVVRDESKGEYGYDD

SEQ ID NO: 2786 - protein, 74 aa, Streptococcus pneumoniae
ISHELSGSRFPVGSSAINTLGLFTIARAIAIRCCSPPESSFGKERTLCFNPTRSKTSITRLLILRRFSPITSIA

SEQ ID NO: 2787 - protein, 306 aa, Streptococcus pneumoniae
LNVFKNTYNTFHKMEELQDEVEILLDFLAEDESVHDELVAQLAELDKIMTSYEMTLLLSEPYDHNNAILEIHPGSGGTEAQDWGDMLLRMYTRYGNAKGFKVEVLDYQAGDEAGIKSVTLSFEGPNAYGLLKSEMGVHRLVRISPFDSAKRRHTSFTSVEVMPELDDTIEVEIREDDIKMDTFRSGGAGGQNVNKVSTGVRLTHIPTGIVVQSTVDRTQYGNRDRAMKMLQAKLYQMEQEKKAAEVDSLKGEKKEITWGSQIRSYVFTPYTMVKDHRTSFEVAQVDKVMDGDLDGFIDAYLKWRIS

SEQ ID NO: 2788 - protein, 218 aa, Streptococcus pneumoniae
MAVKDFMTRKVVYISPDTTVSHAADLMREQGLHRLPVIENDQLVGLVTEGTIAQASPSKATSLSIYEMNYLLNKTKVKDVMIRDVVTVSGYASLEDATYLMLKNKIGILPVVDNHQVYGVITDRDVFQAFLEIAGYGEEGIRVRFVTEDEVGVLGKIVSLIVEENLNISHTVNIPRKDGKVIIEVQIDESIDLPALKEKFEANGIQVEEIARTSAKVL

SEQ ID NO: 2789 - protein, 236 aa, Streptococcus pneumoniae
MSMLKVENLSVHYGMIQAVRDVSFEVNEGEVVSLIGANGAGKTTILRTLSGLVRPSSGKIEFLGQEIQKMPAQKIVAGGLSQVPEGRHVFPGLTVMENLEMGAFLKKNREENQANLKKVFSRFPRLEERKNQDAATLSGGEQQMLAMGRALMSTPKLLLLDEPSMGLAPIFIQEIFDIIQDIQKQGTTVLLIEQNANKALAISDRGYVLETGKIVLSGSGKELASSEEVRKAYLGG

SEQ ID NO: 2790 - protein, 66 aa, Streptococcus pneumoniae
MISKISWMKIGASPIDGSSKRRSFGVDIRARPMASICCSPPERVAASWFFRSSRRGKREKTFFKLA

SEQ ID NO: 2791 - protein, 254 aa, Streptococcus pneumoniae
MALLEVKQLTKHFGGLTAVGDVTLELNEGELVGLIGPNGAGKTTLFNLLTGVYEPSEGTVTLDGHLLNGKSPYKIASLGLGRTFQNIRLFKDLTVLDNVLIAFGNHHKQHVFTSFLRLPAFYKSEKELKAKALELLKIFDLDGDAETLAKNLSYGQQRRLEIVRALATEPKILFLDEPAAGMNPQETAELTELIRRIKDEFKITIMLIEHDMNLVMEVTERIYVLEYGRLIAQGTPDEIKTNKRVIEAYLGGEA

SEQ ID NO: 2792 - protein, 318 aa, Streptococcus pneumoniae
MKENLKVNILWLLLLLAGYSLISVLVSVGVLNLFYVQILQQIGINIILAVGLNLIVGFSGQFSLGHAGFMAIGAYAAAIIGSKSPTYGAFFGAMLVGALLSGAVALLVGIPTLRLKGDYLAVATLGVSEIIRIFIINGGSLTNGAAGILGIPNFTTWQMVYFFVVITTIATLNFLRSPIGRSTLSVREDEIAAESVGVNTTKIKIIAFVFGAITASIAGSLQAGFIGSVVPKDYTFINSINVLIIVVFGGLGSITGAIVSAIVLGILNMLLQDVASVRMIIYALALVLVMIFRPGGLLGTWELSLSRFFKKSKKEEQN

SEQ ID NO: 2793 - protein, 292 aa, Streptococcus pneumoniae
VNLMLQQLVNGLILGSVYALLALGYTMVYGIIKLINFAHGDIYMMGAFIGYFLINSFQMNFFVALIVAMLVTAILGVVIEFLAYRPLRHSTRIAVLITAIGVSFLLENGMVYLVGANTRAFPQAIQTVRYDLGPISLTNVQLMILAISLILMILLQVIVQKTKMGKAMRAVSVDSDAAQLMGINVNRTISFTFALGSALAGAAGVLIALYYNSLEPLMGVTPGLKSFVAAVLGGIGIIPGAALGGFVIGLLETFATAFGMSDFRDAIVYGILLLILIVRPAGILGKNVKEKV

SEQ ID NO: 2794 - protein, 386 aa, Streptococcus pneumoniae
MKKKFALSFVALASVALLAACGEVKSGAVNTAGNSVEEKTIKIGFNFEETGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 2795 - protein, 149 aa, Streptococcus pneumoniae
LISSTANWAPFCSAVPYAAKEPVSSKLNPILIVFSSTELPAVLTAPDFTSPQAARSATLASATNDRANFFFIFLSPYFLNSLLRIYRIIRKLSMFSLNFFDDNVFLSIKIAHKGCFQLLDMTNPNFFNKFFLAQASDQLLHFLSWNIEL

SEQ ID NO: 2796 - protein, 82 aa, Streptococcus pneumoniae
MFEKVNRSGLIIYLYYNRDAKKLQDYGDITYHSKKHRYLQLYVPTQEVEQLVGRLSKEKFIKKVRVCHIQELETPFVGNLYR

SEQ ID NO: 2797 - protein, 196 aa, Streptococcus pneumoniae
MIPVVIEQTSRGERSYDIYSRLLKDRIIMLTGPVEDNMANSVIAQLLFLDAQDSTKDIYLYVNTPGGSVSAGLAIVDTMNFIKADVQTIVMGMAASMGTVIASSGAKGKRFMLPNAEYMIHQPMGGTGGGTQQTDMAIAAEHLLKTRNTLEKILAENSGQSMEKVHADAERDNWMSAQETLEYGFIDEIMANNSLN

SEQ ID NO: 2798 - protein, 216 aa, Streptococcus pneumoniae
LKEGIPKMGKIEVINHPLIQHKLSILRRTDTSTKAFRELVDEIAMLMGYEVLRDLPLEDVEIETPITKTVQKQLAGKKLAIVPILRAGIGMVDGLLSLVPAAKVGHIGMYRDEETLQPVEYLVKLPEDIDQRQIFVVDPMLATGGSAILAVDSLKKRGASNIKFVCLVSAPEGVKALQEAHPDVEIFTAALDERLNEHGYIVPGLGDAGDRLFGTK

SEQ ID NO: 2799 - protein, 54 aa, Streptococcus pneumoniae
LEFLLSIYSSYYTKKRVKNLSKPFIFDNFYIRSASLRAVCTVSSGKWVNSVPFS

SEQ ID NO: 2800 - protein, 155 aa, Streptococcus pneumoniae
MTEKRLAWDEYFAAQALLIANRSTCKRAKVGAILVKDNKVISTGYNGSVSGTEHCIDHECLVIEGHCVRTLHAEVNAILQGAERGVPKGFTAYVTHFPCLNCTKQLLQVGCKRVVYINQYRMDDYAQYLYQEKGTELTHLPLETVQTALKEADLM

SEQ ID NO: 2801 - protein, 185 aa, Streptococcus pneumoniae
MSERRISEKSLENLRKSNQESNLLTREAIETALLQLLEKKELTKISISELVKRAGVSRAAFYRNYDSNEEILESVFKRTVHNIMEQLHHYDLKTDLYLVWVHLFREARKEARVIQLALDYHLEKIFVQAMQEFLGKYHGKSKGVSSYLHSFWSSAIVSVLLKWIKDGMKVPAEKIADLGLPFFKK

SEQ ID NO: 2802 - protein, 281 aa, Streptococcus pneumoniae
MTWKIIADSGCDYRQLPTPAINTTFVSVPLTIQVADQVFVDDASLDIDQMMETMYATAEASKSACPSPDDYLRAFEGAKNIFLVTITGTLSGSHNSAQLAKNIYLEDHPDTKIHVIDSLSAGGEVDLLVEKLNDLIDQGLSFEEVVEAITAYQEKTKLLFVLAKVDNLVKNGRLSKLIGTVVGLLNIRMVGKASETGTLELLQKARGSKKSVQAAYDELVKAGYAGGRIVMAQRNNEKCCQQLSERIRETFPQADIKILPTSGLCSFYAEDGGLLMGYEID

SEQ ID NO: 2803 - protein, 391 aa, Streptococcus pneumoniae
MKHFDTIVIGGGPAGMMATISSNFYGQKTLLIEKNRKLGKKLAGTGGGRCNVTNNGSLDNLLAGIPGNGRFLYSVFSQFDNHDIINFFTENGVKLKVEDHGRVFPASDKSRTIIEALEKKITELGGQVATQIEIVSVKKVDDQFVLKSADQTFTCEKLIVTTGGKSYPSTGSTGFGHEIARHFKHTITDLEAAESPLLTDFPHKALQGISLDDVTLSYGKHVITHDLLFTHFGLSGPAALRMSSFVKGGEVLSLDVLPQLSEKDLVTFLEENREKSLKNALKTLLPERLAEFFVQGYPEKVKQLTEKEREQLVQSIKELKIPVTGKMSLAKSFVTKGGVSLKEINPKTLESKLVPGLHFAGEVMDINAHTGGFNITSALCTGWVAGSLHYD

SEQ ID NO: 2804 - protein, 151 aa, Streptococcus pneumoniae
MNRREAVEFVNMCMIKNGDKVLVQDRVSPDWSGITFPGGHVERGESFVDAVIREVKEETGLIISKPQLCGIKNWYDDKDYRYVVLFYKTEHFTGELQSSDEGKVWWEDFENLSHLKLATDDMSDMLRVFLEEDLSEFFYYKNGDDWLYDLK

SEQ ID NO: 2805 - protein, 172 aa, Streptococcus pneumoniae
LPHLTRQLDYLTRERQHLDTLISTLQKTIQEQKGERKMTIEEKFTGFSYQDNQKYHQEAVEKYGQEVMGQALERQKGHEDEATAAFNQVFQTLAQNLQVGLPATATENQEQAAKLLQAIRTYGFDCSIEVFGHIGKGYVYNPEFKENIDKFGSGTAQYTSDAIAAYVQTNAE

SEQ ID NO: 2806 - protein, 489 aa, Streptococcus pneumoniae
LKMVFLTDLRKHDRIVKSINQTEGYLTTQVAFSYFEKGDQSLTMSEKSQWGSKLGFILASAGSVIGLGSVWKFPYMTAANGGGGFLLIFLISTILIDFPLLLAEFALGRSAGVSAIKTFGKLGKNNKYNFIGWIGAFALFILLSFYSVIGGWILVYLGIEFGKLFQLGGTGDYAQLFTSIISNPAIALGAQATFILLNIFIVSRGVQKGIERASKVMMPLLFIIFVVIIERSLSLPNAMEGVLYFLKPDFSKLTSAGLLYALRQSFFALSLGVTAMLTYASYLDKKTNLVQSRISIVAMNISVSIMAGLAIFQARSPFNIQSEGGPSLVFIVLPQLFDKMPFGTIFYVLFLFATVTSSVVMLEINVDNITNQDNSKRAKWSVILGILTFVFGIPSALSYGVMADVHIFGKAFFDAMDFLVSNLLMPFGALFLSLFTGYIFKKALAMEELHLDERAWKQGLFQVWLFLLRFVIPIIICGLHRPIYVIKRT

SEQ ID NO: 2807 - protein, 314 aa, Streptococcus pneumoniae
MSEPLFLQSVMQEKIWGGAKLRDEFGYDIPSEKIGEYWAISAHPNGVSKVANGRYEGTDLATLYAEHRELFGNRPEPVFPLLTKILDANDWLSVQVHPDDAYGLEHEGELGKTECWYIIAADEGSEIIYGHNAKSKEELRQQIEDKNWDALLTKVPVKAGDFFYVPSGTMHAIGAGILILETQQSSDTTYRVYDFDRKDDKGNLRELHLEKSIDVLNIGEPANSRPVTIKADDLRSTLLVSNDFFAVYKWEITGKVNFEKTADYSLLSVLAGQGQLTVDGKNYPIQKGRHFILPSDVESWTLEGQDLELIVSHP

SEQ ID NO: 2808 - protein, 133 aa, Streptococcus pneumoniae
MSLIAMVQASGRAHLFTIFIKSSPCFIRCKKEFNSNSFFAIMRGEKSDRRSTCQNHYFYNQLCKKKSGVEPSYVMSLATISQVKKSENIGPSQPIQMESLKLPMVVTREQILLLCMRNTVNYLAIVQNLYFHF

SEQ ID NO: 2809 - protein, 109 aa, Streptococcus pneumoniae
FSIIVENGLGAMDTPDENGYVADNYRITYLEAHIKAMRDAIYQDGVDLLGYTTWSCIDPVSAGTGEMNKRYGFIYVDRDNVGNGALKRSKKKSFYWYKDVIDSNGASIG

SEQ ID NO: 2810 - protein, 88 aa, Streptococcus pneumoniae; identical to SEQ ID NO: 2727

SEQ ID NO: 2811 - protein, 217 aa, Streptococcus pneumoniae
MVGEILCHVQNILGKQTLKPLSRLKIKSQFKKARKRFKYSRRFRKVRLMYQDEAGFSRISKLGSCWSPIGVDPHVHSHYIREFRYCYGAVDAYTGESFFLIAGRCNTEWMNAFLEELSQAYPDDYLLLVMDNAIWHKSSILKIPTNIGFAFIPPYTPEMNPIEQVWKEIRKRGFKNKAFRILEDVMNQLQDVIQGLEKEVIKSIVNRRWTRMLFESR

SEQ ID NO: 2812 - protein, 115 aa, Streptococcus pneumoniae
MNLNQLDIIVSNVPQVCADLEHILDKKADYADDGFAQFTIGSHCLMLSQNHLVPLENFQSGIIIHIEVEDVDQNYKRLNELGIKVLHGPTVTDWGTESLLVQGPAGLVLDFYRMK

SEQ ID NO: 2813 - protein, 591 aa, Streptococcus pneumoniae
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAISKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFPFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSIDVGNTTQTSTRHLHMTPKNMWRTSPLFATMGIALPGGIAAKKDNPDRQVWNIMGDGAFNMCYPDVITNVQYDLPVINLVFSNAEYGFIKNKYEDTNKHLFGVDFTNADYAKIAEAQGAVGFTVDRIEDIDAVVAEAVKLNKEGKTVVIDARITQHRPLPVEVLELDPKLHSEEAIKAFKEKYEAEELVPFRLFLEEEGLQSRAIK

SEQ ID NO: 2814 - protein, 66 aa, Streptococcus pneumoniae
VRKPFIEFYSIFSGLLSTMLSGIPIAAGVFSGVGLALNPELAGLAMAFSSVSVLTSSLLLNFSKID

SEQ ID NO: 2815 - protein, 732 aa, Streptococcus pneumoniae
VETMTEIVKASLENGIQKIRIRAEKGYHPAHIQLQKGIPAEITFHRATPSNCYKEILFEEEGILEPIGVDEEKVIRFTPQELGRHEFSCGMKMQKGSYIVVEKTRKSLSLLQRFWITSIFTVPLVILMIGMLTGSISHQVMHWGTFLATTPIMLVAGKPYIQSAWASFKKHNANMDTLVALGTLVAYFYSLVALFAGLPVYFESAGFILFFVLLGAVFEEKMRKNTSQAVEKLLDLQAKTAEVLSDDSYVQVPLEQVKVGDLIRVRPGEKIAVDGVVVEGVSSIDESMVTGESLPVDKTVGDTVIGSTINHSGTLVFRAEKVGSETVLAQIVDFVKKAQTSRAPIQDLTDKISGIFVPVVVILGIMTFWVWFVLLRDSVVVLGASFVSSLLYGVAVLIIACPCALGLATPTALMVGTGRSAKMGVLLKNGTVLQEIQKVQTLVFDKTGTLTEGKPVVTDIIGDEVEVFGLAASLEDASQHPLAEAIVKRASEAGLEFKTVENFQALHGKGVSGRINGKQVLLGNAKMLDGMDISNTYQDKLEELEKEAKTVVFLAVDNEIKGLLALQDIPKENAKLAISQLKKRGLRTVMLTGDNAGVACAIADQIGIEEVIAGVLPEEKAHEIHKLQQSGKVAFVGDGINDAPALSVADVGIAMGAGTDIAIESADLVLTTNNLLGVVRAFDMSKKTFHRILLNLFWAFIYNVVGNSDCSRSLFRCWTGSQPRIGRSSHGL

SEQ ID NO: 2816 - protein, 84 aa, Streptococcus pneumoniae
KVFLLISKARTTPKRLLVVNTKSADSMAISVPAPIAIPTSATLRAGASLIPSPTKATFPDCCSLWISWAFSSGKTPAMTSSIPI

SEQ ID NO: 2817 - protein, 60 aa, Streptococcus pneumoniae
MVEPMTVSPTVLSTGRLSPVTMDSSILETPSTTTPSTAIFSPGRTRIRSPTLTCSKGTWT

SEQ ID NO: 2818 - protein, 123 aa, Streptococcus pneumoniae
MLNSIVTIICIALIAFILFWFFKKPEKSGQKAQQKNGYQEIRVEVMGGYTPELIVLKKSVPARIVFDRKDPSPCLDQIVFPDFGVHANLPMGEEYVVEITPEQAGEFGFACGMNMMHGKMIVE

SEQ ID NO: 2819 - protein, 141 aa, Streptococcus pneumoniae
LTNVDFGGMVMQISDAEWQVMKIIWMQGEQTSTDLIRVLAERFDWSKSTIQTLLARLVEKECLTRKKEGKFFVYSALLTLDQSRDLLVQDIKDKVCSRRIRNLLADLIVECEFTQTDLEDLEAVISEKKSSAVTEVRCNCM

SEQ ID NO: 2820 - protein, 268 aa, Streptococcus pneumoniae
MTYLPVALTIAGTDPSGGAGIMADLKSFQARDVYGMAVVTSLVAQNTRGVQLIEHVSPQMLKAQLESVFSDIPPQAVKTGMLATTEIMEIIQPYLKKLDCPYVLDPVMVATSGDALIDSNARDYLKTNLLPLATIITPNLPEAEEIVGFSIHDPEDMQRAGRLILKEFGPQSVVIKGGHLKGGHLKGGAKDFLFTKNEQFVWESPRIQTCHTHGTGCTFAAVITAELAKGKSLYQAVDKAKAFITKAIQDAPQLGHGSGPVNHTTFKD

SEQ ID NO: 2821 - protein, 210 aa, Streptococcus pneumoniae
MNREALRLYLVTNRYQDSVESFLAKVETACRSGVTIVQLREKNLTTNQYYQLAKQVKEITDAYQVPLIIDDRLDVCLAVDAAGLHIGDDELPVSVARQVLGPEKILGVTAKTVKRALEAEKSGADYLGTGAIFPTTTKENAPITLISTLKTICQTVAIPIVAIGGLTSENIDQLMGTGIAGVAVVRDLMQAEDIEAKTQAFLTKLHDILS

SEQ ID NO: 2822 - protein, 268 aa, Streptococcus pneumoniae
MMQALTNPFPIGSSSLIHCMTNEISCEMLANGILALGCKPVMADDPREVLDFTKQSQALFINLGHLSAEKEKAIRMAALYANQSSLPMVVDAVGVTTSSIRKSLVKDLLDYRPTVLKGNMSEIRSLVGLKHHGVGVDASAKDQETEDLLQVLKDWCQTYPGMPFLVTGPKDLIVSENQVAVLENGCTELDWITGTGDLVGALTAVFLSQGKTGFEASCLAVSYLNIAAEKIVVQGMGLEEFRYQVLNQLSLLRRDENWLDTIKGEVYE

SEQ ID NO: 2823 - protein, 174 aa, Streptococcus pneumoniae
MRKHQLQVHKLTILSMMIALDVVLTPIFRIEGMAPMSSVVNILAGIMMGPVYALAMATVTAFIRMTTQGIPPLALTGATFGALLAGLFYKYGRKFYFSALGEIVGTGIIGSIVSYPVMVLFTGSAAKLSWFIYTPRFFGATLIGTAISFIAFRFLIKQEFFKKVQGYFFAERIE

SEQ ID NO: 2824 - protein, 230 aa, Streptococcus pneumoniae
MEFTDIAMELSKKAWQASFHHPFILQLQEGNLEPAIFRYYLIQDAYYLKAFSEIYHLLADKTSNQEMKRLLKQNAQGLVEGELFIRQQFFKEMEISDQEMEQHPIAPTCYHYISHIYRQFAEPNLAIAFASLLPCPWLYHDIGKSLNLKPSPNPLYQQWIETYITDELEQQIREEGALVNQLYRESDETDKQKMLDAFHISVHMEAKFWEMAYQHQTWKSDLQSLEKGEE

SEQ ID NO: 2825 - protein, 216 aa, Streptococcus pneumoniae
MVKVATQTPIISLFLLILSLETSFIPSIALNLSVVAFCILFMLYYRRFKMLAWMIILAILPSFANYWAVQLHGDASQAVMLGTRAFVTVCIGLVFVSSISLKELLLYLAQKGLSRSWSYALIVVFNSFPLIQQEIKSLKEACLLRGQELYFWSPLIYSKVLMTVFRWRHLYLRALSAHGYDEHAQLKNSYRTFYIPKKTKLIYLLFFLLLQTSLFL

SEQ ID NO: 2826 - protein, 461 aa, Streptococcus pneumoniae
MGLELRAIQSPIFSEPFDFTFHAQAFTLLVGSSGSGKSSLFQVIAQVSSLPYSGQVLIDGSEVSQLSIIARVQKVGILFQNPNHQFTMENLFEELIFTLENIGYHLQEIDSKIAEVVQQCRCEAILHRPIHHLSGGEKQKAALAVLFAMNPRVYLLDEPFASIDRKSRIEILEILKELALDGKTVILCDHDLSDYKAYIDHMVELRDGKLREVFQIPSYEMTQVASKEVASSPELFHMNRVTGELGNRPLFSIADFTFYQGISCILGDNGVGKSTLFRSILQFQKYKGRIAWKGTVLKKKKSLYRDLTGVVQEAEKQFIRVSLREELRLDGPDSERNQRIFQALRYFDLEQAVDKSPYQLSGGQQKILQLLTILTSKASVILLDEPFAGLDDRACHYFCKWIVEERNQGRSFLLISHRLDPLISVVDYWIEMTSQGLSHVKEVTITKPLTSQSSNTQGEVR

SEQ ID NO: 2827 - protein, 186 aa, Streptococcus pneumoniae
MLKKWQLKDVILLAFLSIFFGGVFVGSGYVYNILSLLLTPLGLQAFANEILFGLWCMAAPIAAIFVPRVGSATIGEVLAALAEVLYGSQFGLGALLSGLVQGLGSEFGFIVTKNRYESWLSLTANSIGVTLVSFVYEYIKLGYYAFSLPFVLSLLVVRFISVYFFCTILVRAIVKLYHQFATGGKA

SEQ ID NO: 2828 - protein, 74 aa, Streptococcus pneumoniae
NQIHFPNLEPSQTKELLDQIGYHKGLQQAQLALLQSLHFRLSEQRWQQWAQPYTRDRRGFHWQRPANQEVLRVD

SEQ ID NO: 2829 - protein, 68 aa, Streptococcus pneumoniae
LHSQRQQIFLLQKTNDLFDELAIQAESRHSFLKKENPTYLESKDRYLLFTHFPNSFFYIFCIRYCRND

SEQ ID NO: 2830 - protein, 209 aa, Streptococcus pneumoniae
MFHKELLKLYFICGTTTCQGKNLYTVVEEALKGGITLFQFREKGESALEGLEKLELAIQIKELCKKYNVPFIVNDDIDLAMEIDADGVHVGQDDIGVDEIRKLMPDKIIGLSIRNEEEFQQSKVEYVDYVGVGPVFDTQSKDDAGGAIGYEGLELMRKLLPQMPLVAIGGIQTKHIKDIIKTNVDGVSIISAISYAKNIEKTVREMSEQ

SEQ ID NO: 2831 - protein, 267 aa, Streptococcus pneumoniae
VKRKDFNMTSLKLLKEKAPLVICITNDVVKNFTANGLVALGVSPAMSEFPADLEDLLKYAGGLLINIGTLTDENWKLYQAALKIAEKYNVPAVLDPVACGAGEYRKKVADDLINNYKLAAIRGNAGEIASLVGIDVASKGVDSAGVDNIDEIALAANEKFNIPIVVTGEVDAIAVNGEVVTIHNGSAMMPKVIGTGCLLGAVVASFIGLEKGQELKSLETAMLVYNIAGEMAEKRPNGHLPGTFKVEFINALYEITDEDVKEFKRVK

SEQ ID NO: 2832 - protein, 136 aa, Streptococcus pneumoniae
LLIRSSATFFLYSPAPQATGSKTAGTLYFSAIFRAAWYNFQFSSVNVPMFINKPPAYFNKSSKSAGNSLMAGETPSATNPFAVKFFTTSLVIQMTNGAFSFNNFKLVILKSFLFTLYDLLISIYLYLSLRNFFHLR

SEQ ID NO: 2833 - protein, 81 aa, Streptococcus pneumoniae
LNDLYSMKIKEQTRKLTADCSKHCFEPVDKTDEVSSKHCFEVVDRTDEVSNHTYGKVKLTWFEEIFEEYYLIKFVNIMSLL

SEQ ID NO: 2834 - protein, 74 aa, Streptococcus pneumoniae
VWLLTSSVLSTTSKQCFELTSSVLSTGSKQCFEQSAVSFLVCSLIFIEYKSFNVNEKNFLTKDRDKSKSVDRIK

SEQ ID NO: 2835 - protein, 222 aa, Streptococcus pneumoniae
METQDYAFQPGLTVGELLKSSQKDWQAAINHRFVKELFAGTIENKVLKDYLIQDYHFFDAFLSMLGACVAHADKLESKLRFAKQLGFLEADEDGYFQKAFKELKVAENDYLEVTLHPVTKAFQDLMYSAVASSDYAHLLVMLVIAEGLYLDWGSKDLALPEVYIHSEWINLHRGPFFAEWVQFLVDELNRVGKNREDLTELQQRWNQAVALELAFFDIGYDV

SEQ ID NO: 2836 - protein, 378 aa, Streptococcus pneumoniae
MSYKTSNAEGHVDFINTYDLEPMAQQVIPKAAFGYIASGAEDTFTLRENIRAFNHKLIVPHTLCDVENPSTEIEFAGEKLSSPIIMAPVAAHKLANEQGEVATARGVHEFGSLYTTSSYSTVDLPEISEALQGTPHWFQFYFSKDDGINRHIMDRVKAEGYKAIVLTADATVGGNREVDKRNGFVFPVGMPIVEEYLPEGAGKSMDFVYKSAKQRLSPRDVEFIAEYSGLPVYVKGPQCREDVERSLAAGASGIWVTNHGGRQIDGGPAAFDSLQEVAEAVDRRVPIVFDSGVRRGQHVFKALASGADLVAIGRPVIYGLALGGSVGVRQVFEHLNAELKTVMQLSGAQTIEDVKHFKLRHNPYNPTFPVDPRDLKLY

SEQ ID NO: 2837 - protein, 496 aa, Streptococcus pneumoniae
MSTEHMEELNDQQIVRREKMAALREQGIDPFGKRFERTANSQELKDKYANLDKEQLHDKNETATIAGRLVTKRGKGKVGFAHLQDREGQIQIYVRKDAVGEENYEIFKKADLGDFLGVEGEVMRTDMGELSIKATHITHLSKALRPLPEKFHGLTDVETIYRKRYLDLISNRESFERFVTRSKIISEIRRYLDQKGFLEVETPVLHNEAGGAAARPFITHHNAQNIDMVLRIATELHLKRLIVGGMERVYEIGRIFRNEGMDATHNPEFTSIEVYQAYADFQDIMDLTEGIIQHAAKSVKGDGPVNYQGTEIKINEPFKRVHMVDAIREITGVDFWQDMTLEEAKAIAAEKKVPVEKHYTEVGHIINAFFEEFVEETLIQPTFVYGHPVAVSPLAKKNPEDQRFTDRFELFIMTKEYGNAFTELNDPIDQLSRFEAQAKAKELGDDEATGIDYDYIEALEYGMPPTGGLGIGIDRLCMLLTDTTTIRDVLLFPTMK

SEQ ID NO: 2838 - protein, 226 aa, Streptococcus pneumoniae
LDWSIVEQYLPLYQKAFFLTLHIAVWGILGSFLLGLIVSIIRHYRIPVLAQVATAYIELSRNTPLLIQLFFLYFGLPRIGIVLSSEVCATLGLVFLGGSYMAESFRSGLEAISQTQQEIGLAIGLTPLQVFRYVVLPQATAVALPSFSANVIFLIKETSVFSAVALADLMYVAKDLIGLYYETDIALAMLVVAYLIMLLPISLVFSWIERRTRHAGFGNPSTLSRK

SEQ ID NO: 2839 - protein, 126 aa, Streptococcus pneumoniae
MQDSGIQVLFQGNNLLRILQGLGVTIGISILSVLLSMMFGTVMGIIMTSHSRIIRFLTRLYLEFIRIMPQLVLLFIVYFGLARNFNINISGETSAIIIFTLWGTAEMGDLVRGAITSLPKHQFESG

SEQ ID NO: 2840 - protein, 95 aa, Streptococcus pneumoniae
LTNVQLYYHIIIPQVLRRLLPQAINLVTRMIKTTSLVVLIGVVEVTKVGQQIIDSNRLTIPTASFWIYGTILVLYFAVCYPISKLSTHLEKHWRN

SEQ ID NO: 2841 - protein, 70 aa, Streptococcus pneumoniae
MSETILEIKELKKSFGDNPILQGLSLEIKKGGSCCHPRGIWLWEKYPPSLPQRLRKYSRWRYSSGWSVYR

SEQ ID NO: 2842 - protein, 168 aa, Streptococcus pneumoniae
MVFQSYELFPHLDVLQNLILGPIKAQGRDKKEVTEEALQLLERVGLLDKQHSFARQLSGGQKQRVAIVRALLMHPEIILFDEVTASLDPEMVREVLELINDLTQEGRTMILVTHEMQFAQAITDRIIFLDQGKIAEEGTAQAFFTNPQTKRAQEFLNVFDFSQFGSYL

SEQ ID NO: 2843 - protein, 66 aa, Streptococcus pneumoniae
MAWANCISWVTKIMVRPSWVKSLISSSTSRTISGSSEAVTSSKRMISGCIRRARTIATRCFCPPDN

SEQ ID NO: 2844 - protein, 80 aa, Streptococcus pneumoniae
MKLFKPLLTVLALAFALIFITACSSGGNAGSSSGKTTAKARTIDEIKKSGELRIAVFGDKKPFGYVDNDGSYQGYATILN

SEQ ID NO: 2845 - protein, 184 aa, Streptococcus pneumoniae
LISNKVDITLANFTVTDERKKQVDFALPYMKVSLGVVSPKTGLITDVKQLEGKTLIVTKGTTAETYFEKNHPEIKLQKYDQYSDSYQALLDGRGDAFSTDNTEVLAWALENKGFEVGITSLGDPDTIAAAVQKGNQELLDFINKDIEKLGKENFFHKAYEKTLHPTYGDAAKADDLVVEGGKVD

SEQ ID NO: 2846 - protein, 215 aa, Streptococcus pneumoniae
MNEIITLKNIELKLKKTCVFQNLNFSCKQGEIIGITGANGSGKSVLFKLIAGLYSPSYGEVLINGENIVPERKIPANLGALIEEPGFINYYSGFKNLQYLASIRGVVGNQEINDTLKIVGLYEQKDQKVKTYSLGMRKKLGIAQAIMENPSILLLDEPMNALDKSSVENMRTLFRKLSSEKGTTILIASHSEEDIRILCDKVYAIEDKVCTLCSD

SEQ ID NO: 2847 - protein, 234 aa, Streptococcus pneumoniae
LKMGKLSSHIWRLNQIIYTKYFWGYVLFWILICLGLWYWLEGNDRLVIEILKGPNLSQNSFLFLSIWLLHWFIIHTFFLAVVYRRRASDFFLEVIRFSSIKLWIRYQIWTCFLYGLILIMVKVLVIQFMLQLPNWDIGVLFIVDFLNACVLVLFCFMLYALGANVQMNFACVSFFLLMIVFGGLFVGNRTNYLFYILNRGNGDIGRDLFLQLLFLVFLFKSIFYFTRQKRRFIE

SEQ ID NO: 2848 - protein, 67 aa, Streptococcus pneumoniae
QVYHFLLTNTIILNKSISKKEHNPKSTWYRLSDSTSICDYLTFPFSTFTLSSSFYEQENTFHGIYDR

SEQ ID NO: 2849 - protein, 268 aa, Streptococcus pneumoniae
LFGCLWYIFSTFRGLCIMKQFVQFYKKDFLAVLVYFILLLSCVLSSTVYLLRCRQYSIHPNVLEWILVLLQDMTTGVYCFPFTYILFFFYLMNNYFNRLECRIRLKSIKHFTSFSFKLAALSTGIWTAILFLLIFLIAFSNGFSFSLEIKEVDFLREFYGISIANNASFFIGFFFSYIAYYFFLSLLTISSFSWFKKSNMSLVFLFTFLFVESLFWIYQLNNGIIGLLPIFQYMVNSNPYALIYWPGITIYHKSHGMYFPVHRNWRRV

SEQ ID NO: 2850 - protein, 254 aa, Streptococcus pneumoniae
MEFFICNLVRVVQSPRFYMSLFLTLLCMSLGNFLAFNGIYKIEGLSIFFAASSIRGFSPISLVAALICTLPYSSQIIEDAESHFLTAQLCRISKKRYLAIVGSTAIISSFLVFFLPYLLLLGINLLVTPYQEIYIGDYSGALKELFDSNQFLYSLVTTLWYGVWGAVFSIFGLASALLVKKKLGAIFIPVAYMMVGGILWAILGLSYLEPVTTLALGYQKDISLSLVSGHLAFILFVSCLVVYGTFFLHSEDYV

SEQ ID NO: 2851 - protein, 116 aa, Streptococcus pneumoniae
LFLPTVLARQIGNYDLTLPRWGSDTTSELEKENASAGINNSDSTGGGKRLNTSIRSAYSGSDITPVYSLGSGSRIVMYYNGGGDNYIGSGTRLAMAPQFGNHVRIHTSGSWSPDSY

SEQ ID NO: 2852 - protein, 210 aa, Streptococcus pneumoniae
MTLAKDIASHLLKIQAVYLKPEEPFTWASGIKSPIYTDNRVTLAYPETRTLIENGFVEAIKEAFPEVEVIAGTATAGIPHGAIIADKMDLPFAYIRSKPKDHGAGNQIEGRVAQGQKMVVVEDLISTGGSVLEAVAAAKREGADVLGVVAIFSYQLPKADKNFADAGVKLVTLSNYSELIHLAQEEGYITPEGLDLLKRFKEDQENWQEG

SEQ ID NO: 2853 - protein, 233 aa, Streptococcus pneumoniae
MREHRPIIALDFPSFEAVKEFLALFPAEESLYLKVGMELYYAAGPEIVSYLKGLGHSVFLDLKLHDIPNTVKSAMKVLSQLGVDMTNVHAAGGVEMMKAAREGLGSQAKLIAVTQLTSTSEAQMQEFQNIQTSLQESVIYYAKKTAEAGLDGVVCSAQEVQVIKQATNPDFICLTPGIRPAGAAVGDQKRVMTPADAYQIGSDYIVVGRPITQAEDPVAAYHTIKDEWTQDWN

SEQ ID NO: 2854 - protein, 66 aa, Streptococcus pneumoniae
LPLWTALKVFYYSIISTSTCQVKTWSLKNYKRKSKPSDAMSAGSFGFDCSLPLVFSVLLLVFSQLP

SEQ ID NO: 2855 - protein, 399 aa, Streptococcus pneumoniae
MSKDKKNEDKEILEELKELSEWQKRNQEYLKKKAEEEAALAEEKEKERQARMGEESEKSEDKQDQESETDQEDSESAKEESEEKVASSEADKEKEEKEESESKEKEEQDKKLAKKATKEKPAKAKIPGIHILRAFTILFPSLLLLIVSAYLLSPYATMKDIRVEGTVQTTADDIRQASGIQDSDYTINLLLDKAKYEKQIKSNYWVESAQLVYQFPTKITIKVKEYDIVAYYISGENHYPILSSGQLETSSVSLNSLPETYLSVLFNDSEQIKVFVSELAQISPELKATIQKVELAPSKVTSDLIRLTMNDSDEVLVPLSEMSKKLPYYSKIKPQLSEPSVVDMEAGIYSYTVADKLIMEAEEKAKQEAKEAEKKQEEEQKKQEEESNRNQTTQRSSRR

SEQ ID NO: 2856 - protein, 147 aa, Streptococcus pneumoniae
VKARKIWIPGIFALAGFSFVAFLASFLSCSSFSLDSDSSFSSFSLSASEDATFSSDSSLADSESSWSVSLSWSCLSSDFSDSSPIRACLSFSFSSARAASSSAFFFRYSWFRFCHSDNSFNSSRISLSSFFLSFDIYFPYDKSFFNN

SEQ ID NO: 2857 - protein, 352 aa, Streptococcus pneumoniae
MKKIVFTGGGTVGHVTLNLLLMPKFIEDGWEVHYIGDKRGIEHQEILKSGLDVTFHSIATGKLRRYFSWQNMLDVFKVGWGIVQSLFIMLRLRPQTLFSKGGFVSVPPVIAARVSGVPVFIHESDLSMGLANKIAYKFATKMYSTFEQASSLSKVEHVGAVTKVSDQKNPEPDELVDIQSHFNHKLPTVLFVGGSAGARVFNQLVTDHKKELTERYNIINLTGDSSLNELSQNLFRVDYVTDLYQPLMELADIVVTRGGANTIFELLAIAKLHVIVPLGREASRGDQIENAAYFVKKGYAEDLQESDLTLDSLEEKLSHLLSHKEDYQAKMKASKELKSLADFYQLLKKDLS

SEQ ID NO: 2858 - protein, 450 aa, Streptococcus pneumoniae
MKVIDQFKNKKVLVLGLAKSGESAARLLDKLGAIVTVNDGKPFEDNPAAQSLLEEGIKVITGGHPLELLDEEFALMVKNPGIPYNNPMIEKALAKGIPVLTEVELAYLISEAPIIGITGSNGKTTTTTMIGEVLTAAGQHGLLSGNIGYPASQVAQTASDKDTLVMELSSFQLMGVQEFHPEIAVITNLMPTHIDYHGSFSEYVAAKWNIQNKMTAADFLVLNFNQDLAKDLTSKTEATVVPFSTLEKVDGAYLEDGQLYFRGEVVMAANEIGVPGSHNVENALATIAVAKLRGVDNQTIKETLSAFGGVKHRLQFVDDIKGVKFYNDSKSTNILATQKALSGFDNSKVVLIAGGLDRGNEFDELVPDIPGLKKMVILGQSAERVKRAADKAGVAYVEATDIADATRKAYEIATQGDVVLLSPANASWDMYANFEVRGDLFIDTVAELKE

SEQ ID NO: 2859 - protein, 213 aa, Streptococcus pneumoniae
MIELKNISKKFGSRQLFSDTNLHFEGGKIYALIGTSGCGKTTFLNMIGRLEPYDKGQIIYDGTSLKDIKPSVFFRDYLGYLFQDFGLIENQTVKENLNLGLVGKKLKEKEKISLMKQALNRVNLSYLDLKQPIFELSGGEAQRVALAKIILKDPPLILADEPTASLDPKNSEELLSILESLKNPNRTIIIATHNPLIWEQVDQVIRVTDLSHR

SEQ ID NO: 2860 - protein, 673 aa, Streptococcus pneumoniae
MKKLFILLSTFFLSFFLAWIIVLRAPQYLYASYDSVSLLRVKKDTQEPTREVFEQELENFANSEQSLIARRIVEPSKDGTTHFTYATYGQGTLPKEFQEASQESRERSDPLNSYLLLSGSLTKEKLADKLGDLGYKASADRKIPPYFLAFRILLNPLILISLAIFGLSFFALVIITRIKEMRAAGIKLFSGQTLLSIMGHSLSTDIKWLLLSALLSFLGGGVVLFSQGLFYPILLATYGFGISFYLLFLLAISILLMLLYLMSLSYKALVPVIKGRLPLKRLMILTLLCQLVAVFTVGYAVKTGLMSYQRLKELEISKQAWQDRADYYQISFGLGDRGKDTENQSKWYAFAKEAIEEEQALYVKDNLLHFANPQGKNEQGETLDTYSPDANTLYVSPSYLDKEKVVVDAETKQKLAHLQKGEFILLLPEHLRSREAELKKVFEERLSYYGKSGEEASAPLDYEMKAHVSYLSMGEKRFVYNNGENPVSTQYLTDPILVVFTPTSTGDSFISLSSWSINAGKQLFIKGYESGLELLKKAGIYEQVSYLKEGRSVYLTRYNEVQTETATLILGAIVGIASSLLLFYSVNLLYFEQFRRDILIKRISGLRFFETHAQYMVSQFASFVFGASLFILSSRDLVIGLLTLLVFLASAVLTLYRQAQKESRVSMTIMKGK

SEQ ID NO: 2861 - protein, 134 aa, Streptococcus pneumoniae
MLFLSHKKAVSIKERGGLILLHCCSRCDFFERKNKMKTKKHRLLALALISSFTLLGAASAAVQYPDGGVWTYGEGSGGGWAFSNYYHGKKYHYSSLVSRWNSHSDKGEAPAGKTSYAWIWTKWGEQVAFYCDYD

SEQ ID NO: 2862 - protein, 72 aa, Streptococcus pneumoniae
MQPVLTKYKIDAINEFYSSFSHSYYPSKRDDVIVQNNSNYCKIPSKKESQNSLFYLLLLFLTGMSVMSLTLK

SEQ ID NO: 2863 - protein, 84 aa, Streptococcus pneumoniae
MVYLVLGILLLLLYVFATPESIKGTVNIVAMVCILVALLILLVLSFLKIFQLPTEIFLAIAMLILAYFSVRDITLMPVKKSKRR

SEQ ID NO: 2864 - protein, 620 aa, Streptococcus pneumoniae
LNIIEEIMTKLREDIRNIAIIAHVDHGKTTLVDELLKQSETLDARTELAERAMDSNDIEKERGITILAKNTAVAYNGTRINIMDTPGHADFGGEVERIMKMVDGVVLVVDAYEGTMPQTRFVLKKALEQDLVPIVVVNKIDKPSARPAEVVDEVLELFIELGADDDQLDFPVVYASAINGTSSLSDDPADQEATMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDAVEALPILHIDEPTLQMTFLVNNSPFAGKEGKWVTSRKVEERLQAELQTDVSLRVDPTDSPDKWTVSGRGELHLSILIETMRREGYELQVSRPEVIVKEIDGVKCEPFERVQIDTPEEYQGSVIQSLSERKGEMLDMISTGNGQTRLVFLVPARGLIGYSTEFLSMTRGYGIMNHTFDQYLPLIPGEIGGRHRGALVSIDAGKATTYSIMSIEERGTIFVNPGTEVYEGMIIGENSRENDLTVNITKAKQMTNVRSATKDQTAVIKTPRILTLEESLEFLNDDEYMEVTPESIRLRKQILNKAEREKANKKKKSAE

SEQ ID NO: 2865 - protein, 241 aa, Streptococcus pneumoniae
MRLDNLLAQEKISRKAMKQALLRGEILVDGCPARSLAQNIDTGLQELLFQDRIIQGYEHTYLMLHKPAGVVTANKDKELPTVMDLLPSDIQSDKLYAVGRLDRDTTGLLLLTDNGPLGFQLLHPQYHVDKTYQVQVNGLLTPDHIQTFQKGIVFLDGTICKPARLEILSASPSFSQASITISEGKFHQIKKMFLSVGVKVTSLKRIQFGDFTLNPDLAESNYRPLNQKELQIIKNYLEMSR

SEQ ID NO: 2866 - protein, 65 aa, Streptococcus pneumoniae
VGILSIILGLLFPIVGLILGIIGLVLAISYQKESQLDYKIEKILNILGIVISVVNWIVAIALIFR

SEQ ID NO: 2867 - protein, 126 aa, Streptococcus pneumoniae
MVTWILWALILAMLAWMGFNYLRIRRAAKIVDNEEFEALIRTGQLIDLRDPAEFHRKHILGARNIPSSQLKTSLAALRKDKPVLLYENQRAQRVTNAALYLKKQGFSEIYILSYGLDSWKGKVKTS

SEQ ID NO: 2868 - protein, 73 aa, Streptococcus pneumoniae
MKTFYDVQQFLKRFGIIVYMGKRLYDIELMKLELSRIYDAGLMDKLDYLEAEAVLRREHKVELDYIEKNGEKN

SEQ ID NO: 2869 - protein, 302 aa, Streptococcus pneumoniae
MRIQQLHYIIKIVETGSMNEAAKQLFITQPSLSNAVRDLENEMGIEIFIRNPKGITLTRDGMEFLSYARQVVEQTQLLEERYKNPVAHRELFSVSSQHYAFVVNAFVSLLKKSDMEKYELFLRETRTWEIIDDVKNFRSEVGVLFLNSYNRDVLTKMLDDNHLLAHHLFTAQPHIFVSKTNPLAKKDKVKLSDLENFPYLSYDQGTHNSFYFSEEILSQEHHKKSIVVSDRATLFNLLIGLDGYTIATGILNSNLNGDNIVSIPLDIDDPIELVYIQHEKTSLSKMGERFIDYLLEEVQFDS

SEQ ID NO: 2870 - protein, 251 aa, Streptococcus pneumoniae
MPTILITGASGGLAQEMVKLLPNDQLILLGRNKEKLAQLYGNYSHAELIEIDITDDSALEALVTDLYLRYGKIDVLINNAGYGIFEGFDQIADKDIHQMFEVNTFALMNLSRHLAARMKESSKGHIINIVSMAGLIATGKSSLYSATKFAAIGFSNALRLELMPYGVYVTTVNPGPIRTGFFDQADPDGTYLKSVDRFLLEADAVAKKIVKIIGKNKRELNLPILLNLAHKFYTLFPKLADKLAGETFNYK

SEQ ID NO: 2871 - protein, 309 aa, Streptococcus pneumoniae
MDIQFLGTGAGQPSKARNVSSLALKLLDEINEVWLFDCGEGTQNRILETTIRPRKVSKIFITHLHGDHIFGLPGFLSSRAFQANEEQTDLEIYGPQGIKSFVLTSLRVSGSRLPYRIHFHEFDQDSLGKILEIDKFTVYAEELDHTIFCVGYRVMQKDLEGTLDAEKLKAAGVPFGPLFGKIKNGQDLVLEDGTEIKAADYISAPRPGKIITILGDTRKTDASVRLAVNADVLVHESTYGKGDEKIARNHGHSTNMQAAQVAVEAGAKRLLLNHISARFLSKDISKLKKDAATIFENVHVVKDLEEVEI

SEQ ID NO: 2872 - protein, 207 aa, Streptococcus pneumoniae
MTDIKTLALKYGGYTSLDKVYLDQLLAGKTDQEQLTLITPPPSVVNAYFAELYQKKSPQAATDYFAELSQELNLYNTEPSFTLENKPFIRLNLSGKSFGFCYESDGLGRIFFENEEKISDDLLFEIAQIFPHQLVFEESGKIYMKPVEDEEVISLESLTALTDLERLADGRKRLKGYSQEDLLQEAAAFSGKRYFRSENRTAMLYID

SEQ ID NO: 2873 - protein, 412 aa, Streptococcus pneumoniae
MIETENKEERVLLIGVELQGMDSFDLSMEELASLAKTAGAVVVDSYRQKREKYDSKTFVGSGKLEEIALMVDAEEITTVIVNNRLTPRQNVNLEEVLGVKVIDRMQLILDIFAMRARSHEGKLQVHLAQFKYLLPRLVGQGIMLSRQAGGIGSRGPGESQLELNRRSVRNQITDIERQLKVVEKNRATVREKRLESSTFKIGLIGYTNAGKSTIMNILTSKTQYEADELFATLDATTKSIHLGGNLQVTLTDTVGFIQDLPTELVSSFKSTLEESKHVDLLVHVIDASNPYHEEHEKTVLSIMKDLDMEDIPHLTLYNKADLVEDFTPTQTPYTLISAKSEDSRENLQALLLDKIKEIFEAFTLRVPFSKSYKIHDLESVAILEERDYQEDGEVITGYISEKNKWRLEEFYD

SEQ ID NO: 2874 - protein, 311 aa, Streptococcus pneumoniae
LCYNNSNEKMGIFQGKKMKTKIIVIVGPTAVGKTALAIEVAKRFNGEVVSGDSQQVYRGLDIGTAKASPEEQAAVPHHLIDVREITESYSAFDFVSEAKMTIEGIHNRGKLAIIAGGTGLYIQSLLEGYHLGGETPHEEILAYRASLEPYSDEELAHLVEQAGLEIPQFNRRRAMRALEIAHFGQDLENQEILYEPLIICLDDERSQLYERINHRVDLMFEAGLLDEAKWLFDHSPNVQAAKGIGYKELFPYFRGEQTFEEARESLNQATRRFAKRQLTWFRNRMLVTFYHIGESGVQDRILSQIEESLDD

SEQ ID NO: 2875 - protein, 62 aa, Streptococcus pneumoniae
MKAAFCSSGSITFFLNAYSAHATAATVHATPVTRPLANPLAMSLPPLYSQSASLLKRSHFSD

SEQ ID NO: 2876 - protein, 65 aa, Streptococcus pneumoniae
PILNRFGKLVGWETFKIPTQVWFLNVPEGTIFLNIKAEDLRLVDYDPVKPQLKFALAFKRIEKRS

SEQ ID NO: 2877 - protein, 220 aa, Streptococcus pneumoniae
LENKIAPQLLWSRRLADGRHMCAQEWLTGKILTPYDMNRKQIVNILTRLHRSRRLMTQLSRLGYAMETPVDLLQSWQETAPDALRKNHFISEVMADLRQTIPGFREDHATIVHGDVRHSNWIETDSGLIYLVDWDSVRLTDRMFDVAHMLCHYISEHQWKEWLTYYGYKYNQTVLSKLYWYGQLSYLSQISKYYMNQDLENVNREIHGLRHFRDKYGKRR

SEQ ID NO: 2878 - protein, 211 aa, Streptococcus pneumoniae
MRVRNRKGATELLEANPQYVVLNPLEAKAKWRDLFGNDNPIHVEVGSGKGAFVSGMAKQNPDINYIGIDIQKSVLSYALDKVLEVGVPNIKLLWVDGSDLTDYFEDGEIDRLYLNFSDPWPKKRHEKRRLTYKTFLDTFKRILPENGEIHFKTDNRGLFEYSLVSFSQYGMKLNGVWLDLHASDFEGNVMTEYEQKFSNKGQVIYRVEAEF

SEQ ID NO: 2879 - protein, 88 aa, Streptococcus pneumoniae
VDIEYGKIGSDMILSIFVDKPEGITLNDTADLTEIISPCPRHHQARSLPRTIFPRNYQSRLGTSFENQGCRRWSGWKIHPCRTLPSHR

SEQ ID NO: 2880 - protein, 102 aa, Streptococcus pneumoniae
QKLSVPVLDTIKPDPFPEQYFLEITSPGLERPLKTKDAVAGAVGKYIHVGLYQAIDKQKVFEGTLLAFEEDELTMEYMDKTRKKTVRIPYSLVSKARLAVKL

SEQ ID NO: 2881 - protein, 378 aa, Streptococcus pneumoniae
MSKEMLEAFRILEEDKGIKKEDIIDAVVESLRSAYRRRYGQSDSVAIDFNEKTGDFTVYTVREVVDEVFDSRLEISLKDALAINSAYELGDKIKFEEAPAEFGRVAAQSAKQTIMEKMRKQTRAITYNTYKEHEQEIMSGTVERFDNRFIYVNLGSIEAQLSKQDQIPGEVFASHDRIEVYVYKVEDNPRGVNVFVSRSHPEMIKRLMEQEIPEVYDGTVEIMSVAREAGDRTKVAVRSHNPNVDAIGTIVGRGGANIKKITSKFHPARYDAKNDRMVPIEENIDVIEWVADPAEFIYNAIAPAEVDQVIFDENDSKRALVVVPDNKLSLAIGRRGQNVRLAAHLTGYRIDIKSASEFEAMEDAASVELEVENDTVEE

SEQ ID NO: 2882 - protein, 97 aa, Streptococcus pneumoniae
MKTRKIPLRKSVVSNEVIDKRDLLRIVKNKEGQVFIDPTGKANGRGAYIKLDNAEALEAKKKKVFNRSFSMEVEESFYDELIAYVDHKVKRRELGLE

SEQ ID NO: 2883 - protein, 99 aa, Streptococcus pneumoniae
LNKQKISNLLGLAQRAGRIISGEELVVKAIQDGKAKLVFLAHDAGPNLAKKIQDKSHYYQVEIVTVFSTLELSIAVGKSRKVLAVTDAGFTKKMRSLME

SEQ ID NO: 2884 - protein, 164 aa, Streptococcus pneumoniae
LPLFCLRRSACSLARASRSALKLRLCGFAATFSVFGATGSAGFASSLATAGLAGSDFSAFFSALTFGAAGFASTFGAAAGLKLAAIFAATASSTLDEWLFTSKPNSFARATTSLLSFPSSFAISYNLFLDKSCPPLLFHKRPHFLCKSSICYSQNLSRFPDCYA

SEQ ID NO: 2885 - protein, 930 aa, Streptococcus pneumoniae
LSKKRLYEIAKELGKESKEVVARAKELGLDVKSHSSSVEEAVAAKIAASFKPAAAPKVEAKPAAPKVSAEKKAEKSEPAKPAVAKEEAKPAEPVAPKTEKVAAKPQSRNFKAEREARAKEQAERRKQNKGNNRDQQQNGNRQKNDGRNGGKQGQSNRDNRRFNDQAKKQQGQQKRRNERRQQEDKRSNQVAPRIDFKARAAALKAEQNAEYARSSEERFKQYQAAKEALAQANKRKEPEEIFEEAAKLAEQAQQVQAVVEVVPEKKEPAVDTRRKKQARPDKNRDDYDHEEDGPRKQQKNRSSQNQVRNQKNSNWNNNKKNKKGNNKNNRNQTPKPVTERKFHELPTEFEYTDGMTVAEIAKRIKREPAEIVKKLFMMGVMATQNQSLDGETIELLMVDYGIEAKQKVEVDNADIERFFVEDGYLNEDELVERPPVVTIMGHVDHGKTTLLDTLRNSRVATGEAGGITQHIGAYQIVENGKKITFLDTPGHAAFTSMRARGASVTDITILVVAADDGVMPQTIEAINHSKAANVPIIVAINKIDKPGANPERVIGELAEHGVMSTAWGGDSEFVEISAKFNQNIEELLETVLLVAEIQELKADPTVRAIGTVIEARLDKGKGAVATLLVQQGTLNVQDPIVVGNTFGRVRAMTNDLGRRVKVAGPSTPVSITGLNEAPMAGDHFAVYEDEKSARAAGEERAKRALMKQRQATQRVSLENLFDTLKAGELKSVNVIIKADVQGSVEALSASLQKIDVEGVKVTIVHSAVGAINESDVTLAEASNAFIVGFNVRPTPQARQQAEADDVEIRLHSIIYKVIEEMEEAMKGMLDPEFEEKVIGEAVIRETFKVSKVGTIGGFMVINGKVARDSKVRVIRDGVVIYDGELASLKHYKDDVKEVTNGREGGLMIDGYNDIKMDDVIEAYVMEEIKR

SEQ ID NO: 2886 - protein, 81 aa, Streptococcus pneumoniae
LGFLVIRSKVTQNGVINLGNRQVTQHLNICDGHTLDTWITDFLLQNLIDFTLDFHAHTIRTEMICHDIPFSTLNQKLGQQT

SEQ ID NO: 2887 - protein, 116 aa, Streptococcus pneumoniae
MANHFRTDRVGMEIKREVNEILQKKVRDPRVQGVTITDVQMLGDLSVAKVYYTILSNLASDNQKAQIGLEKATGTIKRELGRNLKLYKIPDLTFVKDESIEYGNKIDEMLRNLDKN

SEQ ID NO: 2888 - protein, 259 aa, Streptococcus pneumoniae
MAEQDLAMQVLQQVVKLPVVKVDSSKFLVDKFSKELGPQDIPTLLEQGPTSLLSQEILDRVANACIRDNVLLASGTSVLAGLPGGLAMAITIPADVAQFYAFSLKLAQELGYIYGYEDLWVSREELSEDAQNTLLLYLGVMLGVNGTAALLRAGGITIAKQVMKTVPNKALTKTLWYPILKKVLKIFGVNLTKGGLAKGMGKFIPILGGIISGGLTFATMKPMGESLQKELSKLVNYSEVQYQEDVETIRKEAEIIEGE

SEQ ID NO: 2889 - protein, 83 aa, Streptococcus pneumoniae
VKFNIKKMLKQSEKRLKSSKESNMGLIKTLAKIYGNYFLTVQGVKVMKTIKKADHVVVGLGKLFIADKLMDTARWLIKPEERE

SEQ ID NO: 2890 - protein, 73 aa, Streptococcus pneumoniae
VGFLLVFCDLDYHLDKFKEPIQYLVKQQLNCKRNDHPKEFHNPNNRFDKKNSKKTKKISFSLLWLNEPPSRIH

SEQ ID NO: 2891 - protein, 64 aa, Streptococcus pneumoniae
LFENLFKPRQLHLAVYMLLTSSVLSTTSKRCFELTSSVLSTTSKHCFKQPAASFLVCSLIFIEY

SEQ ID NO: 2892 - protein, 77 aa, Streptococcus pneumoniae
MDNIIDVSIPVAEVVDKHPEVLEILVELGFKPLANPLMRNTVGRKVSLKQGSKLAGTPMDKIVRTLEANGYEVIGLD

SEQ ID NO: 2893 - protein, 444 aa, Streptococcus pneumoniae
MTDERIHVLRDILLELHNGASPESVQDRFDATFTGVSAIEISLMEHELMNSDSGVTFEDVMELCDVHANLFKNAIKGVEVSDTEHPGHPVRVFKEENLALRAALIRIRRLLDTYESMEDEEMLAEMRKGLVRQMGLVGQFDIHYQRKEELFFPIMERYGHDSPPKVMWGVDDQIRELFQTALTTAKSLPEVSISSVKEAFEAFATEFESMIFKEESILLMILLESFTQDDWLQIAEESDAYGYAIIRPSEKWVPERQIFIEEKIAEEPVQLDTAEGQVQQVIDTPEGHFTITFTPKEKEAVLDRHSQQAFGNGYLSVEQANLILNHLPMEITFVNKEDIFQYYNDNTPADEMIFKRTPSQVGRNVELCHPPKYLDKVKAIMKGLREGTKDKYEMWFKSESRGKFVHITYAAVHDENGEFQGVLEYVQDIQPYREIDTDYFRGLE

SEQ ID NO: 2894 - protein, 84 aa, Streptococcus pneumoniae
MSYEQEFMKEFEAWVNTQIMINDMAHKESQKVYEEDQDERAKDAMIRYESRLDAYQFLLGKFENFKVGKGFHDLPEGLFGERNY

SEQ ID NO: 2895 - protein, 131 aa, Streptococcus pneumoniae
MSKKLNRKKQLRNGLRRAGAFSSTVTKVVDETKKVVKRAEQSASAAGKAVSKKVEQAVEAPKEQAQKVANSVEDFAANLGGLPLDRAKTFYDEGIKSASDFKNWTEKELLALKGIGPATIKKLKENGIKFK

SEQ ID NO: 2896 - protein, 68 aa, Streptococcus pneumoniae
VDFSAPPLSVKCGIQNTSNGSIVARFFRKCKAQEKLLELDAIFFQFLDGSWADSFQGKEFFFSPVFEI

SEQ ID NO: 2897 - protein, 149 aa, Streptococcus pneumoniae
VIGVVARENAAEQIKQYQKFTVNISDETSMLAMEQAGFISHQEKLERLGVHYEISERTQISILDACPLVLDCRVDRIVEEDGICHIFAKILERLVAPEFLDEKGHFKNQLFAPTYFMGDGYQRVYRYLDKRVDMKGSFIKKARKKDGKN

SEQ ID NO: 2898 - protein, 185 aa, Streptococcus pneumoniae
MARTELSDKIETERLVLRVRTVADAEDIHAYASLPEVAYPAGFPPVKTLEDEIYYLEHILPERNQKENLPAGYGIVIKGTDKIAGSVDFNHRYGDDVLELGYTLHSDYWGRGYVPEAARALIDLAFKDLGLHKIELTCFGYNLQSKRVAEKLGFTLEARIRDRKDAQGNCCDDLRYALLKSEWEE

SEQ ID NO: 2899 - protein, 320 aa, Streptococcus pneumoniae
MSDVKEEVSSLSEKQLRQIDVEYAELNDSDIIERLAYLEINNNEKRIVISDIEPTKEIMSVSDQIFEIQKNFQKIKNMFELFISDVSDFLSIKNKLESKELEIEEADVNRFMIHLLSSGKLFVDFNENQIKQKYSKDSEEFDCIHGFASYQYDINFTYRFCHSLRNYSQHTDLPINEVKAVSPDDETVIIDFYIDLDYLLNSNFKWKKLKGELIKLNQETSKIDAIALVKEYFNALTELYGNYNKLFLKLNHNTLVDIKSKLESLKLKHSRYYISKISKYDLKYNPGNYTMSPLAAFAEIEEIYIELSKIGLVKIVNKSN

SEQ ID NO: 2900 - protein, 883 aa, Streptococcus pneumoniae
MSKELSSKYNPAEVEAGRYQKWLDADVFKPSGDQKAKPYSIVIPPPNVTGKLHLGHAWDTTLQDIIIRQKRMQGFDTLWLPGMDHAGIATQAKVEERLRGEGISRYDLGRESFLTKVWEWKDEYATTIKEQWGKMGLSVDYSRERFTLDEGLSKAVRKVFVDLYKKGWIYRGEFIINWDPAARTALSDIEVIHKDVEGAFYHMNYMLEDGSRALEVATTRPETMFGDVAVAVNPEDPRYKDLIGKNVILPIANKLIPIVGDEHADPEFGTGVVKITPAHDPNDFLVGQRHNLPQVNVMNDDGTMNELAFEFSGMDRFEARKAVVAKLEEIGALVKIEKRVHSVGHSERTGVVVEPRLSTQWFVKMDQLAKNAIANQDTEDKVEFYPPRFNDTFLQWMENVHDWVISRQLWWGHQIPAWYNADGEMYVGEEAPEGDGWTQDEDVLDTWFSSALWPFSTMGWPEVDSEDFKRYFPTSTLVTGYDIIFFWVSRMIFQSLEFTGRQPFQNVLIHGLIRDEEGRKMSKSLGNGIDPMDVIDKYGTDSLRWFLSNGSAPGQDVRFSYEKMDASWNFINKIWNISRYILMNNGGLTLDVAHDNVTKVATGEAGNVTDRWILHNLNETIAKVTENFDKFEFGVAGHILYNFIWEEFANWYVELTKEVLYSDNEDDKVITRSVLLYTLDKILRLLHPIMPFVTEEIFGQYAEGSIVTAAYPTVNPAFEDLAAHTGVESLKNLIRAVRNARAEVNVAPSKPITILVKTSDSDLEAFFNSNVNYIKRFTNPEHLEIASTIPAPELAMSSVITGAEIYLPLADLLNVEEELARLDKELAKWQKELDMVGKKLSNERFVANAKPEVVQKERDKQADYQAKYDATVARIDEMKKLVK

SEQ ID NO: 2901 - protein, 251 aa, Streptococcus pneumoniae
MSKHPHYELLNLIGYGLAKFDKLFIKEFQCSSKSEFYRYVVSLGIAETTGVVKNRMDLFDPYFDNNRKGWWQKAEVYRFRKDLIDMMFGNEDVHSYAEIVKMLLASEGKKTGITIVEKPIVRTKFKRLQETGMEAENYFILHFDKEEKFQGGQLTDARLYGDGYDFQVDVQEYSYLAEVKGIRKSKGRVRLTAKEFEKVKEFQSDFILSLVTNLDDIPKLVLIDNPLKHFEFKKNIIKNEIIEYRSVEDLY

SEQ ID NO: 2902 - protein, 267 aa, Streptococcus pneumoniae
MQPTYNIDNPNLSYEAKRDLWRIGFGLQKVDNLVPSAYMESLAEKQSRGELTYEQVYEDATAYHHTIDASTEEADLVSLRIVELLSRRGFSFSPATLLAIHKELFQDIFEPSIPVGQFRQTNITKNEPVLNGESVVYSDYSMIQMTLDYDFNQEKQVAYATLTQADVVKQIQHFISGIWQIHPFREGNTRTVTVFLIQYLREFGFDIDNTPFQQHSKYFRDALVLDNAKILQRRSEFLTAFFENLLLGGQNDLSSEKMYLDLDLDFS

SEQ ID NO: 2903 - protein, 94 aa, Streptococcus pneumoniae
PRLAIPTRFLSSVPKSKGIQASMSRKGNSQDNGMMESFFGILKSEMFYGYEKTFKSLNQLEQAIVDYIDYYNNKRIKVKLKGLSLVQYRTKSFG

SEQ ID NO: 2904 - protein, 101 aa, Streptococcus pneumoniae
MEKCYTDVTEFAIPASTQKLYLSPVLDGFNSEIIAYNLSTSPNLEQVQTMLEQAFTEKYYENTILHSDQGWQYRHDSYHRFLRVREFKHLCHARETAKTTV

SEQ ID NO: 2905 - protein, 90 aa, Streptococcus pneumoniae
MTEFSLDLLLKAIKLARSTYYYHLKQLDKPDKDQELKAEIQSIFIEHKGNYAYRCIHLELRNRGYLVNHKRVQGLMKVLNLQAKMRQKRK

SEQ ID NO: 2906 - protein, 91 aa, Streptococcus pneumoniae
VYMNYTPKVRQKKSNFWGVFIMKLTYDDKVQIYELRKQGYSLEKLSNKFGINNSNIRYMIKLIDRYGIEFVKKGKNRYYSPDLKQEMINKV

SEQ ID NO: 2907 - protein, 421 aa, Streptococcus pneumoniae
MAVFVSLDGIVVEVLDVFSSFNGDSEFFLCKRLKDKSQFVMERSQFEEMFQLQSSRLTTQEKLQLFTSVFAGRYDVYAKSFINDQGKIQYFPSYDCGWKQLLPEKRSFQTLTDSVLKSHFRGETAIGIFPMHLDDSCHFLVLDFDEGDWKEAGLTIRRIARERQMEAHLEISRSGHGLHIWFFFEEAIPSREARLFGKKLIELAMQESMQLSFDSFDRMFPNQDVLPKGGFGNLIALPFQGEAYHQVRTVFVDEHFQPYGDQWRYLQGIQKISTAKVALLIQEELGKQELDKELKVVLSNMIQLKKSSVTPKTLFFLKNMASFSNPEFYLKQAMRQPTYQIPERMYLFGESDYYLWLPRGLLYPLQDKFKQVVVEDRRKVQRSIRVAFKGELTLEQELALSDMNSKENGLLHAGQVLERAF

SEQ ID NO: 2908 - protein, 398 aa, Streptococcus pneumoniae
MIQSLFKLENSQSLLDEYEMMIVDECHHISALMFEKVVAQLRGKYLYGLTATPERKNGHEPIVFQRIGEILHTADKRETDFKRQLQLRFTSFGHLEIEKTKASNFIQLSDWIATDSARNQLILKDILAQVAEGRNILGLVNRIQQIDVFEKLLKEKEVDDCYIISGKTKVRERTSLLETLEQLDKGFVLLSTGKYIGEDFDLPQLDTLILAAPFSWKNNLIQYAGRIHRNYKDKSLVRIFDYVDIHVPYLEKMFQKRQVAYRKMDYRVIEGEEKQFVYVDSRYEKVLREDLAGERQECLLILPYVHQTKLMNFLKEFRISQIEICIPETVANKAWLDQLKSQKIKVSFTQSKIVTPILLVNKTIVWYGAMPLLGKVDEMTILRLESASIVSELVAGLR

SEQ ID NO: 2909 - protein, 97 aa, Streptococcus pneumoniae
IISSKLLPNVILPRLIIFSVMYTNSKGTLINISVKRVILSLFLRKKLFSISIGFTLSPVFLPKAIPLPKRRISISFLLCAITALWFSIRFMIIKFPF

SEQ ID NO: 2910 - protein, 279 aa, Streptococcus pneumoniae
MIIKRILNHNAVIAQSKKDIDILLFGRGIAFGRKTGDKVNPIDIEKSFFLKNRDNMTRFTEMFINVPLELVYITEKIINLGKITLGNNFDEIIYINLTDHISSSIERYKEGIIISNPLRWEISKYYKEEFELGKRALQIIKKELGIELPIDEAAFIALHFVNANLENNFQESYKITEIIMGIEKIIQDFYCTEFNQDSIDYYRFITHIKLFAHRLVENTTYCDDDDEDLLALMKNKYPREYECGEQVAMFIQTEYNYLLTSSELVYLMAHIRRLTKNLD

SEQ ID NO: 2911 - protein, 612 aa, Streptococcus pneumoniae
MSYKDTVQKILDVIGGEKNVNRVTHCVTRLRLELKDENLVNDDDVKKIPGVIGIMKKNGQYQIILGNDVANYYKEFVKLGNFESDSVVQGHKGNILERIIEYIAGSMTPIIPAMLGGGMLKVLVIILPMLGILQSDSQTIAFLTFFGDAPYYFLPLLLAYSASQKLKVTSTLAMSVAGVLLHPNFVQMVQSGNPLSLFGAPVTPASYGSSVVPILIMVWLMKYIEKMIAKLTPAVTKSFLQPTLVLLVSSCIALVVVGPIGVIVGEGLSNLVGQMYGVAGWLTLAILGAIMPFIVMTGMHWAFAPIFLAASIATPDVLILPAMLGSNLAQGAASMAVALKSKNNNTKQIAFAAGFSALLAGITEPALYGVTLKYKKPLYAAMIGGGLAGLFAGLTSVKAYLFAVPSLIALPQFIYSDVPSNIVNALIVAVISVVITFVLAYIFGIDEEESSSNLEVKAGVSNKKMIFSPISGEIIPLSDVQDKTFSDKLIGDGVAIIPSEGKVYAPFDGKITNIFPTKHAIGLKSDEGVELLIHIGLDTVELKGQGFISHVEEGDRVFKNQLIFEMDLNLIKTKGYETVTPVIVTNTNDFLDVLVLPNNQTIEHSKELLVIL

SEQ ID NO: 2912 - protein, 471 aa, Streptococcus pneumoniae
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWVDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKENDINIEFAAEDAELLKNYTVDFLSFSYYMSVTQSAIPTQYNSGEGNIIGGLVNPYLESSEWGWQIDPIGLRIILNRYYDRYQIPLFIVENGLGAKDQLIKDELNNLTVQDDYRIQYMKEHLLQVAEALQDGVEIMGYTSWGCIDCVSMSTAQLSKRYGLIYVDRNDDGNGTFNRYKKMSFTWYKGVIESNGESLFK

SEQ ID NO: 2913 - protein, 348 aa, Streptococcus pneumoniae
MSTIEEQLKALREETLASLKQITAGNEKEMQDLRVSVLGKKGSLTEILKGMKDVSAEMRPIIGKHVNEARDVLTAAFEETAKLLEEKKVAAQLASESIDVTLPGRPVATGHRHVLTQTSEEIEDIFIGMGYQVVDGFEVEQDYYNFERMNLPKDHPARDMQDTFYITEEILLRTHTSPVQARAMDAHDFSKGPLKMISPGRVFRRDTDDATHSHQFHQIEGLVVGKNISMADLQGTLQLIVQKMFGEERQIRLRPSYFPFTEPSVEVDVSCFKCGGEGCNICKKTGWIEIMGAGMVHPRVLEMSGIDATVYSGFAFGLGQERVAMLRYGINDIRGFYQGDVRFSEQFK

SEQ ID NO: 2914 - protein, 330 aa, Streptococcus pneumoniae
LVESTDIVDSITEHSYTLLSKTKGKARVYSRIDTTHFKDTWVNHTGPHNFDPTCFLTYITAFSTTLEARNIHLNRWLCEWEVRWTQTNLTLFTKHFLDNQLKRSLKISHRDIFPNYQAFDLVELVTVGRIVRIATEDTPWRDHLQRTFRKIMGIHSTRLNWRRVGTEQDFFSDIESILHITSWVVFWKVHTFKVIVVLLHFKTIHDLITHTDEDIFDFFTGLCQNVTVTSRNWTTWKRHIDTLASQLSRDFLFFQELSCFFKSSSQDITSFIDVFPDDWTHLSRNIFHPFEDFSERTLFTKDRDTQILHLFFISSSNLLQASQRFFAKRF

SEQ ID NO: 2915 - protein, 169 aa, Streptococcus pneumoniae
MIIKVEMADVEVLAKIAKQTFRETFAYDNTEEQLQEYFEEAYSLKTLSTELGNPDSETYFIMHEEEIAGFLKVNWGSAQTERELEDAFEIQRLYVLQKFQGFGLGKQLFEFALELATKNSFSWAWLGVWEHNTKAQAFYNRYGFEKFSQHHFMVGQKVDTDWLLRKKLR

SEQ ID NO: 2916 - protein, 800 aa, Streptococcus pneumoniae
MLISYKWLKELVDIDVPSQELAEKMSTTGIEVEGVESPAAGLSKIVVGEVLSCEDVPETHLHVCQVNVGEEERQIVCGAPNVRAGIKVMVALPGARIADNYKIKKGKIRGLESLGMICSLGELGISDSVVPKEFADGIQILPEDAVPGEEVFSYLDLDDEIIELSITPNRADALSMCGVAHEVAAIYDKAVNFKEFTLTETNEAAADALSVSIETDKAPYYAARILDNVTIAPSPQWLQNLLMNEGIRPINNVVDVTNYILLYFGQPMHAFDLDNFEGTDIRVREARAGEKLVTLDGEERDLDVNDLVITVADKPVALAGVMGGQATEISEKSSRVVLEAAVFNGKSIRKTSGRLNLRSESSSRFEKGINVATVNEALDAAASLIAELAGATVRKGIVSAGELDTSDVEVSSTLADVNRVLGTELSYADVEDVFRRLGFGLSGNADSFTVRVPRRRWDITIEADLFEEIARIYGYDRLPTSLPKDDGTAGELTATQKLRRQVRTIAEGAGLTEIITYTLTTPEKAVEFTAQPSNLTELMWPMTVDRSVLRQNMISGILDTVAYNVARKNKNLALYEIGKVFEQTGNPKEELPNEINSFAFALTGLVAEKDFQTAAVPVDFFYAKGILEALFTRLGLQVTYTATSEIASLHPGRTAVISLGDQVLGFLGQVHPVTAKAYDIPETYVAELNLSAIEAALQPATPFVEITKFPAVSRDVALLLKAEVTHQEVVDAIQAAGVKRLTDIKLFDVFSGEKLGLGMKSMAYSLTFQNPEDSLTDEEVARYMEKIQASLEEKVNAEVR

SEQ ID NO: 2917 - protein, 295 aa, Streptococcus pneumoniae
LAQIYAFPLATATMAAILSFLFFFLSFYKKNKQIRFYSGILLLLSLILLLFGTDKTLSSASNKTKTLKLVTWNVANQIEAQHIERIFSHFDADMAIFPELATNIRGEQENQRIKLLFHQVGLSMANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNALPPFERGTWNSQSPKLFNATIDHILLPKNHYYVKDLDIVSFQNSDHRCIFTEITF

SEQ ID NO: 2918 - protein, 148 aa, Streptococcus pneumoniae
MLRLEDGKKEGKSNREIASLLGKAPQTIHTEIKYGTVRKCLGKGRFKEVYSADYAQQSYENNRKHSVKRSSLTKELKEKILHYHNQKFLPEMMVMAKGVNVGISTIYYWIHHGKLGLSKQDLLYPRKGKSVKKQVSPNFKPADQSIES

SEQ ID NO: 2919 - protein, 88 aa, Streptococcus pneumoniae
LEGCLSELFSKEEILESDMRVAIMSELIEARNKQGISQKKLEEVSGVSQPVIARMETGKTSPQLDTVLKVLASLGKTLAVVPLEQGKS

SEQ ID NO: 2920 - protein, 98 aa, Streptococcus pneumoniae
FETIYLFRTKEKDLKQTSQILCIACFIALFQLDGSNALLVILISDYGLLLEKTITDSSQLFPCSSGTTASVFPRLARTFKTVSNCGLVLPVSILAITG

SEQ ID NO: 2921 - protein, 749 aa, Streptococcus pneumoniae
MSTTIVGFPRLGEFRELKFTTEKYFRKEISEEELLAAAKDLRAKHWNIVKEKGITEIPSNDFSHYDNFLDAAFLFNVVPASVQNLDLSDLERYFALGRGYQGEKGDVRALPMKKWFNTNYHYIVPKFEKDTQVKLAGHKIFDEFQEAKEIGLNTRPVLVGPFTFLQLSDFEEGVKADDFVDSLVAAYQEVFAKLAELGATCIQLDEAALVKDLTAEEKALFLNLYNKLLADKKGLEVLLQTYFGDVRDVYADLVNLPVDAIGFDFVEGKKTLELVKGGFPADKTLYAGIVNGKNIWRNNYEKSLAVLEQIPAENIVLTSSCSLLHVPFTTANEEFEPALLNHFAFAVEKLDEIRDLDAIRNGQGSEALAANKELFATERVGENAELRARIAGLTDTDYTRLPAFAEREAIQEEAFKLPALPTTTIGSFPQTKEVRAKRLAYRKGELSQKEYDAFLAETIDEWIKWQEDIDFDVLVHGEFERNDMVEYFGQNLSGYLFSKNGWVQSYGMRGVKPPIIWGDVTRLNPITVKWSSYAQSRTNKPVKGMLTGPVTILNWSFPREDISIKDSTLQIALAIKDEVLDLEAAGVKIIQIDEAALREKLPLRRSDWYEDYLDWAIPAFRLVHSTVAPDTQIHTHMCYSEFTDIIPAIDNMDADVISFEASRSNLEILDELKAKNFQTEVGPGVYDIHSPRVPNEGEIDNTIEAILAKVPSKKVWINPDCGLKTRGIPETKESLIRLVEAAKAAREKL

SEQ ID NO: 2922 - protein, 288 aa, Streptococcus pneumoniae
MSRQTPSLSFEVFPPNPAVGNGNIISALQDMQELAPHFISVTASNNKFNIKETTVRLADFIQNDLAIPTIAHLPAIYLTKDKVAETIADLDKVGVQKILALRGDIIPDVEPQKDFRYATDLIEFIKEQTPHFDIIGACYPEGHPDSPNQISDIQNLKKKVDAGCSSLVTQLFFDNERFYDFQDKCILAGIDVPIHAGIMPILNRNQALRLLKTCENIHLPRKFKAILDKYEHDPESLRAAGLAYAVDQIVDLVTQDVAGVHLYTMNNADTAKYIHQATHALFNHQSLG

SEQ ID NO: 2923 - protein, 89 aa, Streptococcus pneumoniae
VLGSLSFFLRNETKIQLLKMLSRQATQRKIGNRTTERLLLGRFIFFHRVVGVFSFQDTSLERFNIKVSKPFTLIAIGRLAKCFTNSLVK

SEQ ID NO: 2924 - protein, 737 aa, Streptococcus pneumoniae
MAKQVFQTTFAGRELIVETGQVAKQANGSVVVRYGESTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFDGPIAGVQVGYVDGQIIINPSQEQAEQSLLELTVAGTKHAVNMVESGAKELSEEIMLEALLKGHEAVKELIAFQEEIVAAVGKEKAEVELLHVDAELQAEIIAAYNSDLQKAVQVEEKLAREAATQVVKDQVTAVYEEKYADHEEFDRIMRDVAEILEQMEHAEVRRLITEDKVRPDGRKVDEIRPLDAVVDFLPRVHGSGLFTRGQTQALSVLTLAPMGETQIIDGLDPEYKKRFMHHYNFPQYSVGETGRYGAPGRREIGHGALGERALAQVLPSLEEFPYAIRLVAEVLESNGSSSQASICAGTLALMAGGVPIKAPVAGIAMGLISDGNNYTVLTDIQGLEDHFGDMDFKVAGTRDGITALQMDIKIQGITAEILTEALAQAKKARFEILDVIEATIPEVRLELAPTAPKIDTIKIDVDKIKIVIGKGGETIDKIIAETGVKIDIDEEGNVSIYSSDQDAINRAKEIIAGLVREAKVDEVYRAKVVRIEKFGAFVNLFDKTDALVHISEMAWTRTNRVEDLVEIGDEVDVKVIKIDEKGRIDASMKALLPRPPKPEHDEKGEKSERPHRPRHHKDHKPKKEFTETPKDSE

SEQ ID NO: 2925 - protein, 205 aa, Streptococcus pneumoniae
MGWWRETIDIVKENDPAARTTLEVLLTYPGVKALAAHRLSHFLWKYDFKLLARMHSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 2926 - protein, 294 aa, Streptococcus pneumoniae
MIQARNKLSQEELSEAKKVINCCQNYDGTYRDPYLSNMLNFDPNMPAFFLYYEKGELVGLLTVYADDQDVEVTILVHPGHRRQGIARALFTSFERETASFPIRSVTFQTERIFLENHPDFASNWGLIEDEETETWLGKDRRPYQLAKLSNLEVLLADSSYQEQISQLKFQAFSGEHESREVVDRYVAEALKDPESRLYILLKDGQVIGTCTVDLSSDTNYFYGLAISEPERGKGYGSYLAKSLVNQLIEQNDKEFQIAVEDSNVGAKRLYEKIGFVKQTQVVYLNEKGARDSEV

SEQ ID NO: 2927 - protein, 151 aa, Streptococcus pneumoniae
VGFFYTEIDIPLTLIGKAFLDQVFHKTDDVCHKLHYTRMASRRFHAQCRHILTKGSDVLIRNLLRCDAFFPGTVDNLIIHICKIGNIGNLIPTVLKIATNRIKSYRRTGVSHVNIVVHGWPTNIHLDLAVLNRDKFSQITRHGVIDFNHKS

SEQ ID NO: 2928 - protein, 447 aa, Streptococcus pneumoniae
MIKIYDTMSRDLREFVPIEDGKIKMYVCGPTVYNYIHVGNARSTVAFDTIRRYFEYRGYKVAYISNFTDVDDKIINRAREEGITPQEVADKYIAAFREDVTALGVKPATRHPRVVEFMADIIRFVEDLIEKGFAYESQGDVYFRVEKSHNYAKLANKTLEDLELGASGRTDEETARKENPVDFALWKSSKPGEISWDSPWGPGRPGWHIECSVMSTEILGDTIDIHGGGADLEFPHHTNEIAQSEAKTGKAFANYWMHNGFVNIDNVKMSKSLGNFITVHDALKTLDGQVLRFFFATQHYRKPINFTEKAVRDAETNLKYLKNTYEQPFTGNVDAQELQNFKDKFVAAMDEDFNAANGITVVFEMAKWINSGNYDASVKQALADMLEIFGIVFVEEVLDAEIEDLIQKRQEARANRDFATADQIRDQLVTQGIKLLDTKDGVRWTRD

SEQ ID NO: 2929 - protein, 128 aa, Streptococcus pneumoniae
VIDVNLINGIALAFEGDAVYSMYIRRHLILKGMTKPNKLHQEATKYVSAKAQARLIALMLEEQVLTEKEEEIYKRGRNTNSHTKAKNADVVTYRMSTGFEAVMGYLHMTENLERLESLVSWCIQKVEG

SEQ ID NO: 2930 - protein, 294 aa, Streptococcus pneumoniae
MRAKELQDWFPEARISDQPVEKEGYLTLPLASQQWILLEEAGLSEREKQLVALLTQQEQARSLNPWYSYLVEGKGQAPQVFKKIQLVYCHLSYFQQENLASWLDMMRTLFPNCQTVLQVGAQDYVFVLQQDKYTSVRDILSDTIEAVEYDFGLRLSIMLGQVWSQTGHQALSDLIKAERDLFKTWWRQGHQGVHTFSQLYLWSMGERLVDLKPIKECLHQMILDQDQIQEIILSLWENSAVLTKTAQQLYLHRNSLQYKIDKWEELTGLQLKELTDLTLCYQLILGSLSTIVGL

SEQ ID NO: 2931 - protein, 87 aa, Streptococcus pneumoniae
MGRVDRASVERVDRPDLVLSIDFRFFVNYSWFVKKLIFGEEDCYLLHFYVQSYSGLMLGKYTVTAKTFLEVALIYLIYLCKFYVILL

SEQ ID NO: 2932 - protein, 199 aa, Streptococcus pneumoniae
MQILCYFTITVVANPNNSGEVHLDVSIEDNQGGSGYNFSSVSSSSQTAKYEGAGYNNNSSLYITIDKTSDATALLKLKLNNVNNQPATEVPSSGITVKLNAKDNAGNWTSASNKKEVTVKIVSAKPTYPDKILVKNPDNIKDTEKNAIIEKLKEANKNHPAGAPTFAKGEGEHANDIVATYSDGTTYYVPLNDVTKYAR

SEQ ID NO: 2933 - protein, 51 aa, Streptococcus pneumoniae
LTQFTPHCLDRLFQSSALVSLLRPSITTYSSTGISTCCPSDTPFGLSLGPD

SEQ ID NO: 2934 - protein, 81 aa, Streptococcus pneumoniae
MWYRHSISNCSKAPWGLSVLSRVTCIFTGTKISPSLSLRQCPNHYAFRAGRNLPDKEFRYLRTVIVTAAVYWGFNSYLRLR

SEQ ID NO: 2935 - protein, 77 aa, Streptococcus pneumoniae
VVPYGRAIAQRIKATLGITGLSPPRVHIDGEVWHLDVGSSHPGAVVGPKGWAVRPLKRHASWVQNVVRQFGPYPSRA

SEQ ID NO: 2936 - protein, 71 aa, Streptococcus pneumoniae
CSGYHVALSRRRSRVRFPSGPFKVTQVILDSLAQLVEQLTFNQWVTGSSPVRVIYAGLAELADAPDLGSGA

SEQ ID NO: 2937 - protein, 62 aa, Streptococcus pneumoniae
LVEYLVWDQGVAGSNPVFPIHGGVAQLARASGSYPGGRGFDPLRRYNDLVGPLAQLVRALGS

SEQ ID NO: 2938 - protein, 311 aa, Streptococcus pneumoniae
MKSYQAVYQILSKETDYISGEKIAEKLSLSRTAIWKAIKRLEQEGIEIDSIKNRGYKLMNGDLILPEILEENLPIKVSFKPETKSTQLDAKEAIDLGHEANTLYLASYQTAGRGRFQRSFYSPQGGIYMTLHLKPNLPYDRLPSYTLLVAGAVYKAIKNLTLIDVDIKWVNDIYLNNHKIGGILTEAMTSVETGLVTDIIIGVGINFTIKDFPQELKEKAASLFKATAPITRNELIIEIWRAFFETPAEELLYLYKKQSFILGKEVTFTLEQKDYKGLAKDISENGKLLVQCDNGKEIWLNSGEISLNSWK

SEQ ID NO: 2939 - protein, 286 aa, Streptococcus pneumoniae
MLVFSEYQTGTIDLALSFYGYEECTPNYSFGPAIRDTYVLHYITKGQGKFYYKGKIVDLKEGDFFLLKPEELTFYQADSKEPWAYYWLGITGGKSPDYFALSQISDQSYLIQSETCHTQTTAKLISDIVRFAQITKSSELAQLHIMGQLHELMFHLGTIAPNQKKKNISSTHQLYLECKRLIDSHYPQSLTIQDLAKELSVHRSYLSSVFKEFNTLSPKEYLLYVRMHRARQLLENTQESIKVIAYSVGFSDPLHFSKAYKQYFNQTPSHTRKEYSQYQLVRKATL

SEQ ID NO: 2940 - protein, 720 aa, Streptococcus pneumoniae
MGVRIENNLFYVESKNLSLIIENRNGYLLLKHLGKTIKNYKGSNSVYERDHAFSGNPTATNRTFSLDTQRQIFGQHGLGDFRKPTIQVQHSVTEVTDFRFVEAKILKGQNGPQGLPSPHSMDDTETLVLMLEDSKAQLSLTLYYTTFNNDATIASYSKLDNNSNQEVVIHKDFSFMADFPAADYEIVTLQGAYAREKTVRRQQVEQGIFSISSNRGASGHAQTPALLLCEQGVTEDAGNVFAIQLMYSGNFEAFVQKNQLNEVRVAIGINPENFSWKLAPEEYFETPVALVTHSDQGLTGISHESQNFVLKHIILSEFSKKERPILINNWEATYFDFQREKLLELADEAKKVGIELFVLDDGWFGNRFDDNRALGDWVVNEEKLGGSLESLISAIHERGLQFGLWLEPEMISVDSDLYRQHPDWAIQVPDYEHTYSRNQLVLNLANPQVVEYLKSVLDQLLSYHEIDYIKWDMNRNITKLGNGLTYLETQMQSHQYMLGLYELVSYLTEKHSHILFESCSGGGGRNDLGMMRYFPQVWASDNTDAIARLPIQYGSSYLYPTISMGAHVSAVPNHQMGRTTPLETRGHVAMMGNLGYELDLTSLSDEEKAEIANQVNLYKELRPVVQLGQQYRLINPDTASNEAAVQFNYKNQTIVTYVRVLSVVETMETTLKLKDLDEEGLYELQENGEVYSGAELMYAGLTVILSQGDFLSKQYIFRRL

SEQ ID NO: 2941 - protein, 419 aa, Streptococcus pneumoniae
MKWYKKIGLLATTGLALVGLGACSNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 2942 - protein, 81 aa, Streptococcus pneumoniae
MTTKAHAQYFCNTFFIVSLLLIHIRFHRVKEGIQIIDHALFITGQDIVHGQGMEVCFTGPVLLQPDQVTIRKGIFGHTSKR

SEQ ID NO: 2943 - protein, 288 aa, Streptococcus pneumoniae
MKKVLQKYWAWAFVVIPLLLQAIFFYVPMFQGAFYSFTNWTGLTYNYKFVGLNNFKLLFMDPKFMNAIGFTAIITIAMVVGEIALGIFIARVLNSKIKGQTFFRAWFFFPAVLSGLTVALIFKQVFNYGLPAIGNALHIEFLQTSLLGTKWGAIFAAVFVLLWQGVAMPIIIFLAGLQSIPTEITEAARIDGATSKQVFWNIELPYLLPSVSIVFILALKGGLTAFDQVFAMTGGGPNNATTSLGLLVYNYAFKNNQFGYANAIAVILFFLIVVISIIQLRVSKKFEI

SEQ ID NO: 2944 - protein, 277 aa, Streptococcus pneumoniae
MKQDERKALIGKYILLILGSVLLLVPLLATLFSSFKPTKDIVDNFFGFPTNFTWDNFSRLLADGIGGYYWNSVVITVLSLLAVMIFIPMAAYSIARNMSKRKAFTIMYTLLILGIFVPFQVIMIPITVMMSKLGLANTFGLILLYLTYAIPQTLFLYVGYIKISIPESLDEAAEIDGANQFTTYFRIIFPMMKPMHATTMIINALWFWNDFMLPLLVLNRDSKMWTLPLFQYNYAGQYFNDYGPSFASYVVGIISITIVYLFFQRHIISGMSNGAVK

SEQ ID NO: 2945 - protein, 481 aa, Streptococcus pneumoniae
MMPIQNKTMLITYSDSLGNNLKDLYDNLEEHFRDAIGGVHLLPFFPSTGDRGFAPVDYDEVDSAFGDWEDVKRLGERYYLMFDFMINHISRQSKYYKDYQEKHEASEFKALFLNWDKFWPENRPTQSDVDLIYKRKDRAPKQEIVFEDGSVEHLWNTFGEEQIDLDVTKEVTMEFIRKTIQHLASNGCDLIRLDAFAYAVKKLDTNDFFVEPDIWDLLDKVRDIATEYGTEFLPEIHEHYSIQFKIADHDYYVYDFALPMVTLYTLYSSRTERLAKWLKMSPMKQFTTLDTHDGIGVVDVKDILTDEEIDYASNELYKVGANVKRKYSSAEYNNLDIYQINSTYYSALGDDEVKYFLARLIQAFAPGIPQVYYVGLLAGKNDLKLLEETKEGRNINRHYYSNEEIAKEVQRPVVKALLNLFSFRNRSEAFDLEGTTEIETPTAHSIVIKRQNKDKSVTAVAEIDLQNQTYRVIENGVEVTF

SEQ ID NO: 2946 - protein, 397 aa, Streptococcus pneumoniae
LKSIGFIEKLKGLSSKELILLGIILSIFLPFYLFVVVLCLYIISLIFTGDMKSILQKMGEHPMLLLFLSYSTVISILAQNWMGLVASVGMFLFTIFFLHYQSILSHKFFRLILQFVLFGSVLSAVFASLEHFQIVKKFNYAFLSPNMQVWHQNRAEVTFFNPNYYGIICCFCIMIAFYLFTTTKLNWLKVFCVIAGFVNLFGLNFTQNRTAFPAIIAGAIIYLFTTIKNWKAFWLSIGVFAIGLSFLFSSDLGVRMGTLDSSMEERISIWDAGMALFKQNPFWGEGPLTYMHSYPRIHAPYHEHAHSLYIDTILSYGIVGTILLVLSSVAPVRLMMDMSQESGKRPIIGLYLSFLTVVAVHGIFDLALFWIQSGFIFLLVMCSIPLEHRMLVSDMTD

SEQ ID NO: 2947 - protein, 133 aa, Streptococcus pneumoniae
ALGADESDDFEELHAASTPAANKTRPAVADTPIFLFSTPLVMGIMNGHPLFHLIPLKIKQIFRIFRLVGTNFSFFFEYMIQIVVRSVKDYSENRKFDAETLEFRKTYSKMKYGRNNVILEFKLNYNNIVEVSF

SEQ ID NO: 2948 - protein, 661 aa, Streptococcus pneumoniae
VENKKIGVSATAGLVLLAAGVLAACSSSKSSDSSAPKAYGYVYTADPETLDYLISSKNSTTVVTSNGIDGLFTNDNYGNLAPAVAEDWEVSKDGLTYTYKIRKGVKWFTSDGEEYAEVTAKDFVNGLKHAADKKSEAMYLAENSVKGLADYLSGTSTDFSTVGVKAVDDYTLQYTLNQPEPFWNSKLTYSIFWPLNEEFETSKGSDFAKPTDPTSLLYNGPFLLKGLTAKSSVEFVKNEQYWDKENVHLDTINLAYYDGSDQESLERNFTSGAYSYARLYPTSSNYSKVAEEYKDNIYYTQSGSGIAGLGVNIDRQSYNYTSKTTDSEKVATKKALLNKDFRQALNFALDRSAYSAQINGKDGAALAVRNLFVKPDFVSAGEKTFGDLVAAQLPAYGDEWKGVNLADGQDGLFNADKAKAEFAKAKKALEADGVQFPIHLDVPVDQASKNYISRIQSFKQSVETVLGVENVVVDIQQMTSDEFLNITYYAANASSEDWDVSGGVSWGPDYQDPSTYLDILKTTSSETTKTYLGFDNPNSPSVVQVGLKEYDKLVDEAARETSDLNVRYEKYAAAQAWLTDSSLFIPAMASSGAAPVLSRIVPFTGASAQTGSKGSDVYFKYLKLQDKVVTKEEYEKAREKWLKEKAESNEKAQKELASHVK

SEQ ID NO: 2949 - protein, 498 aa, Streptococcus pneumoniae
MKKYIFMRVLRSLVSIFLVTTLTYTIIYTLVPRKLIFKQDPNYNKIATTADKRDNYENTVFERMGYIEYYDTRELQEKASSMDSSVTVEANATNKAIYEKYINQLGHGWTLGEFTESGQFYATREIPIFERVFHFYANLIDIDHTNKIQDPENPDLKRYLRFENDPAIGWSLVGSGTKHKYLLYFNSQFPFVHQNFVNLNLGDSYPTYANTPVLQVITQGQGQTKTAQVQFPTGKKTSSVNIYSRTYKSPSQADSREVASYGKDDPYTATESNYQYPSMIVSSAITGLIGLVLAYALAVPLGSAMARFKNTWIDSLSTGTLTFLLALPTIALVYIVRLIGSSIALPDSFPILGAGDWRSYVLPAVILGLLGAPVTAIWIRRYMIDLQSQDFVRFARAKGLSEKEISNKHIFKNAMVPLVSGIPGAIIGVIGGATLTETVFAFPGMGKMLIDSVKASNNSMVVGLVFIFTCISIFSRLLGDIWMTIIDPRIKLTEKGGK

SEQ ID NO: 2950 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 2951 - protein, 355 aa, Streptococcus pneumoniae
MTKEKNVILTARDIVVEFDVRDKVLTAIRGVSLELVEGEVLALVGESGSGKSVLTKTFTGMLEENGRIAQGSIDYRGQDLTALSSHKEWEQIRGAKIATIFQDPMTSLDPIKTIGSQITEVIVKHQGKTAKEAKELAIDYMNKVGIPDADRRFNEYPFQYSGGMRQRIVIAIALACRPDVLICDEPTTALDVTIQAQIIDLLKSLQNEYHFTTIFITHDLGVVASIADKVAVMYAGEIVEYGTVEEVFYDPRHPYTWSLLSSLPQLADDKGDLYSIPGTPPSLYTDLKGDAFALRSDYAMQIDFEQKAPQFSVSETHWAKTWLLHEDAPKVEKPAVIANLHDKIREKMGFAHLAD

SEQ ID NO: 2952 - protein, 112 aa, Streptococcus pneumoniae
MISPLLVSFRPMIARPIVVFPLPDSPTSEKVSPLLIKKLAFLTATNFLLPSPKEISKSLISTNFSDISFLLVSQMGKSHFFTDLIMEICNHSWFFYFWSILMKKPSFSPMCL

SEQ ID NO: 2953 - protein, 308 aa, Streptococcus pneumoniae
MSEKLVEIKDLEISFGEGSKKFVAVKNANFFINKGETFSLVGESGSGKTTIGRAIIGLNDTSNGDIIFDGQKINGKKSREQAAELIRRIQMIFQDPAASLNERATVDYIISEGLYNHRLFKDEEERKEKVQNIIREVGLLAEHLTRYPHEFSGGQRQRIGIARALVMQPDFVIADEPISALDVSVRAQVLNLLKKFQKELGLTYLFIAHDLSVVRFISDRIAVIYKGVIVEVAETEELFNNPIHPYTQALLSAVPIPDPILERKKVLKVYDPSQHDYETDKPSMVEIRPGHYVWANQTELARYQKGLN

SEQ ID NO: 2954 - protein, 418 aa, Streptococcus pneumoniae
MEQLHFITKLLDIKDPNIQILDIINKDTHKEIIAKLDYDAPSCPECGSQMKKYDFQKPSKIPYLETTGMPTRILLRKRRFKCYQCSKIAVAETSLVKKNHQIPRIINQKIAQKLIEKISMTDIAHQLSISTSTVIRKLNDFHFKHDFSCLPEIMSWDEYAFTKGKMSFIAQDFNNLNIITVLEGRTQAIIRNHFLKYDRAVRCRVKIITMDMFSPYYDLARQLFPCAKIVLDRFHIVQHLSRAMSRVRVQIMNQLDRKSHEYKAIKRYWKLIQQDSRKLSDKRFYRPTFRIHLTNKEILNKLLSYSEDLKHHYQLYQLLLFHFQNKEPEKFFGLIEDNLKQVHPLFQTVFKTFLKDKEKIVNALQLHYSNAKLEATNNLIKLIKRNAFGFRNFENFKKRIFIALNIKKERTKFVLSRA

SEQ ID NO: 2955 - protein, 95 aa, Streptococcus pneumoniae
MSFIAQNFEKLDIITVLEGRTQAVIRDHFLKYDRAVRCRVKIITMDMFSPYYDLAKQLRFQISRLRLKQSPRLFHSRMLKSFLIAFTLYNILAVL

SEQ ID NO: 2956 - protein, 172 aa, Streptococcus pneumoniae
MEQLHFITKLLDIKDPNIQILDIINKDTHKEIIAKLDYEAPSCPECGSQMKKYYFQKPSKIPYLETTGMPTRILLRKRRFKCYHCSKIMVAETSIVKKNHQIPRIINQKIAQKLIEKISMTDIAHQLSISTSTVIRKLNDFHFECNFRNLPKIMSWDVETVRGVTVSIGRWR

SEQ ID NO: 2957 - protein, 236 aa, Streptococcus pneumoniae
MKKYQQLFKQIQETIQNETYAVGDFLPSEHDLMEQYQVSRDTVRKALSLLQEEGLIKKIRGQGSQVVKEETVNFPVSNLTSYQELVKELGLRSKTNVVSLDKIIIDKKSSLITGFPEFRMVWKVVRQRVVDDLVSVLDTDYLDMELIPNLTRQIAEQSIYSYIENGLKLLIDYAQKEITIDHSSDRDKILMDIGKDPYVVSIKSKVYLQDGRQFQFTESRHKLEKFRFVDFAKRKK

SEQ ID NO: 2958 - protein, 655 aa, Streptococcus pneumoniae
MGKFEQEAKDLLQAIGGKENVTAVTHCATRMRFVLRDDKKANVKAIESIPAVKGTFTNAGQFQVIIGNDVPIFYNDFTAVSGIEGVSKEATKSAAKSNQNVVQGVMTTLAEIFTPIIPALIVGGLILGFRNVLEGVHWSMLDGKTITESSQFWAGVNHFLWLPGEAIFQFLPVGITWSVSRKMGTSQILGIVLGICLVSPQLLNAYAVASTPAADIAANWVWNFGYFTVNRIGYQAQVIPALLAGLSLSYLEIFWRKHIPEVISMIFVPFLSLIPALILAHTVLGPIGWTIGQGLSSVVLAGLTGPVKWLFGAIFGALYAPFVITGLHHMTNAIDTQLIADAGGTALWPMIALSNIAQGSAVFAYYFMHRHDECEAQVSLPATISAYLGVTEPALFGVNVKYIYPFVAGMTGSALAGMLSVTFNVTAASIGIGGLPGILSIQPQYMLPFAGTMLVAIVVPMLLTFFFRKAGLFTKIEGDTNLQAEFVAQEEAEFVSHEPVELTSVEIISPLTGQVKELSQATDPVFASGVMGQGLVIEPSQGELTSPVNGTVTVLFPTKHAIGIVSDEGVELLIHIGMDTVGLDGKGFESLVVQGDHVIVGQQLIRFDMDVIKAAGLVTETPVIITNQDAYTATITGTYPTTIQAGASLMVATRI

SEQ ID NO: 2959 - protein, 541 aa, Streptococcus pneumoniae
MTLDKGKVVYQIYPKSYKDTTENGIGDFRGIIEKIPYLAKLGVDMVWLNPFYPSPQRDNGYDISDYMAVDPLFGDMADFEEMVCVGKEHKIDFMLDMVLNHCSTEHEWFQKALAGDKYYQDFFFIQDQPTDWQSKFGGSAWAPFGDTGKYYLHLFDETQADLNWRNPNVRKELFKVVNFWRDKGVKGFRFDVINLIGKDEVSVDCPENEGKPAYTDKPIVHNYLRMMNQATFGSDDSFMTVGEMSSTTMENCVLYSSPDRQELSMTFNFHHLKVDYKDGQKWTLAPFDFEELKSLYHSWGKEMSDKDGWSALFWNNHDQPRALNRFVDIQNFRKEGATMLAASIHLSRGTPYIYMGEEIGMIDPDYDSMADYVDVESLNAYQMLLEEGKSQQEAFQIIQAKSRDNSRIPMQWDASENAGFSTGTPWLKAGKSYKYINVENEIQGPIFTFYQDLIRLRKEMPIISEGSYKPAFEDSKQVYAFERQFEDQKLLVLNNFYAKEVEIDLPAVYQNGQILISNYEDAEVSEKILLKPYQTLAIYVN

SEQ ID NO: 2960 - protein, 60 aa, Streptococcus pneumoniae
INTLRKSLQTVSVLSATSKRCFEQPVASFLVCSLIFIEYKLSKETSFSEKQGSFCCLFHP

SEQ ID NO: 2961 - protein, 83 aa, Streptococcus pneumoniae
MMDLLLAIVLIVLAFLGGALGGMYLVRKQIEKEFADNPRLNAEAVRTLLSANGQKPSEAKVQQVYHQIIRQQKAALANNKKKK

SEQ ID NO: 2962 - protein, 264 aa, Streptococcus pneumoniae
MDNRPIGFLDSGVGGLTVVRDVMRQLPHEEIVYIGDSARAPYGPRPAEQIREYTWQLVNFLLTKDVKMIVIACNTATAVVWEEIKAQLDIPVLGVILPGASAAIKSSQGGKIGVIGTPMTVQSDIYRQKIHDLDPDLQVESLACPKFAPLVESGALSTSVTKKVVYETLRPLVGKVDSLILGCTHYPLLRPIIQNVMGPKVQLIDSGAECVRDISVLLNYFEINRGRDAGPLHHRFYTTASSQSFAQIGEEWLEKEIHVEHVEL

SEQ ID NO: 2963 - protein, 296 aa, Streptococcus pneumoniae
RMAGKRDSCGACRIMTNKIYEYKDDQDWYVGSYSIFGGVNSLSDYKTDFPLFEFSKIFGDEEYGFPLSVTVLRYGSTYRLFSFVVDMLNQDMGRNLEVIQRHGALLLVENGQLLYVELPKEGVNVHDFFETSKVRETLLIATRNEGKTKEFRAIFDKLGYDVENLNDYPDLPEVAETGMTFEENARLKAETISQLTGKMVLADDSGLKVDVLGGLPGVWSARFAGVGATDRENNAKLLHELAMVFELKDRSAQFHTTLVVASPNKESLVLNTRPGQVILTLNLRVKMALAMIPSSL

SEQ ID NO: 2964 - protein, 73 aa, Streptococcus pneumoniae
GKFSVEHQTWSGYINFEPKGENGFGYDPLFLVGETGESSAELTLEEKNSQSHRALAVKKLLEVFPSWQSKPSL

SEQ ID NO: 2965 - protein, 173 aa, Streptococcus pneumoniae
MAKQTIIVMSDSHGDSLIVEEVRDRYVGKVDAVFHNGDSELRPDSPLWEGIRVVKGNMDFYAGYPERLVTELGSTKIIQTHGHLFDINFNFQKLDYWAQEEEAAICLYGHLHVPSAWMEGKILFLNPGSISQPRGTIRECLYARVEIDDSYFKVDFLTRDHEVYPGLSKEFSR

SEQ ID NO: 2966 - protein, 153 aa, Streptococcus pneumoniae
MIAKEFETFLLGQEETFLTPAKNLAVLIDTHNADHATLLLSQMTYTRVPVVTDEKQFVGTIGLRDIMAYQMEHDLSQEIMADTDIVHMTKTDVAVVSPDFTITEVLHKLVDESFLPVVDTEGIFQGIITRKSILKAVNALLHDFSKEYEIRCQ

SEQ ID NO: 2967 - protein, 246 aa, Streptococcus pneumoniae
MPMRDRISAFLEEKQGLSVNSKQSYKYDLEQFLDMVGERISETSLKIYQAQLANLKISAQKRKISACNQFLYFLYQKGEVDSFYRLELAKQAEKKTEKPEILYLDSFWQESDHPEGRLLALLILEMGLLPSEILAIKVADINLDFQVLRISKASQQRIVTIPTALLSELEPLMGQTYLFERGGKPYSRQWAFRQLESFVKEKGFPSLSAQVLREQFILRQIENKVDLYEIAKKLGLKTVLTLEKYR

SEQ ID NO: 2968 - protein, 242 aa, Streptococcus pneumoniae
MDIKLKDFEGPLDLLLHLVSKYQMDIYDVPITEVIEQYLAYVSTLQAMRLEVTGEYMVMASQLMLIKSRKLLPKVAEVTDLGDDLEQDLLSQIEEYRKFKLLGEHLEAKHQERAQYYSKAPTELIYEDAELVHDKTTIDLFLAFSNILAKKKEEFAQNHTTILRDEYKIEDMMIIVKESLIGRDQLRLQDLFKEAQNVQEVITLFLATLELIKTQELILVQEESFGDIYLMEKKEESQVPQS

SEQ ID NO: 2969 - protein, 189 aa, Streptococcus pneumoniae
MSTLAKIEALLFVAGEDGIRVRQLAELLSLPPTGIQQSLGKLAQKYEKDPDSSLALIETSGAYRLVTKPQFAEILKEYSKAPINQSLSRAALETLSIIAYKQPITRIEIDAIRGVNSSGALAKLQAFDLIKEDGKKEVLGRPNLYVTTDYFLDYMGINHLEELPVIDELEIQAQESQLFGERIEEDENQ

SEQ ID NO: 2970 - protein, 240 aa, Streptococcus pneumoniae
MRINKYIAHAGVASRRKAEELIKQGLVTVNGQVVRELATTIKSGDKVEVEGQPIYNEEKVYYLLNKPRGVISSVTDDKGRKTVVDLLPNVKERIYPVGRLDWDTSGVLILTNDGDFTDEMIHPRNEIDKVYVARVKGVANKDNLRPLTRGLEIDGKKTKPAVYEILKVDPVKNRSVVQLTIHEGRNHQVKKMFEAVGLQVDKLSRTRFGHLDLTGLRPGESRRLNKKEISQLHTMAVTKK

SEQ ID NO: 2971 - protein, 80 aa, Streptococcus pneumoniae
MKRILIAPVRFYQRFISPVFPPSCRFELTCSNYMIQAIEKHGFKGVLMGLARILRCHPWSKTGKDPVPDHFSLKRNQEGE

SEQ ID NO: 2972 - protein, 174 aa, Streptococcus pneumoniae
VAYFKAFCMSSIMSFVDSSPPPLRYQRSGVSWIILPFLAAGVSAIRAFSRTPLLLELSPPMARVRLMTKRMSGLISLTLSKLTSCPWRESSNVVSVGLNFKVWYKKEKRDLAPKAAIFPSLRRIARAFLSELSFLVATSWMLLSSLANSSLAFCVPVSPKALAKDSILALVEVQ

SEQ ID NO: 2973 - protein, 321 aa, Streptococcus pneumoniae
MKTSLKLYFTALVASFLLLLGACSTNSSTSQTETSSSAPTEVTIKSSLDEVKLSKVPEKIVTFDLGAADTIRALGFEKNIVGMPTKTVPTYLKDLVGTVKNVGFMKEPDLEAIAALEPDLIIASPRTQKFVDKFKEIAPTVLFQASKDDYWTSTKANIESLASAFGETGTQKAKEELAKLDKSIQEVATKNESSDKKALAILLNEGKMAAFGAKSRFSFLYQTLKFKPTDTTFEDSRHGQEVSFESVKEINPDILFVINRTLAIGGDNSSNNGVLENALIAETPAAKNGKIIQLTPDLWYLSGGGLESTKLMIEDIQKALK

SEQ ID NO: 2974 - protein, 250 aa, Streptococcus pneumoniae
VKLENIDKSIQKQDILQGISLEVSPQKLTAFIGPNGAGKSTLLSIMSRLTKKDQGVLSIKGREIESWNSQELAQELTILKQKINYQAKLTVEELVSFGRFPYSRGRLRSEDWEKIRETLNYLELTNLKDRYINSLSGGQLQRVFIAMVLAQDTDFILLDEPLNNLDIKQSVSMMQILRRLVEELGKTIIIVLHDINMASQYADEIVAFKDGQVFSKGSTDQIMQADLLSQLYEIPITLADINDKKICIYS

SEQ ID NO: 2975 - protein, 66 aa, Streptococcus pneumoniae
MLISWRTMIMVLPSSSTSRRRICIMLTLCLISRLLSGSSSKIKSVSWASTIAIKTRWSCPPDRLLM

SEQ ID NO: 2976 - protein, 318 aa, Streptococcus pneumoniae
MQTKSKHTKLFWILIILAIGACLLYFWPITHLSAFAWKLRSQKIIVYLLVAIATGISTISFQTLTENRFLTPSILGIESFYVLLQTLLLVFESKFLQLGKSPILEFLVLLLVQSLFFLALQGYLKTLMKQDLVFILLICLALRSLFRNISTFLQVLMDPNEYDKLQNSLFASFQHLNTSILAIGSLIILALTIFFFRKAVVLDVLHLQRETAQILGLDVEKEQKELLWGIVLLTSTATALVGPMAFFGFMLANLTYLIVKDYQHKLLFIVAILIGFISLTLGQALIERVFALEIRISMIIESVGGFLFFILLYRRARQ

SEQ ID NO: 2977 - protein, 319 aa, Streptococcus pneumoniae
MKLSHYLIGLLLLLVFLSISIGTSDFSWGKLFDFDQQTWLLFQESRLPRTISILLTASSMSMAGLLMQTITQNQFAAPSTVGTTEAAKLGMVLSLFVFPSASLTQKMLFAFVSSIVFTLFFLAFMTIFTVKERWMLPLIGIIYSGIIGSVTEVIAYRFNLVQSMTAWTQGSFSMIQTHQYEWLFLGLIILITVWKLSQTFTIMNLGKETSESLGISYSLLEKLALFLVALTTSVTMITVGGLPFLGVIVPNLVRKCYGDNLSQTKLMVALVGANLVLACDILSRVLIRPYELSVSLLLGIIGSLVFILLLWRGGRKDAD

SEQ ID NO: 2978 - protein, 135 aa, Streptococcus pneumoniae
MNQFLKVLSEVGIQKIMFFLSVLFYGNNCIDKPVIEDTVFDPVNPYAETKLMGERMIYWMANRYDWKYVIFRYFNVAGAEMDASNGLRVKNPTHIIPNINKTALGQNDSLKIFGDDYDTRDGSCIRDYIYVLDLA

SEQ ID NO: 2979 - protein, 80 aa, Streptococcus pneumoniae
MTKTILVTGGTSYIGSHTVKALLNAGYQVHVLDNLSTGNRAAVDSRASFKELDVYDASALKAYLKKNQIDAVFPFPVEIF

SEQ ID NO: 2980 - protein, 354 aa, Streptococcus pneumoniae
MTTLFSKIKEVTELAAVSGHEAPVRAYLREKLTPHVDEVVTDGLGGIFGIKHSEAVDAPRVLVASHMDEVGFMVSEIKPDGTFRVVEIGGWNPMVVSSQRFKLLTRDGHEIPVISGSVPPHLTRGKGGPTMPAIADIVFDGGFADKAEAESFGIRPGDTIVPDSSAILTANEKNIISKAWDNRYGVLMVSELAEALSGQKLGNELYLGSNVQEEVGLRGAHTSTTKFDPEVFLAVDCSPAGDVYGGQGKIGDGTLIRFYDPGHLLLPGMKDFLLTTAEEAGIKYQYYCGKGGTDAGAAHLKNGGVPSTTIGVCARYIHSHQTLYAMDDFLEAQAFLQALVKKLDRSTVDLIKHY

SEQ ID NO: 2981 - protein, 98 aa, Streptococcus pneumoniae
MVEPNLESLIKDLYNHARHDLSEDLVAALLETTKKLPTTNEQLQAVRLSGLVNRELLLNPKHPAPELLNLARFVKREEAKYRGTATSALMYEELFKML

SEQ ID NO: 2982 - protein, 62 aa, Streptococcus pneumoniae
KISINSFDFPNQFVHILFHSAIISPYPIFFVAPFKQPIPYRLTIPHFTPLPLQKFLHYYGLG

SEQ ID NO: 2983 - protein, 147 aa, Streptococcus pneumoniae
MKDSHLLAHHIRLLNGRIFQKLLSQDPEALYRGEQGKILAVLWNSETGCATATDIALATGLANNTLTTMIKKLEEQKLVIVSPCGKDKRKKYLVLTELGKSQKEVGHRVSQKLDTIFYKGFSEEEIHQFEGFQERILANLKEKGNEV

SEQ ID NO: 2984 - protein, 254 aa, Streptococcus pneumoniae
MSQQVKNAHNLYIHAIQDGRVAEAQAQSVGDTYIQHSTGVPDGKEGFAAFFADFFERHPERQIKIVRTIEDGNLVFVHVHQYLNGGEAQWVTTDTFREDENGCIVEHWDVIDYYRTPENDQLDQIFGDFEIKDLDKKAENKKLVRRFLTEIFQNGELEQWSDYVADDLIQHNHEIGQGSAAYKNYVAEYSVTFDFVFQLLGQGNYVVSYGQTQIDGVAYAQYDIFRLENGKIVEHWDNKEVMPKVEDLTNRGKF

SEQ ID NO: 2985 - protein, 242 aa, Streptococcus pneumoniae
MIEYKNVALRYTEKDVLRDVNLQIEDGEFMVLVGPSGSGKTTMLKMINRLLEPTDGNIYMDGKRIKDYDERELRLSTGYVLQAIALFPNLTVAENIALIPEMKGWSKEEITKKTEELLAKVGLPVAEYGHRLPSELSGGEQQRVGIVRAMIGQPKILLMDEPFSALDAISRKQLQVLTKELHKEFGMTTIFVTHDTDEALKLADRIAVLQDGEIRQVSNPETILKAPATDFVADLFGGSIHD

SEQ ID NO: 2986 - protein, 28 aa, Streptococcus pneumoniae
LLHPFISGMRAIFSATVRFGKRAIACKT

SEQ ID NO: 2987 - protein, 310 aa, Streptococcus pneumoniae
MTNLIATFQDRFGDWLTALSQHLQLSLLTLLLAILLAIPLAVYLRYHEKLADWVLQIAGIFQTIPSLALLGLFIPLMGIGTLPALTALVIYAIFPILQNTITGLKGIDPSLQEAGIAFGMTRWERLKKFEIPLAMPVIMSGIRTAAVLIIGTATLATLIGAGGLGSFILLGIDRNNASLILIGALSSAVLAIAFNFLLKVMEKAKLRTIFSGFALVALLLGLSYSPALLAQKEKENLIIAGKIGPEPEILANMYKLLIEENTSMTATVTPNFGTTSFLYEALKKGDIDIYPEFTGTVTEKFASTITQGES

SEQ ID NO: 2988 - protein, 209 aa, Streptococcus pneumoniae
LKSLLQPSPKVSHEPEQVYQVARDGIAKQDHLAYLKPMSYQNTYAVAVPKKIAQEYGLKTISDLKKVEGQLKAGFTLEFNDREDGNKGLQSMYGLNLNVATMQPALRYQAIQSGDIQITDAYSTDAELERYDLQVLEDDKQLFPPYQGAPLMKEALLKKHPELERVLNTLAGKITESQMSQLNYQVGVEGKSAKQVAKEFLQEQGLLKK

SEQ ID NO: 2989 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 2990 - protein, 178 aa, Streptococcus pneumoniae
MTNIDRRISKTKKAIYQAFIQLLNAKGYEATTVQDIIDLADVGRSTFYCHYESKELLLDQLCRYLFHHLFEREQAISTEDYLAHLFLHFHKNQDHITSLLFSKNDYFLRQLHKELEHHVYSVLADNLKEAHPNMPTSYLQHLVVSNFIETLTWWLKKGQDFTGQEVVQFYLDLLIPKN

SEQ ID NO: 2991 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGALVTAVILVTGSVLVILENVTKILHPQPVNDEGILWLGIIAITINLLASLVVGKGKTKNESILNLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 2992 - protein, 117 aa, Streptococcus pneumoniae
VNIKSASDLLGISADTIRYYERVGLVPPITRTATGIRDFQDQDIEALEFIKCFRSAGVSVDSLVDYMSLYQKGDETREERLGILEEEKQKLEERLSQLQTALNRLNLKIKLYKEGKF

SEQ ID NO: 2993 - protein, 345 aa, Streptococcus pneumoniae
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 2994 - protein, 335 aa, Streptococcus pneumoniae
MATLKDIAQLASVSIATVSRVLNRDQSLSVTEETRHRILTVAEELGYTKHLKTGESHKPKQKIAIIQWVSEQGELDDLYYYQIRLGIEKRAQELDYDILRYFNDHPFTLSEEVIGILCIGKFSRAQISAFEEYQKPLVFLDSDTLSLGHTCIITDFYTAMKQVVDYFLSQGMDRIGILTGLEETTDQEEIIEDKRLENFRNYSQAKGIYHDELVFQGRFTAQSGYDLMKEAIQSLGDQLPPAFFAASDSLAIGALRALQEAGISLPDRVSLISFNDTSLTKQVYPPLSSITVYTEEMGRAGMDILNKEVLHGRKIPSLTMLGTRLTLRESTLNQE

SEQ ID NO: 2995 - protein, 392 aa, Streptococcus pneumoniae
MTQHLTAETLRKDFLAVFGQEADQIFFSPGRINLIGEHTDYNGGHVFPAAISLGTYGAARKRDDQVLRFYSANFEDKGIIEVPLADLKFEKEHNWTNYPKGVLHFLQEAGHVIDKGFDFYVYGNIPNGAGLSSSASLELLTGVVAEHLFDLKLERLDLVKIGKQTENNFIGVNSGIMDQFAIGMGADQRAIYLDTNTLEYDLVPLDLKDNVVVIMNTNKRRELADSKYNERRAECEKAVEELQVALDIQTLGELDEWAVDQYSYLIKDENRLKRARHAVLENQRTLKAQAALQAGDLETFGRLMNASHVSLEHDYEVTGLELDTLVHTAWAQEGVLGARMTGAGFGGCAIALVQKDTVEAFKEAVGKHYEEVVGYAPSFYIAEVAGGTRVLD

SEQ ID NO: 2996 - protein, 493 aa, Streptococcus pneumoniae
VILVDKFVTHVISESSFEEMDRIYLTNRVLARVGEGVLEVETNLDKLIDLKDQLVEEAVRLEMIEDSQTAREILGTELMDLVTPYPSQVNRDFWEAYVHSPEQAIEDFYQLSQKNDYIKLKAIAKNIAYRVPSDYGELEITINLSKPEKDPKEIAVAKLVQASNYPQCQLCLENEGYHGRVNHPARSNHRIIRFEMVGQEWGFQYSPYAYFNEHCIFLDGQHRPMAISRQSFERLLAIVEQFPGYFAGSNADLPIVGGSILTHDHYQGGRHVFPMELAPLQKTFRFAGFEQVKAGIIKWPMSVLRLTSDSKEDLINLADKIFQEWRQYSDSSVQILAETDGTPHHTITPIARKRDGQFELDLVLRDNQTSAEHPDGIYHPHKDVQHIKKENIGLIEVMGLAILPPRLKEEVEQVASYLVGEAVTVADYHQEWADQLKSQHPDLTDKEKALAIVKDSVGAIFVRVLEDAGVYKQTEQGQTAFMRFVEQVGISLD

SEQ ID NO: 2997 - protein, 134 aa, Streptococcus pneumoniae
MKDFHFDAISAFENYEIEKMRDGHVVVTTKVVNSSLNYYGNAHGGYLFTLCDQISGLVVISLGLDGVTLQSSINYLKAGKLDDVLTIKGECVHQGRTTCVMDVDITNQEGRNVCKATFTMFVTGQRSEERRVSI

SEQ ID NO: 2998 - protein, 295 aa, Streptococcus pneumoniae
LCFNFYGIIKSMKIKEIKKVTLQPFTKWTGGKRQLLPVIRELIPKTYNRYFEPFVGGGALFFDLAPKDAVINDFNAELINCYQQIKDNPQELIEILKVHQEYNSKEYYLDLRSADRDERIDMMSEVQRAARILYMLRVNFNGLYRVNSKNQFNVPYGRYKNPKIVDEELISAISVYLNNNQLEIKVGDFEKAIVDVRTGDFVYFDPPYIPLSETSAFTSYTHEGFSFADQVRLRDAFKRLSDTGAYVMLSNSSSALVEELYKDFNIHYVEATRTNGAKSSSRGKISEIIVTNYEK

SEQ ID NO: 2999 - protein, 256 aa, Streptococcus pneumoniae
MTKPYYNKNKMILVHSDTFKFLSKMKPESMDMIFADPPYFLSNGGISNSGGQVVSVDKGDWDKISSFEEKHEFNRKWIRLAKEVLKPNGTVWISGSLHNIYSVGMALEQEGFKILNNITWQKTNPAPNLSCRYFTHSTETILWARKNDKKARHYYNYDLMKELNDGKQMKDVWTGSLTKKVEKWAGKHPTQKPEYLLERIILASTKEGDYILDPFVGSGTTGVVAKRLGRRFIGIDAEKEYLKIARKRLEAENETN

SEQ ID NO: 3000 - protein, 288 aa, Streptococcus pneumoniae
MKQTRNFDEWLSTMTDTVADWTYYTDFPKVYKNVSSIKVALNIMNSLIGSKNIQEDFLDLYQNYPEILKVVPLLIAKRLRDTIIVKDPIKDFYFDFSKRNYSIEEYTMFLEKSGIFDLLQNHLVSNLVDYVTGVEVGMDTNGRKNRTGDAMENIVQSYLEAEGYILGENLFKEIEQNEIEEIFSVDLSAITNDGNTVKRFDFVIKNEQVLYLIEVNFYSGSGSKLNETARSYKMIAEETKAIPNVEFMWITDGQGWYKAKNNLRETFDILPFLYNINDLEHNILKNLK

SEQ ID NO: 3001 - protein, 118 aa, Streptococcus pneumoniae
  UNSURE (10): Xaa at each above location is unknown.
RLATNLITQXVSWFSLDSFLKFGALAQIIPSPVLGGAMLVMFVFVSIQGMQILARVDFANNEHNFLIAAVSIAAGVGLNNSNLFVSMPTAFQMFFSNGIVVASLLAIVLNAVLNHKKK

SEQ ID NO: 3002 - protein, 282 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAASMGLVDFSPVAAAPVVHVPTPFYFGMPTFEISSIVMMCIIATVSMVESTGLFIWPCLISQRIQSTAPPAQRIPRRRFGLNFWGDF

SEQ ID NO: 3003 - protein, 193 aa, Streptococcus pneumoniae
MKLLEDRILKDGHILGDNILKVDSFLTHQVDFSLMREIGKVFAEKFAAAGITKVVTIEASGIAPAVFTAEALNVPMIFAKKAKNITMNEGILTAQVYSFTKQVTSTVSIAGKFLSPEDKVLIIDDFLANGQAAKGLIQIIEQAGATVQAIGIVIEKSFQDGRDLLEKAGYPVLSLARLDRFENGQVVFKEADL

SEQ ID NO: 3004 - protein, 57 aa, Streptococcus pneumoniae
MPFMMEKSSNTLRKSLQATSTSPYRRYMILTLSILSTTSKQCFEVVDSFLVCSLIFI

SEQ ID NO: 3005 - protein, 79 aa, Streptococcus pneumoniae
MLEEGTKDQLAELTYPFGRGVNLSFGIKDVPKLYQKVMEANYPIYRLLTKRKFRVSDPYIYPHKFAVLDPDGYFLRFSE

SEQ ID NO: 3006 - protein, 275 aa, Streptococcus pneumoniae
MKLISWNIDSLNAALTSDSARAKLSQEVLQTLVAENADIIAIQETKLSAKGPTKKHVEILEELFPGYENTWRSSQEPARKGYAGTMFLYKKELTPTISFPEIGAPSTMDLEGRIITLEFDAFFVTQVYTPNAGDGLKRLEERQVWDVKYAEYLAELDKEKPVLATGDYNVAHNEIDLANPASNRRSPGFTDEERAGFTNLLATGFTDTFRHVHGDVPERYTWWAQRSKTSKINNTGWRIDYWLTSNRIADKVTKSDMIDSGARQDHTPIVLEIDL

SEQ ID NO: 3007 - protein, 75 aa, Streptococcus pneumoniae
MKFYSYDYVLSQIGQQNGIMVGFGIVLLAVTVFFAFKAYHDKKGTEFRELVMISALALFSSAFGQHHDLSKQSSF

SEQ ID NO: 3008 - protein, 89 aa, Streptococcus pneumoniae
LVSITTYQNNQVSNNKFQTSLHFIEVVSKDLGVDKSEVYVNTSTNTDGALIKVGDRYYRALNGSEPDKYLLEKVELYKTDAIELVDVNK

SEQ ID NO: 3009 - protein, 176 aa, Streptococcus pneumoniae
MTLNYIEILIKLVLTLKWLNNNVHFVKRLIDGKPTLLIKNGNIDPEACRSVGLSASDVALKLRSQGIFQMKQVKRAVQEQNGQLIVVQMGDENPKYPVVTDGVIQVDVLESIGRSEEWLLDNLSKQGHDNVANIFIAEYDKGAVTVVTYEKEKPGVLYSSKISSNRVNVALPYVGY

SEQ ID NO: 3010 - protein, 78 aa, Streptococcus pneumoniae
WGLVLFENLFKPRQRRLAVCRLLTSSVLSTTSKQCFEQPAASFLVCSLIFIEYWPQVSICNQKGILCPLFKNFGGFSS

SEQ ID NO: 3011 - protein, 581 aa, Streptococcus pneumoniae
MSIIQKLWWFFKLEKRRYLVGIVALVLVSVLNLIPPMVMGRVIDAITSGQLTQQDLLLSLFYLLLAAFGMYYLRYVWRMYILGTSYCLGQIMRSRLFKHFTKMSSAFYQTYRTGDLMAHATNDINALTRLAGGGVMSAVDASITALVTLLTMLFSISWQMTLVAILPLPFMAYATSRLGRKTHKAFGESQAAFSELNNKVQESVSGIKVTKSFGYQADELKSFQAVNELTFQKNLQTMKYDSLFDPMVLLFVGSSYVLTLLVGSLVVQEGQITVGNLVTFISYLDMLVWPLMAIGFLFNTTQRGKVSYQRIENLLSQESPVQDPEFPLDGIENGRLEYAIDSFAFENEETLTDIHFSLAKGQTLGLVGQTGSGKTSLIKLLLREYDVDKGAIYLNGHDIRDYRLTDLRSLMGYVPQDQFLFATSILDNIRFGNPNLPLSAVEEATKLARVYQDIVDMPQGFDTLIGEKGVSLSGGQKQRLAMSRAMILDPDILILDDSLSAVDAKTEYAIIDNLKETRKDKTTIITAHRLSAVVHADLILVLQNGQIIERGRHEDLLALDGWYAQTYQSQQLEMKGEEDAE

SEQ ID NO: 3012 - protein, 293 aa, Streptococcus pneumoniae
MQNKQEQWTVLKRLMSYLKPYGLLTFLALSFLLATTVIKSVIPLVASHFIDQYLSNLNQLAVTVLLVYYGLYILQTVVQYVGNLLFARVSYSIVRDIRRDAFANMEKLGMSYFDKTPAGSIVSRLTNDTETISDMFSGILSSFISAVFIFLTTLYTMLVLDFRLTALVLLFLPLIFLLVNLYRKKSVKIIEKTRSLLSDINSKLAENIEGIRIIQAFNQEKRLQAEFDEINQEHLAYANRSVALDALFLRPAMSLLKLLGYAVLMTYFGYRGLSIGITAGTMYAFIQYINRPL

SEQ ID NO: 3013 - protein, 68 aa, Streptococcus pneumoniae
MLLSSTSTALFDPLIEVTQNFSTLQTSMVSAGRVFALIDESTYEPLQENGQAKVKEGNISFGTCVYLV

SEQ ID NO: 3014 - protein, 263 aa, Streptococcus pneumoniae
MRAPMSPFKKMGKPKSRRAISVLEHVCISYDGKHPILDDISFSVNKGETIAFVGHTGSGKSSIINVLMRFYEFQSGRVLLDDVDIRDFSQEELRKNIGLVLQEPFLYHGTIKSNIAMYQEISDEQVQAAAAFVDADSFIQELPQGYDSPVSERGSSFSTGQRQLFAFARTVASQPKILILDEATANIDSETESLVQASLAKMRQGRTTIAIAHRLSTIQDANCIYVLDKGRIIESGTHEELLTLGGTYHKMYSLQAGAMAYTL

SEQ ID NO: 3015 - protein, 231 aa, Streptococcus pneumoniae
MLKWEDLPVEMKSSEVESYYQLVSKRKGSLIFKRCLDWVLALVLTWVLTSPIFLILSIWIKLDSKGPVIYKQERVTQYNRRFKIWKFRTMVTDADKKGSLVTSANDSRITKVGNFIRRVRLDELPQLVNVLKGEMSFVGTRPEVPRYTEQYSPEMMATLLLQAGITSPASINYKDEDTIISQMTEKGLSVDQAYVEHVLPEKMRYNLAYLREFSFFGDIKIMFQTVFEVLK

SEQ ID NO: 3016 - protein, 408 aa, Streptococcus pneumoniae
MPNYNIPFSPPDITEAEIAEVADTLRSGWITTGPKTKELERRLSLYTQTPKTVCLNSATAALELILRVLEVGPGDEVIVPAMTYTASCSVITHVGATPVMVDIQADTFEMDYDLLEQAITEKTKVIIPVELAGIVCDYDRLFQVVEKKRDFFTASSKWQKAFNRIVIVSDSAHALGSTYKGQPSGSIADFTSFSFHAVKNFTTAEGGSATWKANPVIDDEEMYKEFQILSLHGQTKDALAKMQLGSWEYDIVTPAYKCNMTDIMASLGLVQLDRYPSLLQRRKDIVDRYDSGFAGSRIHPLAHKTETVESSRHLYITRVEGASLEERSLIIQELAKAGIASNVHYKPLPLLTAYKNLGFDMTNYPKAYAFFENEITLPLHTKLSDEEVDYIIETFKTVSEKVLTLSKK

SEQ ID NO: 3017 - protein, 62 aa, Streptococcus pneumoniae
GLFLLRERIFIGFSFLVGVPWFEIRCEQFGVAFRILTRHHLENLVSCSSFQFTLFFERREFP

SEQ ID NO: 3018 - protein, 88 aa, Streptococcus pneumoniae
EIYCSVLVSIRHMSDIKVNIPGECLYDKVFVLSFIIYNISINLNIVNGIFYIQAKKDSITFEWKAKEQTRKLAIDSSKPCFEVVDIVK

SEQ ID NO: 3019 - protein, 708 aa, Streptococcus pneumoniae
MKYFVPNKVFSIRKLKVGTCSVLLAISILESQGILSNKVVTSSSPMATKESSNAITNDLDNSPTVNQNRSAEMIASNSTTNGLDNSLSVNSISSNGTIRSNSQLDNRTVESTVTSTNENKSYKEDVISDRIIKKEFEDTALSVKDYGAVGDGIHDDRQAIQDAIDAAAQGLGGGNVYFPEGTYLVKEIVFLKSHTHLELNEKATILNGINIKNHPSIVFMTGLFTDDGAQVEWGPTEDISYSGGTIDMNGALNEEGTKAKNLPLINSSGAFAIGNSNNVTIKNVTFKDSYQGHAIQIAGSKNVLVDNSRFLGQALPKTMKDGQIISKESIQIEPLTRKGFPYALNDDGKKSENVTIQNSYFGKSDKSGELVTAIGTHYQTLSTQNPSNIKILNNHFDNMMYAGVRFTGFTDVLIKGNRFDKKVKGESVHYRESGAALVNAYSYKNTKDLLDLNKQVVIAENIFNIADPKTKAIRVAKDSAEYLGKVSDITVTKNVINNNSKETEQPNIELLRVSDNLVVSENSIFGGKEGIVIEDSKGKITVLNNQFYNLSGKYISFIKSNANGKEPVIRDSDGNFNIVTENGLYKIVTNNLSDKNEKEKNKEEKQYNSNNVIDSNQKNGEFNSSKDNRQMNDKIDNKQDNKTEEVNYKIVGDGRETENHINKSKEIVDVKQKLPKRGSYKIMELFLTVTGIGLLLTLKGLKYYGKDK

SEQ ID NO: 3020 - protein, 81 aa, Streptococcus pneumoniae
GDIVGSQNQYFWIIGGATDLYNSKEEIGYSVSEVVHILSESLSVNCKESKTLKQIFETALLEVKDEIGLNSYKLTEYSKMK

SEQ ID NO: 3021 - protein, 68 aa, Streptococcus pneumoniae
LLEIDLTVLIDLSYYYFILLYSVNLYEFKPISSLTSSKAVSNICLRVFDSLQLTDKLSDKICTTSETE

SEQ ID NO: 3022 - protein, 94 aa, Streptococcus pneumoniae
DKSIRTVKSISNNVLEVEVYYSSFNILYYRLPIFAKLSEKKLEYMMLGDCVMLVNEMEITDHRVDNLFEKGKNEIKDSCSRFSNRTYKSFRKSI

SEQ ID NO: 3023 - protein, 95 aa, Streptococcus pneumoniae
KIHVVDLAIGHIKALEKVSEKTDVYIYNLGSGEGTSVLQLVNTFESVNKIPIPYKIVPRRSGDVATCYANADKAYKELNWRTTKSIEDMCRDTWN

SEQ ID NO: 3024 - protein, 65 aa, Streptococcus pneumoniae
VFHIKTFFFIFDIGVIMFTLYNETVSFVKRCQTFFLIYLSLNMHFIKRLSNFSKIQHSYRQYHQL

SEQ ID NO: 3025 - protein, 219 aa, Streptococcus pneumoniae
MKNLTKIKFKENGEFNHFPGNTVVANLYTKQDLMEVVDIIQSRYRELPFIDKFTLTPRNSIHMTVIELLCHENRETEFWSSNLPLDTPLQEIHDYFAKQLEIFPLLDEEIHMRITEMGKQNILVEPADEASAKRLEEIRTYVSEKAGVCFPNHDRYQFHISIGYLRIPLTEEEEEEFTKVRAELTEILLEKIPTITVNRIDYTVFEDMRQFVPYHEKFK

SEQ ID NO: 3026 - protein, 355 aa, Streptococcus pneumoniae
MKKMKVWSTVLATGVALTTLAACSGGSNSTTASSSEEKADKSQELVIYSNSVSNGRGDWLTAKAKEAGFNIKMVDIAGAQLADRVIAEKNNAVADMVFGIGAVDSNKIRDQKLLVQYKPKWLDKIDQSLSDKDNYYNPVIVQPLVLIGAPDVKEMPKDWTELGSKYKGKYSIYGLQGGTGRAILASILVRYLDEKGDLGVSEKGWEVAKEYFANAYTLQKGESSVVKALDKESPIQYGMIWGSGALIGQKEQNVEFKVMTPEIGVPFVTEQTMVLSTSKKQALAKEFIDWFGQSEIQVEYSKKFGSIPANKDALKELPEDTKKFVDQVKPQNIDWEAVGKHLDEWVEKAELEYVK

SEQ ID NO: 3027 - protein, 336 aa, Streptococcus pneumoniae
MIKFDNIQIKYGDFVAIDNLNLDIHEGEFFTFLGPSGCGKSTTLRALVGFLDPSSGSIEVNGTDVTHLEPEKRGIGIVFQSYALFPTMTVFDNIAFGLKVKKVAPDVIKAKVSAVAAKIKISDQQLQRNVSELSGGQQQRVALARALVLEPKILCLDEPLSNLDAKLRVDLRKELKRLQKELGITTLYVTHDQEEALTLSDRIAVFNNGYIEQVGTPVEIYHNSQTEFVCDFIGDINVLTDETVHEVLLKNTSVFLEDKKGYIRLEKVRFNRETEQDFILKGTIIDVEFSGVTIHYTIKVSESQILNVTSIDSQAAIRSVGESVELFITPSDVLQF

SEQ ID NO: 3028 - protein, 563 aa, Streptococcus pneumoniae
MRHKLNLKDWLIRLGLIWFLVTFIIYPNFDLVVNVFVKGGEFSLDAVHRVLKSQRALQSIMNSFKLAFSLIITVNVVGILCVLFTEYFDIKGAKILKLGYMTSLIYGGVVLATGYKFVYGPYGLITKFLQNVIPSLDPNWFIGYGAVLFIMTFSGTANHTLFLTNTIRSVDYHTIEAARNMGAKPFTVFRKVVLPTLIPTLFALTIMVFLSGLSAVAAPMIVGGKEFQTINPMIITFAGMGNSRDLAALLAIILGIATTILLTIMNKIEKGGNYISISKTKAPLKKQKIASKPWNIIAHIVAYGLFTVFMLPLIFIVLYSFTDPVAIQTGNLTLSNFTLENYRLFFSNSAAFSPFLVSFIYSIIAATTATILAVVFARVVRKHKSRFDFLFEYGALLPWLLPSTLLAVSLLFTFNQPQFLVLNQILVGSLVILLIAYIVVKIPFSYRMVRAILFSVDDEMEDAARSMGASPFYTMMKVIIPFILPVVLSVIALNFNSLLTDFDLSVFLYHPLAQPLGITIRSAGDETATSNAQALVFVYTIVLMIISGTVLYFTQRPGRKVRK

SEQ ID NO: 3029 - protein, 236 aa, Streptococcus pneumoniae
MTATSLGLSNIEIVVRIVLSVVIGSIIGLERGSKSQPAGIRTYSIVCLAACLIMMTNEYVSYKFGTGDPTRLGAQVISGVGFLGAGTILITDKKKITGLTTAAGIWASAGIGLAIGVGFYEGALLVAISVWGVISMFQPLKKYLQNRSKMIELYIVVKSTEAYNRVLVYCAENGIRMTDSRTAFGDVNSDRIEYFDVPDKKIASFITLELSGRFEHLRLMEEIANIVGVIYVEEIS

SEQ ID NO: 3030 - protein, 102 aa, Streptococcus pneumoniae
LIQVYKFISFYDICEMVFAFHLPPDELITNVIFKEKINSMLKCYIDRLLYVFINPTHFTEKVNLQFYGSFFSYEFICREVGNILKNKGVKCNLNFFEGEEYL

SEQ ID NO: 3031 - protein, 333 aa, Streptococcus pneumoniae
MKNINGKKVTIYDIARLSGFSPKTVSRVINGGVNVKEETYQAIQKVIEELSYIPNAYAKNLTKKEAINILISVKKIDSFPLIWFHTLLDKVLRTCKEFGVNAIVEYFGEEDTISNSIISSTGSLVDGVIVFYESVDDIRIQYLKKNHMPFLVFGESQTSGVVYVSNNNFQATYDMMKAVTEEKFKNMWLLMGGESHVNKDRERGVRSFLNDKNYFMDLKVIYGLSTIDSVYSYAMQHLTSQNYPDIIFVSGDEKVQGLIRACYEKGILIPDDISIIGFDNIPISQYYTPALSTIAPNYVKLAKEMIEGVLAIIKGESVTSVEVSPKFVRRQSF

SEQ ID NO: 3032 - protein, 65 aa, Streptococcus pneumoniae
GGTALPTPSHGSIFCVWAFFYPSFALSFIRALSRFDELEFYLQLLPPTKSKQKGWTNTKKASNTQ

SEQ ID NO: 3033 - protein, 68 aa, Streptococcus pneumoniae
MKIKEQTRKLAAGCSKHCFEVADRTDEVSSKHCFEVADRTDEVSNHTYDKATLTRFEEIFEEYKGVPR

SEQ ID NO: 3034 - protein, 487 aa, Streptococcus pneumoniae
LRWHREFRPHASYFAWGFFIQSLRTRIRTEREITMERIIHGDVLSPILAYMRLKGQHKVILESIPRDKETARFSILAYNPVFEIKFENGVLYQNGQVIDRDPLDFLYEVIHKSQHHSELPFGGGAIGFVGYDMISLYEEIGQIPEDTIGTPDMHFFVYESYIVFDHKKEKIHVIEDALYSERSQEALEKSLNQVLEELRIPAPNEFEDLDLSPLDFKPHIAPHKFEGMVETARDLIRNGDMFQCVLSQRFSAEVTGNPFDFYRNLRVTNPSNYLYFYDFGDYQIIGASPESLVSVKNGIVTTNPIAGTRPRGATDEEDKALATDLLSDEKETAEHRMLVDLGRNDIGRISETASVQVTKYMEVELFRYVMHLTSVVKGRLLAELTAMDALKATLPAGTVSGAPKIRAMRRIYELETEKRGVYAGAIGYLSATGDMDLAIAIRTMILKNQRAYVQAGAGIVYDSIAQNEYQETINKAKSMTRIGELRP

SEQ ID NO: 3035 - protein, 66 aa, Streptococcus pneumoniae
MRPISLRPKSTNIRCSAVSFSSERRSVAKALSSSSVAPLGRVPAIGLVVTMPFLTETKLSGLAPMI

SEQ ID NO: 3036 - protein, 188 aa, Streptococcus pneumoniae
MILLIDNYDSFTYNLAQYIGNFAEVQVLRNDDSKLYEEAEKADGLVFSPGPGWPVDAGKMEDMIRDFAGKKPILGICLGHQAIAEVFGGKLGLAPKVMHGKQSNINFEAPSVLYQGIEDGRAVMRYHSILIEEMPEDFEVTARSTDDQAIMGIQHKNLPIYGFQYHPESIGTPDGLSSIRNFIEKVVK

SEQ ID NO: 3037 - protein, 334 aa, Streptococcus pneumoniae
MKEIIEKLAKFENLSGVEMTDVIERIVTGRVTEAQIASLLLALKMKGETPEERTAIAQVMRGHAQHIPTEIHDAMDNCGTGGDKSFSFNISTTAAFVLAGGGIHMAKHGNRSISSKSGSADVLEALGINLDLKPAELGKVFDKTGIVFLFAKNMHPAMKYIMPARLELGIPTIMNLTGPLIHPMALETQLLGISRPELLESTAQVLKNMGRKRAIVVAGPEGLDEAGLNGTTKIALLENGEISLSSFTPEDLGMEGYAMEDIRGGNAQENAEILLSVLKNEASPFLETTVLNAGLGFYANGKIDSIKEGVALARQVIARGKALEKLRLLQEYQK

SEQ ID NO: 3038 - protein, 255 aa, Streptococcus pneumoniae
MSQEFLARILEQKAREVEQMKLEQIQPLRQTYRLAEFLKNHQDCLQVIAEVKKASPSLGDINLDVDIVQQAQTYEENGAVMISVLTDEVFFKGHLDYLREISSQVEIPTLNKDFIIDEKQIIRARNAGATVILLIVAALSEERLKELYDYATELGLEVLVETHNLAELEVAHRLGAEIIGVNNRNLTTFEVDLQTSVDLAPYFEEGRYYISESAIFTGQDAERLAPYFNGILVGTALMQAENVAQRIKELQIDKG

SEQ ID NO: 3039 - protein, 209 aa, Streptococcus pneumoniae
MWPRESRSCRLTKVKICGLSTKEAVETAVSAGADYIGFVFAPSKRQVTLEEAAELAKLIPADVKKVGVFVSPSRVELLEAIDKVDLDLVQVHGQVADDLFENLPCASIQAVQVDGNGHVPNSQADYLLFDAPVAGSGQSFDWGQLDTTGLAQPFFIAGGLNEDNVVKAIQHFTPYAVDVSSGVETDGQKDHEKIRRFIERVKHGISGTK

SEQ ID NO: 3040 - protein, 407 aa, Streptococcus pneumoniae
MAYQEPNKDGFYGKFGGRFVPETLMTAVLELEKAYRESQADPSFQEELNQLLRQYVGRETPLYYAKNLTQHIGGAKIYLKREDLNHTGAHKINNALGQVWLAKRMGKKKIIAETGAGQHGVATATAAALFNMECTIYMGEEDVKRQALNVFRMELLGAKVEAVTDGSRVLKDAVNAALRSWVANIDDTHYILGSALGPHPFPEIVRDFQSVIGREAKQQYRDLTGQNLPDALVACVGGGSNAIGLFHPFVEDESVAMYGAEAAGLGVDTEHHAATLTKGRPGVLHGSLMDVLQDAHGQILEAFSISAGLDYPGIGPEHSHYHDIKRASYVPVTDEEALEGFQLLSRVEGIIPALESSHAIAFAVKLAKELGPEKSMIVCLSGRGDKDVVQVKDRLEADAAKKGEAHA

SEQ ID NO: 3041 - protein, 277 aa, Streptococcus pneumoniae
MWFKSKTAWKQMQQRREKLMPKTLTEKLNAIKATGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFIYAVAINGVTGKSGNYRADLDKHLAQLHQVADIPVLTGFGVSSQADLERFNAVSDGVIVGSKIVKALHQGEPIQDFIRQAVAYQK

SEQ ID NO: 3042 - protein, 67 aa, Streptococcus pneumoniae
NQLKTEQIYWEIQITFLKYFRNRSVIFQIQFTIKLAFLLQKKKERLPFVPFLLLATCLIIFGKLLLV

SEQ ID NO: 3043 - protein, 243 aa, Streptococcus pneumoniae
MLNQDLFDSLEAQKIVDTLMKGQKDYVDERLEKRETMIVSNGYAWTRPNHIDTAFASADLFEYKLQLAGQTWGYLEFETNTEKYGKVLLIIKGKKRLTNQFPLVQKNKSGYLFEYAQMNTLYLNQHSSYKNDEDSHSFPIQMELVSDEMIQEIEQATKNSNIEKFMILTYEADSENNIISVDVVMPDARTGQLHLIQDLSEYIQSSSYHFEEAKYQDIPNFSELSETEDFEIIPRIEKQEGQK

SEQ ID NO: 3044 - protein, 383 aa, Streptococcus pneumoniae
MFNGRVLKELRLLNGLSRAELAQRINLTEQAIWQFESNETKPKLSTKMHLANQFHVDLTYFEQEEESIRFDSSVIAFRNADLATRKTIDIQTMYLHKVDSLIDYFESFVIIPNIIIHDLSNVVSESYHKGESIEELALYAREKLGISKDNHDLLYKLERSGIYIVERLINGQADAYSAWSKLGRPYIVLGTNKSSVRRNFDLAHELGHILLHKYKDMNEDGDRLEQEANYFASCFLLPKEEFLVKFEERVGKRVSNPDSYILLKSDLNVSIQALEYRAFKLGLLTPKQHSYFYRQIAQKGYKMIEPLDDQIFVKKPSKVKSILDVVLSNHLVSLATIMSKQSIRLQFISEIFSVEMKFFDQYQEDRRTDRFDNIIPLYKRNNL

SEQ ID NO: 3045 - protein, 219 aa, Streptococcus pneumoniae
MIDFYFFLVGSILASFLGLVIDRFPEQSIISSASHCDSCQTRLRPLDLIPILSQVFNRFRCRYCKVRYPVWYALFELVLGLLFLLYSWELLSLGQVVLITAGLTLGIYDFHHQEYPLLVWMTFHLILIASSGWNLVMVSFLALGILAHFIDIRMGAGDFLFLASCALVFSVTELLILIQFASATGILAFLLQKKKERLPFVPFLLLATCLIIFGKLLLV

SEQ ID NO: 3046 - protein, 148 aa, Streptococcus pneumoniae
MTIRFEEKVSIENAQFVCQWSNSLGKSFQEQWMGPRIPFLLTLQALEGVFSIFDEQEFVGLIQKIRLEDSNLHIGRFFINPQKQEQDLGSQALRKFVSLAFENEDIDSISLNVFEANQRAQNLYQKEGFEIVQMVEAPVRKYSRLKLE

SEQ ID NO: 3047 - protein, 103 aa, Streptococcus pneumoniae
KANSLEINVDCDYEPESAPQKGLYMNERYQCLKTKEYQALLSSKGRQIFAKRKIDMKSVFGQIKVCLGYKRCHLRGKRQVRIDMGFVLMANNLLKYNKRKRQN

SEQ ID NO: 3048 - protein, 67 aa, Streptococcus pneumoniae
MSVEEKLNQAKGSIKEGVGKAIGDEKMEKEGAAEKVVSKVKEVAEDAKDAVEGAVEGVKNMLSGDDK

SEQ ID NO: 3049 - protein, 202 aa, Streptococcus pneumoniae
MSNEKNTNTNVEKKDATVVAHEIKGELTYEDKVIQKIIGLSLENVSGLLGIDGGFFSNLKEKIVNSDDVTSGVNVEVGKTQVAVDLNVIVEYQKNVPALYSEIREIVSSEVAKMTDLEIVEINVNVVDIKTKEQHEADSVSLQDRVSDVAESTGEFTSEQFEKAKSGLGSGFSTVQEKVSEGVEAVKGAANGVVSHENTRVN

SEQ ID NO: 3050 - protein, 190 aa, Streptococcus pneumoniae
LYMSKAKKICFIIFCILILTIFLPVLIDYHQVSDLGIHLLSWRQNSVVEFYLARYVFWGTVVLSTLVLLSILVVMFYPKRYLEIQLETKNDTLKLKNSAIEGFVRSLVSDHRLIKNPTVHVNLRKNKCFVHVEGKILPSDNIADRCQIIQNEITNGLKQFFGIERQVKLEVAVKNYQPKPQNKKTVSRVK

SEQ ID NO: 3051 - protein, 512 aa, Streptococcus pneumoniae
LWYNCKRFNPIIYKERKIFMRDLLSKKSHRQLELLELLFEHKRWFHRSELAELLNCTERAVKDDLSHVKSAFPDLIFHSSTNGIRIINTDDSDIEMVYHHFFKHSTHFSILEFIFFNEGCQAESICKEFYISSSSLYRIISQINKVIKRQFQFEVSLTPVQIIGNERDIRYFFAQYFSEKYYFLEWPFENFSSEPLSQLLELVYKETSFPMNLSTHRMLKLLLVTNLYRIKFGHFMEVDKDSFNDQSLDFLMQAEGIEGVAQSFESEYNISLDEEVVCQLFVSYFQKMFFIDESLFMKCVKKDSYVEKSYHLLSDFIDQISVKYQIEMENKDNLIWHLHNTAHLYRQELFTEFILFDQKGNTIRNFQNIFPKFVSDIKKEISHYLETLEVCSSSMMVNHLSYTFITHTKHLVINLLQNQPKLKVLVMSNFDQYHAKFVAETLSYYCSNNFELEVWTELELSKESLEDSPYDIIISNFIIPPIENKRLIYSNNINTVSLIYLLNAMMFIRLDE

SEQ ID NO: 3052 - protein, 333 aa, Streptococcus pneumoniae
MVEQRKSITMKDVALEAGVSVGTVSRVINKEKGIKEVTLKKVEQAIKTLNYIPDYYARGMKKNRTETIAIIVPSIWHPFFSEFAMHVENEVYKRNNKLLLCSINGTNREQDYLEMLRHNKVDGVVAITYSPIEHYLTSGIPFVSIDRTYSDIAIPCVSSDNDAGGREAAKQLISKGCQHLAFVGGHNTTINETKRRRISFEKYVQEHKIPLSIFDLDETVTDYYGKLESFLEENSSIDGIFTINDFTALDVIEILEKNGKRIPHDVQIIGYDGIKMAGDRDYLLSTIEQPLEEMAKEAVRILFDIIDGKTVNLQTILPVKFVEGKTTKNENKS

SEQ ID NO: 3053 - protein, 314 aa, Streptococcus pneumoniae
MKRFKKEVAMNSKAKQVSLWERIKKQKLLLLMTVPGLVLTFIFKYIPMYGVLIAFKDYNPLKGILGSDWIGFSEFTKFISSPNFGILLANTLKLSIYGLLLGFLPPIILAIMLNQLLSEKVKKRIQLILYAPNFISVVVIVGMIFLFFSVGGPINNFLSMFGMKADFLTNPDFFRPLYIFSGIWQGMGWASTLYTATLVNVDPALVEAARLDGANIFQRIWHIDIPALKPIMVIQFVLAAGGIMNVGYEKAFLMQTSLNLPTSEIISTYVYKVGLVSGDYSYSTAVGLFNAVINVVLLVAVNQIVKRMNNGEGI

SEQ ID NO: 3054 - protein, 305 aa, Streptococcus pneumoniae
MVKEFKEGSMKNSIMDTKFDRRILLLNKIIIVFIVLMTLLPLLYIVVASFMDPKVLVSRGISFNPADWTVEGYQRVFSDQSILRGFINSLLYSFGFAALTVLLSVFTAYPLSKKDLVGRRWINYFLIVTMFFGGGLVPTYLLVKELGMLNTPWAIIVPGAVNVWNIILARAYFQGLPEELVEAAVIDGANDLQIFFKIMLPLAKPIMFVLFLYAFVGQWNSYFDAMIYIKDPNLEPLQLVLRKILIQSQPGQDMIGAQAAMNEMKRLAELIKYATIVISSLPLIVMYPFFQKYFDKGIMAGSLKG

SEQ ID NO: 3055 - protein, 538 aa, Streptococcus pneumoniae
MKFKTFSKSAVLLTASLAVLAACGSKNTASSPDYKLEGVTFPLQEKKTLKFMTASSPLSPKDPNEKLILQRLEKETGVHIDWTNYQSDFAEKRNLDISSGDLPDAIHNDGASDVDLMNWAKKGVIIPVEDLIDKYMPNLKKILDEKPEYKALMTAPDGHIYSFPWIEELGDGKESIHSVNDMAWINKDWLKKLGLEMPKTTDDLIKVLEAFKNGDPNGNGEADEIPFTFISGNGNEDFKFLFAAFGIGDNDDHLVVGNDGKVDFTADNDNYKEGVKFIRQLQEKGLIDKEAFEHDWNSYIAKGHDQKFGVYFTWDKNNVTGSNESYDVLPVLAGPSGQKHVARTNGMGFARDKMVITSVNKNLELTAKWIDAQYAPLQSVQNNWGTYGDDKQQNIFELDQASNSLKHLPLNGTAPAELRQKTEVGGPLAILDSYYGKVTTMPDDAKWRLDLIKEYYVPYMSNDNNYPRVFMTQEDLDKIAHIEADMNDYIYRKRAEWIVNGNIDTEWDDYKKELEKYGLSDYLAIKQKYYDQYQANKN

SEQ ID NO: 3056 - protein, 140 aa, Streptococcus pneumoniae
MFFRLILSINEMFIFCYKTIGFFYCVFLISHNQPLVFVCLVLVVVFLFNSEVIRKSVFFKFFLVIIPLSINIAIYNPFSTFTVDIVIHICLDMGNLVQIFLCHKDSWIVIVIAHVRNIIFFDKIQTPFGIIWHGCHFTIV

SEQ ID NO: 3057 - protein, 439 aa, Streptococcus pneumoniae
MGDKKYTVEKANRFIAENKHLVNTQYKPEEHFSAEIGWINDPNGFVYFRGEYHLFYQFYPYDSVWGPMHWGHAKSKDLVTWEHLPVALAPDQDYDRNGCFSGSAIVKDDRLWLMYTGHIEEKTGVRQVQNMAFSDDGIHFEKISQNPVVTGTDLPDELIAADFRDPKLFEKDGRYYSVVAVKHMDNVGCIVLLGSDNLVEWQFESIFLKGGEHQGFMWECPDYFELDGKDCLIMSPMRYQREGDSYHNINSSLLFTGKVDWREKRFIPESVQEIDHGQDFYAPQTLLDDQNRRILIAWMQTWGRTLPTHDQEHKWACAMTLPRILRLEDGKLRQFPVKKGQYQIQIDKDCHYHLGNDIDYLEFGYDSNAQQVYIDRSHLIQKILGEEEQDTSRRYVDIEAKELEVVLDKNSIEIFVNQGEASLTATYYLTVPAELSRID

SEQ ID NO: 3058 - protein, 423 aa, Streptococcus pneumoniae
MPDNLALRMRPKTIDQVIGQEHLVGPGKIIRRMVEANRLSSMILYGPPGIGKTSIASAIAGTTKYAFRTFNATVDSKKRLQEISEEAKFSGGLVLLLDEIHRLDKTKQDFLLPLLESGLVIMIGATTENPFFSVTPAIRSRVQIFELEPLSNQDVKEALQIALSNPERGFDFPIELDEDALDFIATSTNGDLRSAFNSLDLAVLSTPENDEGIRHITLDIMENSLQRSYITMDKDGDGHYDVLSALQKSIRGSDVDASLHYTARLIEAGDLPSLARRLTVIAYEDIGLANPEAQIHTVTALDAAQKIGFPEARILIANVVIDLALSPKSNSAYVAMDKALADLKTSGHLPIPRHLRDGHYSGSKELGNAQDYLYPHNYPGNWVKQDYLPEKIRNHHYFQAEDTGKYERALAQRKEAIDHLRKI

SEQ ID NO: 3059 - protein, 73 aa, Streptococcus pneumoniae
MEMMELPSQEILIFTKQIRHWILSDQVISGKRKLFFREDTPKEILDLYENIKSKLDFAYQEVYSNNGLKKYEK

SEQ ID NO: 3060 - protein, 59 aa, Streptococcus pneumoniae
LNLIFEEYQFVKIGDKKYRVRSVPMIHSTPPQSVLDRDTFTIDYTDDELLDKEAVFTTH

SEQ ID NO: 3061 - protein, 83 aa, Streptococcus pneumoniae
NNKYHSFTIRVTRVIMVLSGGKSAMPMTQKEMVKLLTAHGWIKTRGGKGSHIKMEKQGERPITILHGKLNKYTERGIRKQAGL

SEQ ID NO: 3062 - protein, 150 aa, Streptococcus pneumoniae
MLVTYPALFYYDDTDGTEATYFVHFPDFEYSATQGEGISEALAMGSEWLGITVADLIESDGEFPQPSDINSLSLIDNDPFKDDEDFVSTYDLDKSFISMVSVDVSEYLGSQEPIKKTLTIPKWADKLGREMGLNFSQTLTDAIADKKVQA

SEQ ID NO: 3063 - protein, 156 aa, Streptococcus pneumoniae
MATYGFLDILEEELDKNFPFDFEISWDKRNHAVEVSFLLEAQNAAGVEMVDEDGEVLSDDILFEEAVLFYNPAKSTVNEEDYLTVIPYLPKKGFSREFLAYFALFLKDTAEVGLDVLMDFLEDPEAEEFVMEWNQEVFEEGKVGLEEGEFYPYPRY

SEQ ID NO: 3064 - protein, 362 aa, Streptococcus pneumoniae
MKKIGTYLVYVLAVVFIMLAFACGTIAFAELGYSAVLAFTFGYAFALLSMYLIFILHELGHAFCGYLTGYRLVAFGLGHFILTKKSGRFHLSRTAILKNVGAQYIGLKEDESDQRIILMLSGGLMVHLGLILLAIVFGFLTRSWYFAGTWIFLNLSFFLNNILSVDITDGAKIWELLQHPENTKYAYLVLRHSAQTLLAPQEYDLKDFVQAVPEDARGSFADGVLGMQGEVSILEGKEEVAKQQFQALLERTTTPMMQTVAQLSLLHIALLEGDFEQAEQYASIRQVKSFLSLKLSNLQVIQAWYQFKVRKDVVQTHKAMKIARQKMDSSRMLRDEKRYYENLLAELEKEMLEGTEDGTRNF

SEQ ID NO: 3065 - protein, 344 aa, Streptococcus pneumoniae
MKKSDVLDLIKYHYEGRETEFRNQSIAIARNFNKHGDTQIAQYIMGLMSQSDRFMPQIENPSEYLTPAKLDIGPLPLPLSIMNDLKGIINAVNHHIGINKFLFVGSTGTGKTESVKQVARLIGKELLVVDFSHLVDSKLGQTVKNLATLFNEINNLPFKQNYIILFDEIDSIVLDRVNQNDLREMGRVTSAFLKELDRLSPEIVLIATTNLFENLDKAVTRRFDAIIDFDRYTDEDKVEVATIILNELLKQFKNVARDLKLFKKIINSANVIPNPGDLRNSIRTSLAFSDPSDPHDYQKRLLRSLHNGRNLSISKLSKLGFTVREIEILTGVSKSSVSRELSED

SEQ ID NO: 3066 - protein, 747 aa, Streptococcus pneumoniae
MNTLLTLRGKSFTQKSRNNGMGPITIPKKTIITLEHLKYLHFSLEETKTYWEKNNIIDGILISIYYNRIVAKSNRINGYFNVGGGNPFPNDTIVGAKFNDEKTKHIVTHYISRDALNKTITVLSKIIEVFEEHFDRAITCEMFSDSSTFASINFSEYGISKSKFQQYLRDSCFIENFGVEHTTVSDIQNSIVTFYDVHTDIFRLLNKLNIDISEANIMNQTTVLLDEKNIELLLSKAPYLVSMIVEDFSKLSVDDFSLDNNDLKINLPSPMNEPVVGVIDTLFDKRVYFNEWVEYHDFVSPDISKDSQDYKHGTAVTSLIVDGANLNPNLDDGCGNFRVRHFGVSLQSGFNSFTIIKQIKEIVSQNADIKVWNLSLGSNDEIRENFISAEGALLDEIQFENDVIFIIAGTNASVINGKRKRIGAPADSLNSIIVNSVDFNNQSVSYSREGIVLSFFVKPDVSYYGGGNGDFINVCEPLGLGRVAGTSFAAPFIARKMAYLIHIMGLSREEAKALLIDAAIPWNDKKTFTDLSLIGNGIVPIKMDDILSTPDDEIKFIVSDISRAYDTYNYDFPVPISSESYPYVAKATMCYFPNCSRKQGVDYTNTEMQLTFGRLKSDGIKSINKDNQHAEDSPGYVRENAARNIFRKWDNVKHIGESFTSRKRAKAILNPSNPQWGMSIKTIERLKSGDGQGVRFGVVVTLKELNGVNRIEDFIQQAELRGWLVNRLQVEAQVDLFNSLNEEIEFE

SEQ ID NO: 3067 - protein, 339 aa, Streptococcus pneumoniae
MNITYIVGNGLDLQYGLKTRYRDFYEFQNKVYISRTENEEKYSNFIYESLFSDKVNDYENWSDFELSIGKLTKDNDLISSSIEIKEKFIDDFSEVVDDLREYLRIQQEKNLEKGNAIDFISTLDNMRTSLPVINQPAIDKKYNENLYQHDIVNILTLNYTNVIDKLYNESAKSFSNQLRTNNYKFHIAPPIHAHGTVDICTVLGVSDETQISNSFDEEQKESLIKNLVLKNYRENMDVKNSDIIKNSDIIILYGVSLGETDGYIWNQIAEQSIRSSVPVIIYHYVPHFDAGNPTRVKRLYRNVEDKFIQNSGIDLELEKKLRDNLIVVIGKTIFNLMER

SEQ ID NO: 3068 - protein, 316 aa, Streptococcus pneumoniae
METWQELKVTVKREGEELVSNLLIELGAQGVAIEDSLDYVGNVDRFGEIFPEVEQQEEIVVTAYYPDTVDVTVVEADLQARISELTDFMDLGELKIGTTALAEEDWADNWKKYYEPARITHDLTIVPSWTDYEATAGEKIIKLDPGMAFGTGTHPTTKMSLFALEQVLRGGETVLDVGTGSGVLSIASSLLGAKEIFAYDLDDVAVRVAQENIELNPGMENIHVAAGDLLKGVEIEADVIVANILADILIHLTEDAYRLVKDEGYLIMSGIIKDKWDMVRQSAESAGFFLETHMVQGEWNTCVFKKTKDISGVIGG

SEQ ID NO: 3069 - protein, 247 aa, Streptococcus pneumoniae
MQQYFVKGSAISPVTIEDKETSKHMFQVMRLKEEDEVTLVFDDGIKRLARVLDMENRQFELVQELNDNVELPVQVTIASGFPKGDKLEFIAQKVTELGASQIWAFPADWSVAKWDGKKLGKKVEKLEKIALGAAEQSKRNIVPSIKLFEKKADFLAQLDQFDSIIVAYEESAKEGEAAALLQAVTGLETGAKLLFIFGPEGGLSPAEIESFEAKGAVLAGLGPRILRAETAPLYALSALSVLVELEK

SEQ ID NO: 3070 - protein, 598 aa, Streptococcus pneumoniae
MEQKHRSEFPEKELWDLTALYQDREDFLRAIEKAREDINQFSRDYKGNLHTFEDFEKAFAELEQIYIQMSHIGNYAFMPQTTDYSNDEFANIAQAGMEFETDASVALTFFDDALVVADEEVLDRLGELPHLTAAIRQAKIKKAHYLGADVEKALTNLGEVFYSPQDIYTKMRAGDFEMADFEAHGKTYKNSFVTYENFYQNHEDAEVREKSFRSFSEGLRKHQNTAAAAYLAQVKSEKLLADMKGYDSVFDYLLAEQEVDRVMFDRQIDLIMKDFAPVAQRYLKHVAKVNGLEKMTFADWKLDLDSALNPEVTIDDAYDLVMKSVEPLGQEYCQEVARYQEERWVDFAANSGKDSGGYAADPYRVHPYVLMSWTGRLSDVYTLIHEIGHSGQFIFSDNHQSYFNAHMSTYYVEAPSTFNELLLSDYLENQSNDPRQKRFALAHRLTDTYFHNFITHLLEAAFQRKVYTLIEEGETFGASKLNSIMKEVLTDFWGDAIEIDDDAALTWMRQAHYYMGLYSYTYSAGLVISTAGYLHLKNSETGAEDWLNLLKSGGSKTPLESAMIIGADISTDKPLRDTIQFLSDTVDQIIAYSAELGE

SEQ ID NO: 3071 - protein, 225 aa, Streptococcus pneumoniae
MEPDIFIITKLLSDPSRMHILDILMDGKAHTVNEIASFTKIKQHTVSYHLKLLTEAQVTTLQTYGRFHYYSLKSAAIAEMLEFLSFYSPQRDVKSYKQHIHKKELKVARTCYDHIAGELGISITNYLLQENLLSESEKDFQLTEAGKSYFQRKLHIDTDELKKKKRKFCPKCLDWSERKNHVGGALGNALLEFFSEKQLVIPAQTPRSLTITEKGKEFLEKEWGI

SEQ ID NO: 3072 - protein, 216 aa, Streptococcus pneumoniae
LGILGINGAGKTSTLKMIYSLTSISSGEIDILGQNIETNRRKSKSCLGIVGQEDMLDMTLNVYDNLFAHGLCYGISSVELRKRIDSLLDFVQLSKHAQKMVNQLSSGMRRRLVLARALINRPDIIILDEPTVGLDIQSRNIIWDKLLELKELGVSIIITSHYMNEIEYLTDRVLMLHQGTIKEEGTVEDLLIKYDADNLETLFLGLTGTEKEDLHV

SEQ ID NO: 3073 - protein, 254 aa, Streptococcus pneumoniae
MFKLSFQSIGHVVVRNYMSFRNLFKISIVPNLIDPLFYLLAMGFGVGAYLTHVNGMLYRDFVITGLIAATAMSAATAETTVNAFIQYKIEKTYDAMLMTPINTSDIVVGQAIWAGIRAVIFGGIFWLISMLITAHFHVLMLLIPLILFIVGYLFGVLGLIFTYLAPSREFLNYYNVLVIRPLYMFSDTFFPITSLPPILGDLTWFSPLYHATRMIRIIWGGEVTGLYLHLIWLIALALLITVLPMYMLHRRYYR

SEQ ID NO: 3074 - protein, 263 aa, Streptococcus pneumoniae
MYQDLLRKIAEEKPNYNQEEIQWLFDHLGNPSPEIRDDLIFTSFAKGIQEELFIQEQFHFIAEGVSSDVGLDKEIDKVGLPTLERSFRALVYANLLSADANQQSVFYQGLQSEIRDDLSNQGLHYLSKEKDTTGFSSQYGWVHSFAHGADLLTEVVCHPDFPKNRVHEVFDILGQLFKRMSIRFTDDEDWRLARVIYEPILQGKLEQEQVASWIKTVDFPIEEREDFSKFSNFRSCLVEVYVQLDQRNSLQDELKEAIQSFQY

SEQ ID NO: 3075 - protein, 209 aa, Streptococcus pneumoniae
LYSSGTGAVVFGNGLDGLGHLGIAFAFGLAIVVAAYSIGTVSGAHLNPAVSIAMFVNKRLSSSELVNYILGQVVGAFIASGAVFFLLANSGMSTASLGENALANGVTVFGGFLFEVIATFLFVLVIMTVTSESKGNGAIAGLVIGLSLMAMILVGLKITGLSVNPARSLAPAVLVGGAALQQVWIFILAPIAGGVLAALVAKNFLGTEE

SEQ ID NO: 3076 - protein, 59 aa, Streptococcus pneumoniae
LLKAVFEVVDKTDEVSLKHCFEVADRTDEVSNHTYDKVKLTWFEEIFEEYHTKKPCSSR

SEQ ID NO: 3077 - protein, 190 aa, Streptococcus pneumoniae
LRALNISHFGRSTVKRQSALVVFSGGQDSTTCLFWGMQHYETVEAVTFAYGQHHHLEIQIAREIAKEQGIRHHILDMSLLGQITAQPDFATIHISYIPDKLCVESKSLKLYLFSYRNHGDFHENCINTIGKDLVNLLDPRYLEVWGKFTPRGGISIDPYYNYGKQGTKYEGLAEQRLFQHDLYPEKIDNR

SEQ ID NO: 3078 - protein, 104 aa, Streptococcus pneumoniae
MAKAITDATFEQETKDGLVLVDFWATWCGPCRMQGPILDKLSEELSEDVLKIVKMDVDENPNTARAFGIMSIPTLLFKKDGQVVKQVAGVHTAEQIKAIIAELS

SEQ ID NO: 3079 - protein, 100 aa, Streptococcus pneumoniae
LRAQSFFLTFSFIRSKIKLALNKGVLNMIEITYIDASKNERTVTFESYEDFERSQQACLIGVADYYPVQKLTYKGHNLDYHGTYGDIFFYLMKQDLSQYN

SEQ ID NO: 3080 - protein, 66 aa, Streptococcus pneumoniae
LHLSPSAVSRMVARLEAKNCGLLSRMCCHQDRRSSFICLTNDGQKTLASLQKTVEESLEAGLDFLI

SEQ ID NO: 3081 - protein, 74 aa, Streptococcus pneumoniae
MDFLLYYDSKKKGDTMTYLEKWFDFNRRQKEIESLLEETIAQQSEQSLTLKEFYLLYYLDLAEEKSLRQIELAD

SEQ ID NO: 3082 - protein, 317 aa, Streptococcus pneumoniae
MSISQRTTKLILATCLACLLAYFLNLSSAVSAGIIALLSLSDTRRSTLKLARNRLFSMLLALAIGVLAFHLSGFHIWSLGLYLAFYVPLAYKMGWEIGITPSTVLVSHLLVQESTSPDLLVNEFLLFAIGTGFALLVNLYMPSREEEIQHYHTLVEEKLKDILQRFKYYLSRGDGRNRAQLVAELDTLLKEALRLVYLDHSDHLFHQTDYHIHYFEMRQRQSRILRNMAQQINTCHLAASESLILAQLFSKIAGQLSQTNPASDLLDEIERYLEVFRNRSLPKTREEFETRATLLQLLREAKTFIQVKVDFYQKYRQ

SEQ ID NO: 3083 - protein, 286 aa, Streptococcus pneumoniae
MIGTFAAALVAVLASFIVPIEITLNSANTEIAPPDGIGQVLSNLLLKLVDSPVNALLTANYIGILSWAVIFGIAMREASKNSKELLKTIADVTSKIVEWIINLAPFGILGLVFKTISDKGVGSLANYGILLVPLVTTMLFVAPVVNPLIAFFFMRRNPYPLVWNCLRVSGVTAFFTRSSATNIPVNMKLCHDLGLNPDTYSVSIPLGSTINMAGVAITINLLTLAAVNTLGIPVDFATAFVLSVVAAISACGASGIAGVPSFLSQLLVAFSVFLTILPYKLLGLVL

SEQ ID NO: 3084 - protein, 74 aa, Streptococcus pneumoniae
GKPCQAYLDWYALWGILGLTLPNLSGIGLLGDLFVGGLKAVAPILVFALVANALSQHQKGQDSNMKTVVFLYIL

SEQ ID NO: 3085 - protein, 139 aa, Streptococcus pneumoniae
MQKFIQAYIEKLDVTTIIENILTKVISLLLLLIVFYIAKKMLHTMVQRIVKPSLKMSRHDVGRQKTISRLLENVFNYTLYFFLLYCILSILGLPVSSLLAGAGIAGVPIGMGTKAFCLMSSMAFSSSLNVNWMWEMRSF

SEQ ID NO: 3086 - protein, 65 aa, Streptococcus pneumoniae
FAGWSWYCWGTDWYGNQGFLSDVINGFFILFERQLDVGDEVVLTNGTITVSGKGCQGGNSYDTAS

SEQ ID NO: 3087 - protein, 58 aa, Streptococcus pneumoniae
LSLTEISQLLAIFHAQTRPVILSNLWYNRGSLIRRKDGFRKAVGQWLYLDRPRPRKVE

SEQ ID NO: 3088 - protein, 302 aa, Streptococcus pneumoniae
MVLEKQLGNGCTWIDLDLGKLNKLEDLSEIYGLDKETIEYALDRNERAHMDYHRESGTVTFIYNVLDVKKDKAYYETFPMTFIVEHRRLITISNTKNAYVIEQMTRYLENHDTLSIYKFLFASLEIISNAYYPVIEQMDKSRDEVNDLLRQRTTKKNLFALSDLETGMVYLTAAAKQNRILLEHIQGHALYRSFDEIEREQFDDAMIEAHQLVSMTDLISQILQQLSASYNNILNNNLNDNLTTLTIISVLLAVLAVVTGFFGMNVPLPLTDEPHAWLYISLASAGLWIVLSLLLRKIAKKS

SEQ ID NO: 3089 - protein, 175 aa, Streptococcus pneumoniae
MAIENYIPDFAVEAVYDLTVPSLQAQGIKAVLVDLDNTLIAWNNPDGTPEMKQWLHDLRDAGIGIIVVSNNTKKRVQRAVEKFGIDYVYWALKPFTFGIDRAMKEFHYDKKEVVMVGDQLMTDIRAAHRAGIRSILVKPLVQHDSIKTQINRTRERRVMRKITEKYGPITYKKGI

SEQ ID NO: 3090 - protein, 368 aa, Streptococcus pneumoniae
MEEILCIGCGATIQTTDKAGLGFTPQSALEKGLETGEVYCQRCFRLRHYNEITDVQLTNDDFLKLLHEVGDSDALVVNVIDIFDFNGSVIPGLPRFVSGNDVLLVGNKKDILPKSVKSGKISQWLMKRAHEEGLRPVDVVLTSAQNKHAIKEVIDKIEHYRKGRDVYVVGVTNVGKSTLINAIIQEITGDQNVITTSRFPGTTLDKIEIPLDDGSYIYDTPGIIHRHQMAHYLTAKNLKYVSPKKEIKPKTYQLNPEQTLFLGGLGRFDFIAGEKQGFTAFFDNELKLHRSKLEGASAFYDKHLGTLLTPPNSKEKEDFPRLVQHVFTIKDKTDLVISGLGWIRVTGTAKVAVWAPEGVAVVTRKAII

SEQ ID NO: 3091 - protein, 103 aa, Streptococcus pneumoniae
MSLTSKQRAFLNSQAHTLKPIIQIGKNGLNDQIKTSVRQALDARELIKVTLLQNTDENIHEVAEILEEEIGVDTVQKIGRILILFKQSSKKENRKISKKVKEI

SEQ ID NO: 3092 - protein, 204 aa, Streptococcus pneumoniae
LTPFTKVELEPEIKEKKRKQVGILGGNFNPVHNAHLIVADQVRQQLGLDQVLLMPEYQPPHVDKKETIPEHHRLKMLELAIEGIDGLVIETIELERKGISYTYDTMKILTEKNPDTDYYFIIGADMVDYLPKWYRIDELVDMVQFVGVQRPRYKVGTSYPVIWVDVPLMDISSSMVRAFLAQGRKPNFLLPQPVLDYIEKEGLY

SEQ ID NO: 3093 - protein, 197 aa, Streptococcus pneumoniae
MSYQDYINCSREALLEKMAELLPEKRLTHCLGVERAAMELAQRFGVDVEKASLAGLLHDYAKKLSDQEFLDLIDRYQLDPDLKNWGNNVWHGMVGIYKIQEDLDLHDSEILRAIEVHTVGAGQMTDLDKVIYVADYIEHNRAFPGVDVAREIASLSLNKAVAYETARTVEYLAHQGFPIYPQTLETYNAFVHYLKED

SEQ ID NO: 3094 - protein, 166 aa, Streptococcus pneumoniae
MKTAFIIIDVQNVLVETGFQTKSLLEKISYLQNQARSKNIEIIYVQHIENSEAQTSEDWQLSALLNRKPAEKVFQKKYNSIFKETGLKEYLDKQGIEKLVLCGMQTEYCVDTSVKVAFEYGYQLIVPEGAVTTFDGDDIPAETINEFYEDIWEERFADVLDYKHIF

SEQ ID NO: 3095 - protein, 117 aa, Streptococcus pneumoniae
MNEKELLELVVKAADEKRAEDILALDVQDLTSVTDYFVITSSMNSRQLDAIAANIREKVAQAGFKGSHVEGDAAGGWVLLDLGAVVVHIFSEEMRAHYNLEKLWHEANSVDISEALA

SEQ ID NO: 3096 - protein, 246 aa, Streptococcus pneumoniae
MATYETFAAVYDAVMDDSLYDKWTNFSLRHLPKTKERKKLLELACGTGIQSVRFSQAGFDVTGLDLSADMLKIAEKRATSAKQKIAFIEGNMLNLSKAGKYDFVTCYSDSICYMQDEVEVGDVFKDVYNALNEEGVFIFDVHSTYQTDEVFPGYSYHENAEDFAMLWDTYEDEAPHSIVHELTFFIKEADGSFSRHDEVHEERTYEILTYDILLEQAGFKSFKLYADFEDKEPTETSTRWFFVAQK

SEQ ID NO: 3097 - protein, 187 aa, Streptococcus pneumoniae
MAIMKRIELRDNTCYGHANLLLLRHKKPTGASFCWLLILKVCIEFEGLKSSLFQQDIIGQDLIGPLLMYFIVATKGTVSLLDKESQLMHDGVRSFVLICIPKHGKIFRIFMVGIAREYFICLVGRVHVKDENSLFIQRIVHVLKDVPYFHLILHIADRVRITRDKIVFPCLGQIQHITFYKSNLLLG

SEQ ID NO: 3098 - protein, 365 aa, Streptococcus pneumoniae
MTITGIIAEFNPFHNGHKYLLDQAEGLKIVAMSGNFMQRGEPAIVDKWTRTQMALENGADLVVELPFLVSVQAADFFGQGAMDILDRLGIDSLVFGTEEVRDYQKIADLYTEKGAEMEKFVENLPDSLSYPQKTQAMWKEFAGLDFSGNTPNHVLALAYAKAVAGRNIKLHPIQRQGAGYHSVNKDVDFASATALRQHQKDQDFLERFMPSVALFEQASKVIWEDYFPLLRYQILSNPDLTTIYQVNQEMAVRIKEAIKTAQSVEELVELVTTKRYTKARVRRLLTYILVQARENVLPEAIHVLGFTEKGRQHLKSLKGQVNLVSRIGKEPWDAMTQKVDQIYQLGKPSIAEQNFGRVPIRIETN

SEQ ID NO: 3099 - protein, 62 aa, Streptococcus pneumoniae
PVLFIIPQNNKHKADSKIKIKVHILIFFIDFLSSVLGSLSFSKNFIFNLLSKISTIKKPTFQ

SEQ ID NO: 3100 - protein, 915 aa, Streptococcus pneumoniae
MEENYNLSITQIKNSIKENSLVLFVGAGISANSNLPTWGELIQSLKKELNIPEERTDSPLRIAQYYYDTFGKNQYTKKIEEIFFKKGLSKPNELHKLIEKIAPKHIITTNYDSLLESQFESGLLKYNVVAEDKDIPYTSSERYLIKMHGDFSKKNIVLKEDDYLDYHLNFPMISTLIQSLIMNHTLLFVGYSLSDSTFNSIFRMIQNTFKLDAKNAYFYTPEEPSMIIREYYKKQGIFIISNEENLGQETSEKQNKLYCRTKDFLEVLSENRSQDVNNADDLWNQLAFLDRLSFIDAKDFSRYSDLKKRALNWDDEYCWFGNDQLRFEIDGHEELRIMVSKKSLLNRFLDMEIGEPRDLKGNRFLSKAFKLYEEKQYSLAKAKFRELANIAFRQKDYFNFLVCEFNFQQIQIIDRYEKTPSYAEPLYDGELSELTEQILNSVTGDEKKIIEFFRDSILNFNFLYRKLETINELFDEIREEHESYRRGGWSANNHLFNAEFTVKNLYNFLKLNCLCVEHYKIYKSIINRYLEILLLSYDNSYVNPDSSIFDRTSSWLKNLDLDDVKLILPNIDFKVVNLYFRNYSFGKIKITEEAKDYLLNRITYLQERLEITEDENLRELKNMLIFLPLVDDIDIEKVIEILNNQTLYYNWSEEFRRIIKIVLDNMDVIDKDSLKSKIIGIVNKHLNEILEKNFSLYNSVYPLYSQLLEYCSTDQETAIIVLEKFNTDILRIKYKNDDIKNIIEYSDLICHLFKYFEKDIKDDILDTLKVYEESENIIYHKVIDLMSYNVYDFPQIQNKIYHYLIKRINDKRVEGVKTFPDPREKSVSDLYNLSRKGYFSDFEILKDIEEDIRGLYPEVDWTWFHDRSDDVIHRLLEHRTPNNIKTYFSKNEEDNKLINEYILKAFDEDKLILKK

SEQ ID NO: 3101 - protein, 537 aa, Streptococcus pneumoniae
MEIMSLAIAVFAVIIGLVIGYVSISAKMKSSQEAAELMLLNAEQEATNLRGQAEREADLLVNEAKRESKSLKKEALLEAKEEARKYREEVDAEFKSERQELKQIESRLTERATSLDRKDDNLTSKEQTLEQKEQSISDRAKNLDAREEQLEEVERQKEAELERIGALSQAEARDIILAQTEENLTREIASRIREAEQEVKERSDKMAKDILVQAMQRIAGEYVAESTNSTVHLPDDTMKGRIIGREGRNIRTFESLTGVDVIIDDTPEVVTLSGFDPIRREIARMTMEMLLKDGRIHPARIEELVEKNRQEIDNKIREYGEAAAYEIGAPNLHPDLMKIMGRLQFRTSYGQNVLRHSIEVAKLAGIMASELGENAALARRAGFLHDIGKAIDHEVEGSHVEIGMELARKYKEPPVVVNTIASHHGDVEAESVIAVIVAAADALSAARPGARSESLESYIKRLHDLEEIANGFEGVQTSFALQAGREIRIMVNPGKIKDDKVTILAHKVRKKIENNLDYPGNIKVTVIRELRAVDYAK

SEQ ID NO: 3102 - protein, 208 aa, Streptococcus pneumoniae
MADRGLLIVFSGPSGVGKGTVRREIFESSENQFQYSVSMTTRAQRPGEVDGVDYFFRTREEFEELIRQGQMLEYAEYVGNYYGTPLTYVNETLDKGIDVFLEIEVQGALQVKKKVPDAVFIFLTPPDLDELQDRLVGRGTDSAEVIVQRIEKAKEEIALMREYDYAIVNDQVPLAAERVKCVIEAEHFCVDRVIGHYQEMLPKSPTTR

SEQ ID NO: 3103 - protein, 104 aa, Streptococcus pneumoniae
MMLKPSIDTLLDKVPSKYSLVILEAKRAHELEAGAPATQGFKSEKSTLRALEEIESGNVTIHPDPEGKREAVRRRIEEEKRRKEEEEKKIKEQIAKEKEDGEKI

SEQ ID NO: 3104 - protein, 798 aa, Streptococcus pneumoniae
MALAKIIVDVPLMQTDQPYSYRIPEEFEGMLEVGMRVHVPFGKGNRLIQGIVLGLKSQSDGEEMEQDLKDIAEVLDFSPVLTPEQLWLAEELRKSVFSYKISILKAMLPGFLNSSYDKILYPLEGLSQEERVRLFGSEDSLAFSSLDLAKQAEMMRLTRKGLLGLEYQAVDQKKVKTQSWYEVDHAQLEGVEISTRAKKKLELRDYLLSHPESASLASLLESYSREQVNFFVDQGAVTIVQKEVQRSAAYFEGIEASRPLELNPEQRQARDAVVSSIGSSQPPFLLQGITGSGKTEVYLQIIQGALDKGKTAILLVPEISLTPQMTERFIARFGDKVAILHSGLSNGEKYDEWRKVERGDAQVVVGARSAIFAPLKNLGVMIIDEEHEAAYKQDSNPRYHAREVAILRAQYNQATLVLGSATPSLESRARAGKGVYQHLRLTQRANPLATIPEVQVIDFRDYIGQNETSNFTPPLLEAIQDRLVKKEQVVLMLNRRGYSSFVMCRECGTVDTCPNCDISLTLHMDTKTMNCHYCGFSKDIPQVCPNCKSHSIRYYGTGTQKAYDELAELFPQARILRMDVDTTRKKGSHQALLDQFGRGEADILLGTQMIAKGLDFPNVTLVGVLNADTALNLPDFRSSERTFQLLTQVAGRSGRAEKAGQVLIQSYNPQHYAIRFAKDQDYEGFYAYEMGIRRQLGYPPYYFTIGITLSHKKEEEVFKRAYEVMNILRSGLSETSPILGPTPKPIARTHNLYHYQILIKYRLEDELGPTLNQVLALTQERENSELRLSIDHEPQQFL

SEQ ID NO: 3105 - protein, 311 aa, Streptococcus pneumoniae
MTKLIFMGTPDFSATVLKGLLTDDRYEILAVVTQPDRAVGRKKVIQETPVKQAAKEAGLSIYQPEKLSGSPEMEELMKLGADGIVTAAFGQFLPSKLLDSMDFAVNVHASLLPRHRGGAPIHYALIQGDEEAGVTIMEMVKEMDAGDMIFRRSIPITDEDNVGTLFEKLALVGRDLLLDTLPAYIAGDIKPEPQDTSQVTFSPNIKPEEEKLDWDKTNRQLFNQIGGMNPGPVAHTFLKGDRFKIYEALPVEDQGNPGEILSIGKKELIVATAEGALSLKQVQPAGKPKMDIASFLNGVGRTLTVGERFGD

SEQ ID NO: 3106 - protein, 175 aa, Streptococcus pneumoniae
LVTKVETARSLALAVLEDVFVNQAYSNIALNKHLKGSQLSAADKGLVTELVYGTVARKLTLEWYLSHFIEDRDQLDSWLYVLLLMSAYQLRYLDKIPDHAVVNEAVELAKLRKKGSEKLVNAVLRRILREGWPDIASIKRKNKRDSIAYSLPVWLVTKLKEEYGEERAKAIFESL

SEQ ID NO: 3107 - protein, 138 aa, Streptococcus pneumoniae
LKACSLRNKASIRVTDLSRKEEIQALLEANDSLLATTRLVKEQGHFAGHNLFADGAITIQDESSQLVAPTLDLQGDERVLDPVRLQVENSPYSLLSYDRSGYCSGLVRPQVGFNSRKCPTSGSCRSGSNSKIGCQKGA

SEQ ID NO: 3108 - protein, 232 aa, Streptococcus pneumoniae
QPLVWLRSKGILQGIICLRMEPLPSKTSPVSWLLRRLIYKVMSECLILCGSRWKTAHIASYLTTGQVTALDLYDHKLDLIQENAQRLGVADRVQTQKLDARKVHEFFDQDSFDKILVDAPCSGIGLLRRKPDIKYNKETADFASLQEIQLEILGSVCQILGKGGIITYSTCTIVSEENFQVVKAFLESHPEFEQVKLEHECKDIMKDGCILITPELYGSDGFFISQFRKISD

SEQ ID NO: 3109 - protein, 246 aa, Streptococcus pneumoniae
MEISLLTDVGQKRTNNQDYVNHYVNRAGRTMIILADGMGGHRAGNIASEMAVTDLGVAWVDTQIDTVNEVREWFAHYLEIENQKIHQLGQDEAYRGMGTTLEVLAIIDNQAIYAHIGDSRIGLIRGEEYHQLTSDHSLVNELLKAGQLTPEEAEAHPQKNIITQSIGQKDEIQPDFGTVILESGDYLLLNSDGLTNMISGSEIRDIVTSDIPLADKTETLVRFANNAGGLDNITVALVSMNEEDEE

SEQ ID NO: 3110 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 3111 - protein, 67 aa, Streptococcus pneumoniae
MEESKELNAVIDVIMLAGTILLKSGSEIHRVEDTMIRIAIRRGLWIAMSLPCLPLSFSLLKIPIFRA

SEQ ID NO: 3112 - protein, 73 aa, Streptococcus pneumoniae
KWLRNPSCRRYHDSNRDSQGIVDCNVLAMPAAIFFSIENTNISRMKRVTSSSYNIEKSLRCEPDFSSASWGAD

SEQ ID NO: 3113 - protein, 169 aa, Streptococcus pneumoniae
VNQISRQLVGGQIDLETAFKQLTALQAQPLPYTKLQVTLAATFSAPFFSVMFSGNIYDALGAGVATLFGFAFSLYVEKFIRIPFVTAFAGAFVFGIIAQFWARYTGFPSTADLIIAGAVMPFVPGIALTNAVRDIMTNHINSGMSKMFESLLITLALGAGTSVALVLMN

SEQ ID NO: 3114 - protein, 111 aa, Streptococcus pneumoniae
MTVWLIYLLLKEPTNVIVATFIAAIIGSCVSQILSILYKTPAVVFILAILAPLVPGYLSYRTTAFFVTGDYNKALASGLLVVMLALVISIGMASGSVILRLYHYIKTHRVS

SEQ ID NO: 3115 - protein, 66 aa, Streptococcus pneumoniae
VREYRTYEEIAADFGIHESNLLRRSQWVEVTLVQSGVTISKTHLSAENTVIVDATEVKINRPKKIN

SEQ ID NO: 3116 - protein, 129 aa, Streptococcus pneumoniae
MEPQAIVTSQERIVSLNIAVNYCHDMKLFKMSRRNIGQAGKILADSGYQGPMKIYPQAQTPRKSSNLKPLIAEDKAYNHALSKERSKVENIFAKVKTFKMFSTTYRNHRKRFGLRMNLIVGIINHELGF

SEQ ID NO: 3117 - protein, 95 aa, Streptococcus pneumoniae
LSVSLLTLLFIPVMVSSSGSEFQSGWQEHQLIAEKVSKTLDKTFDKDVREIPTSQFYQKFVDEMGRTYSGNLILQELITVNGAYKATYIGELSSN

SEQ ID NO: 3118 - protein, 390 aa, Streptococcus pneumoniae
MTIGIDKIGFATSQYVLKLQDLAEARGIDPEKLSKGLLLKELSIAPLTEDIVTLAASASDSILTEQERQEVDMVIVATESGIDQSKAAAVFVHGLLGIQPFARSFEIKEACYGATAALHYAKLHVENSPESKVLVIASDIAKYGIETPGEPTQGAGSVAMLITQNPRMMAFNNDNVAQTRDIMDFWRPNYSTTPHVNGVYSTQQYLDSLKTTWLEYQKRYQLTLDDFAAVCFHLPYPKLALKGLKKIMDKSLPQEKKDLLQKHFDQSILYSQKVGNIYTGSLFLGLLSLLENTDSLKAGDKIALYSYGSGAVAEFFSGELVEGYEAYLDKDRLNKLNQRTALSVADYEKVFFEEVNLDETNSAQFAGYENQDFALVEILDHQRRYSKVEK

SEQ ID NO: 3119 - protein, 424 aa, Streptococcus pneumoniae
MKISWNGFSKKSYQERLELLKAQALLSPERQASLEKDEQMSVTVADQLSENVVGTFSLPYSLVPEVLVNGQEYTVPYVTEEPSVVAAASYASKIIKRAGGFTAQVHQRQMIGQVALYQIANPKLAQEKIASKKAELLELANQAYPSIVKRGGGARDLHVEQIKGEPDFLVVYIHVDTQEAMGANMLNTMLEALKPVLEELSQGQSLMGILSNYATDSLVTASCRIAFRYLSRQKDQGREIAEKIALASQFAQADPYRAATHNKGIFNGIDAILIATGNDWRAIEAGAHAFASRDGRYQGLSCWTLDLEREELVGEMTLPMPVATKGGSIGLNPRVALSHDLLGNPSARELAQIIVSIGLAQNFAALKALVSTGIQQGHMKLQAKSLALLAGASESEVAPLVERLISDKTFNLETAQRYLENLRS

SEQ ID NO: 3120 - protein, 321 aa, Streptococcus pneumoniae
MVAKLTDVAKLAGVSPTTVSRVINKKGYLSEKTIQKVNEAMRELGYKPNNLARSLQGKSAKLIGLIFPNISNVFYAELIDKLEHQLFKNGYKTIICNSEHDSEKEREYIEMLEANQVDGIISGSHNLGIEDYNRVTAPIISFDRNLSPDIPVVSSDNYAGGVLAAQTLVKTGAQSIIMITGNDNSNSPTGLRHAGFASVLPKAPIINVSSDFSPVRKEMEIKNILTREKPDAIFASDDLTAILVIKIAQELGISVPKELKVIGYDGTYFIENYYPQLATIKQPLEEIACLTIDLLLQKIEGKEVATTGYFLPVTLLPGKSI

SEQ ID NO: 3121 - protein, 484 aa, Streptococcus pneumoniae
MEWTTERRYRLYQDWTQEEIQHIKENMAQSPWHTHYHVEPKTGLLNDPNGFSYFDGKWILFYQNFPFGAAHGLKSWAQLESDDLVHFRETGVKVLPDTPLDSHGAYSGSAMQFGDNLFLFYTGNVRDENWIRHPYQIGALMDKEGKITKIDKILIDQPADSTDHFRDPQIFNFQGQYYAIVGGQDLEKKGFVRLYKAVNNDYTNWQAVGDLDFANDRTAYMMECPNLVFVEEQPVLLYCPQGLDKKVLDYDNIFPNMYKIGASFDPKNAKMVDVSQLQNMDYGFEAYATQAFNAPDGRALAVSWLGLPDVSYPSDRFDHQGTFSLVKELTIKDDKLYQYPVAAIKDLRASEEAFSNRFQTKNTYELELNLEANSQSEIVLLADKEGKGLSINFDLVNGQVTVDRSQAGEQYAQEFGTTRSCPIENQATTATIFIDNSVFEIFINKGEKVFSGRVFPHADQNGILIKSGNPTGTYYELDYGRKTN

SEQ ID NO: 3122 - protein, 76 aa, Streptococcus pneumoniae
LAQHGNEYAMEIVPYFPLYVEFLLASNLDKVCNDAQLSIPFIPPKILSLLIVTVFDKKCKPFILKKRKNCQTIIMK

SEQ ID NO: 3123 - protein, 65 aa, Streptococcus pneumoniae
MQAFYIKKEKKLSNDYHEINTGNQSNFYENVKDNEIKYFLTKVSNLFFKEFLMKQSKTINLKLAH

SEQ ID NO: 3124 - protein, 627 aa, Streptococcus pneumoniae
MNNQEIAKKVIDALGGRENVNSVAHCATRLRVMVKDEEKINKEVIENLEKVQGAFFNSGQYQIIFGTGTVNKMYDEVVVLGLPTSSKDDMKAEVAKQGNWFQRAIRTFGDVFVPIIPVIVATGLFMGVRGLFNALEMPLPGDFATYTQILTDTAFIILPGLVVWSTFRVFGGNPAVGIVLGMMLVSGSLPNAWAVAQGGEVTAMNFFGFIPVVGLQGSVLPAFIIGVVGAKFEKAVRKVVPDVIDLLVTPFVTLLVMSILGLFVIGPVFHVVENYILIATKAILSIPFGLGGFLIGGVHQLIVVSGVHHIFNLLEVQLLAADHANPFNAIITAAMTAQGAATVAVGVKTKNPKLKTLAFPAALSAFLGITEPAIFGVNLRFRKPFFLSLIAGAIGGGLASILGLAGTGNGITIIPGTMLYVGNGQLPQYLLMVAVSFALGFALTYMFGYEDEVDATAAAKQAEVAEEKEEVAPAALQNETLVTPIVGDVVALADVNDPVFSSGAMGQGIAVKPSQGVVYAPADAEVSIAFPTGHAFGLKTRNGAEVLIHVGIDTVSMNGDGFEAKVAQGNKVKAGDVLGTFDSNKIAAAGLDDTTMVIVTNTADYASVAPVATGSVAKGDAVIEVKI

SEQ ID NO: 3125 - protein, 295 aa, Streptococcus pneumoniae
MTKLYGSLEAGGTKFVCAVGDENFNVVEKTQFPTTTPIETIDKTIEFFSKFDNLSGLAVGSFGPIDIDKNSKTYGFITTTPKPNWANVDLLGAFRRALNVPMYFTTDVNSSAYGEMVARNNAGGRIENLVYYTIGTGIGAGVIQRGEFIGGVGHPEMGHYYVARHPMDIEKEFKGVCPFHKGCLEGYAAGPSLEARTGVRGENIELNNPVWDVQAYYIAQAAVNATVTFRPDVIVFGGGVMAQQHMLDRVREKFTSLLNGYLPVPDVRDYIVTPAVAGNGSATLGNFVLAKEVSK

SEQ ID NO: 3126 - protein, 70 aa, Streptococcus pneumoniae
VSKHLPEKVNNIGQTVGINHEGKGFGQNDDGHVALETHLGQGSQHTEKVSWANGPNHHKNKEAVKTIALI

SEQ ID NO: 3127 - protein, 199 aa, Streptococcus pneumoniae
MKAVSPLLQRVINISSIVGGVGSLIFCIWAYQAGILQSKETLSAFIQQAGIWGPPLFIFLQILQTVVPIIPGALTSVAGVFIYGHIIGTIYNYIGIVIGCAIIFYLVRLYGAAFVQSVVSKRTYDKYIGWLDKGNRFDRFFIFMMIWPISPADFLCMLAALTKMSFKRYMTIIILTKPFTLVVYTYGLTYIIDFFWQML

SEQ ID NO: 3128 - protein, 74 aa, Streptococcus pneumoniae
FQSIISIMHTTIGSNKNHNKFIHRWLPQGTKKTTTKEVAFIEKWINNYPKKCLNYKSPREDFWMTNLNLKFSNN

SEQ ID NO: 3129 - protein, 83 aa, Streptococcus pneumoniae
LSIFRRLLLCKIWPGALLYSMKIKEQTRKLAVDCSKYSFEVADKTDEVSSKHCFEVVDRTDEVSNYIYGKAKLTWFEEIFEEY

SEQ ID NO: 3130 - protein, 75 aa, Streptococcus pneumoniae
LLTSSVLSTTSKQCFELTSSVLSATSKLYFEQSTASFLVCSLIFIEYKSAPGHILHSNSLLKMDKKHCKGYQKGV

SEQ ID NO: 3131 - protein, 297 aa, Streptococcus pneumoniae
MLEVRSLEKSFGSKQVLFGIDFQARPGRILGLVGKNGAGKTTIFHSILKFLEYQGEIGLDGQDIRQETYARIGYLPEERSLMPKLTVLEQVRYLATLKGMDAKEVKEKLPQWMKRLEVKGKLTDKIKSLSKGNQQKIQLIITLIHEPDLIILDEPFSGLDPVNTELLKQVIFQEKERGATIIFSDHVMTNVEELCDDILMIRDGRVVLHGPVQDVRNQYGKTRLFVSSERSKEELENLPHVKQVSLTKQGSWKLILEDESAGRELFPILTQGQYIATFDQQAPTIDEIFKLESGVEV

SEQ ID NO: 3132 - protein, 399 aa, Streptococcus pneumoniae
MRNMWVVIKETYLRHVKSWSFFFMVISPFLFLGISVGIGHIQGSSMAKNNKVAVVTTVPSVAEGLKNVNGVNFDYKDEASAKEAIKEEKLKGYLTIDQEDSVLKAVYHGETSLENGIKFEVTGTLNELQNQLNRSTASLSQEQEKRLAQTIQFTEKIDEAKENKKFIQTIAAGALGFFLYMILITYAGVTAQEVASEKGTKIMEVVFSSIRASHYFYARMMALFLVILTHIGIYVVGGLAAVLLFKDLPFLAQSGILVHLGDAISLNTLLFILISLFMYVVLAAFLGSMASRPEDSGKALSPLMILIMGGFFGVTALGAAGDNLLLKIGSYIPFISTFFMPFRTINDYAGGAEAWISLAITVIFAVVATGFIGRMYASLVLQTDDLGIWKTFKRALSYK

SEQ ID NO: 3133 - protein, 55 aa, Streptococcus pneumoniae
LFYEYVTYLGKNYLKQINLISQDVVGSEIKDSYEYEFFNNGYTCSHIEMVIESYQ

SEQ ID NO: 3134 - protein, 282 aa, Streptococcus pneumoniae
MIFATSQVNPLTNSSVRNLRPKQRRLFMFWNLVHYEFKNVNKWYLALYAAVLVLSALIGIQTQGFKNLPYQESQATMLLFLATVFGGLMLTLAISTIFLIIKRFKGSVYDRQGYLTLTLPVSEHHIITAKLIGAFIWSLISTAVLALSAVIILALTAPEWIPLSYVITFVETHLPQIFLTGISFLLNTISGILCIYLAISIGQLFNEYRTALAVAAYIGIQIVIGFIELFFNLSSNFYVNSLVGLNDHFYMGAGIAIVKELIFIAIFYLGTYYILRNKVNLL

SEQ ID NO: 3135 - protein, 240 aa, Streptococcus pneumoniae
VIILKEFKPMSLLAFENVSKSYGATPALENVSLDIPAGKIVGLLGPNGSGKTTLIKLINGLLQPDQGRVLINDMDPSPATKAVVAYLPDTTYLNEQMKVKEALTYFKTFYKDFNLERAHHLLADLGIDENSRLKKLSKGNKEKVQLILVMSRDARLYVLDEPIGGVDPAARAYILNTIINNYSPTSTVLISTHLISDIEPILDEIVFLKDGKVVRQGNVDDIRYESGESIDQLFRQEFKA

SEQ ID NO: 3136 - protein, 69 aa, Streptococcus pneumoniae
SGCKRPLISLIRVVFPEPFGPRRPTIFPAGMSRETFSRAGVAPYDLDTFSNASNDIGLNSFNIITDYAW

SEQ ID NO: 3137 - protein, 121 aa, Streptococcus pneumoniae
MSWTFDNKKPIYLQIMEKIKLQIVSHTLEPNQQLPTVRELASEAGVNPNTIQRALSDLEREGFVYSKRTTGRFVTKDKELIAQSRKQLSEEELEHFVSSMTHFGYEKEELPGVVSDYIKGV

SEQ ID NO: 3138 - protein, 157 aa, Streptococcus pneumoniae
MRCPKCGATKSSVIDSRQAEEGNTIRRRRECDECQHRFTTYERVEERTLVVVKKDGTREQFSRDKIFNGIIRSAQKRPVSSDEINMVVNRIEQKLRGRNENEIQSEDIGSLVMEELAELDEITYVRFASVYRSFKDVSELESLLQQITQSSKKKKER

SEQ ID NO: 3139 - protein, 389 aa, Streptococcus pneumoniae
MKPIDRFSYLKNNRVSQDTSSLVQCYLPIIGQEALSLYLYTISFWDNGRKEYLFSSILNHLNFGMDRLIKSLKILSAFNLLTLYQKGDVYQLALHAPLSSQDFLGHPVYRRLLEKKIGDVAVEDLKVESADGEEIPVSLNQVFPELAELGSQEYLGLKKKVANDFDLDHFRQLMARDGLRFADEQSDVLNLFAIAEEKKWTWFETYQLAKSTAVSQVISTKRMREKIAQKPVSSDFSLKEAIIIKEAKSKTALQFLAEIKQTRKGTITQTERELLQQMAGLGLLDEVINIILLLTFNKVDSANINEKYAMKVANDYAYQKIHSAEEAVLRIRERGQKAKTQKQNQTAPAKTNIPKWSNPEYKNTSSAEELEEMERQTLELLAKLDNGGD

SEQ ID NO: 3140 - protein, 298 aa, Streptococcus pneumoniae
MESVGDVLKRQPSRFHYQDLVQKIMKDPDVAAFVQQESLNQDELNRSISKFNQYITERDKFLRGDTDYIAKGYKPILVMNHGYADVSYEETPELIAAEKEAAIKKRLNLINFPSSLKNVSFLDVYRDDVQRLTVLKRMIEFVNDYPNNLKGLYLYGDFGVGKSFMVAALAHDLSEKRGVSSTLLHYPSFVIDVKNAISDGNVKTLVDEIKLSEVLILDDIGAEQSTTWVRDEILQVILQYRMQENLPTFFTSNFNFEDLEKHFAKGKNGNDETWEARRVMERIRYLAEETRLEGVNRR

SEQ ID NO: 3141 - protein, 237 aa, Streptococcus pneumoniae
MTETIKLMKAHTSVRRFKEQVLPQEDLTEILTAAQMASSWKNFQSYSVIVVRSQEKKDALYELVPQEAIRQSAVFLLFVGDLNRAEKGARLHTDTFQPQGVEGLLISSVDAALAGQNALLAAESLGYGGVIIGLVRYKSEEVAELFNLPDYTYSVFGMALGVPNQTHDVKPRLPLDNVVFEEEYQEQSTEAIQAYDRVQADYAGARATTSWSQRLAEQFGQAEPSSTRKNLKQKKLL

SEQ ID NO: 3142 - protein, 436 aa, Streptococcus pneumoniae
MALPTIAIVGRPNVGKSTLFNRIAGERISIVEDVEGVTRDRIYATGEWLNRSFSMIDTGGIDDVDAPFMEQIKHQAEIAMEEADVIVFVVSGKEGITDADEYVARKLYKTHKPVILAVNKVDNPEMRNDIYDFYALGLGEPLPISSVHGIGTGDVLDAIVENLPNEYEEENPDVIKFSLIGRPNVGKSSLINAILGEDRVIASPVAGTTRDAIDTHFTDTDGQEFTMIDTAGMRKSGKVYENTEKYSVMRAMRAIDRSDVVLMVINAEEGIREYDKRIAGFAHEAGKGMIIVVNKWDTLEKDNHTMKNWEEDIREQFQYLPYAPIIFVSALTKQRLHKLPGMIKQISESQNTRIPSAVLNDVIMDAIAINPTPTDKGKRLKIFYATQVATKPPTFVIFVNEEELMHFSYLRFLENQIRKAFVFEGTPIHLIARKRK

SEQ ID NO: 3143 - protein, 114 aa, Streptococcus pneumoniae
MSVMEHLFKFLLLAPYFYFDNWIEKANRNSKFFPIFYYFYWIYIPFYSLFSLAWTVVSVLFFNTVLRNVTDIKLWGIWFLFILLAIGMNWLTYSCFKEMFRLRQELGKSKGGRH

SEQ ID NO: 3144 - protein, 117 aa, Streptococcus pneumoniae
VMEHLFKMIILLPCFYFFSWIDKDNRESKFFPIFYYFYWIYITLYALFSLAWTVFSVLFFNIVLRNLTDIKLWGIWLLLLLIAFASDWLDYICFKKMLDLRRELGKSKGVHKGRCRN

SEQ ID NO: 3145 - protein, 63 aa, Streptococcus pneumoniae
LIRSHSITIYYNKMMRVITNYRFEKSLISFSSILTNASSLVSRNKVIPLSIKSELCCSIPKRT

SEQ ID NO: 3146 - protein, 283 aa, Streptococcus pneumoniae
MRWDYGQIFKEIRKSKGLTQQDVCGQVIHRTTLTNIEHGKVIPSFENMVFLLEQIDMSLAEFKYICNEYHPSKRRDIIVESQNPSTFQDTRKMVELTEKCQKYLKTHHDVPIQNIYRHTKIVTELRTKGFKNNHVLKDLSEEIWDYLEPMDTWYISDLKLLGTILFFFPSENLPLLIDRIMKTIEKYKYFRETKVFLSSFLANLSTVYFQHHLFKECETITLQLLVLAEELKIYDILGFSQVRLGILQHNSDLIDKGITLLRLTKEEALVKILEKEINDFSNL

SEQ ID NO: 3147 - protein, 130 aa, Streptococcus pneumoniae
MKTKKLLKMVIPVLMISAVGTTFVEANQIGAFSNFVITTSYKRTGYLTKENEGAEYIMNLNPCRNLHPMTVKHRIVNSNGEARSGESLTTCGTRSTHGNWATVGYVYAADMARQNWWDLSAAISGSWSPN

SEQ ID NO: 3148 - protein, 263 aa, Streptococcus pneumoniae
MKIPLLTFARHKFVYVLLTLLFLALVYRDVLMTYFFFDIHAPDLAKFDGQAIKNDLLKSALDFRILQFNLGFYQSFIIPIIIVLLGFQYIELKNKVLRLSIGREVSYQGLKRKLTLQVASIPCLIYLVTVLIIAIITYFLGTFSPLGWNSLFSDGSGLQRLLDGEIKSYLFFTCVLLIGIFINAIYFLQIVDYVGNVTRSAITYLMFLWLGSMLLYSALPYYMVPMTSLMQASYGDVSLMKLFTPYILYIVPYMVLEKYEDNV

SEQ ID NO: 3149 - protein, 225 aa, Streptococcus pneumoniae
LSLIWCLKNMKIMFKNFNNILLKRKIVLLLRIVLMMILINYLLSTAVQKQDAVIFFKRELISIFSYNDYSEANLEIPKLLLNLSLFMVGWLSVILLESDLADHYHHLIRYQSSSFFDYTRKRLVVISKFFTQDLLVWFLGLLPLGIHFKTVALFFLLAQLMMLYLLLSYLIALISAGAGFSFFLYFLAFVGQEWMMDHIVTVYLLLLSLLVMLIVSRLEEKFKKG

SEQ ID NO: 3150 - protein, 210 aa, Streptococcus pneumoniae
MKLEIINGQKIYGKRPILNQLNLVFQSGKIYGLKGDNGSGKTVLLKVLAGYIKLDKGKVLQDGKVYGIKNHYIQDAGILIEKVEFLSHLSLRENLELLRYFSSKVTEKRIAYWIQYYDLQEFEDVEYRHLSLGTKQKMALIQAFISSPSILFLDEPMNALDEKSVRLTKQVILSYLKKENGLVILTSHISEDISDLCTDVLVVENGHIQM

SEQ ID NO: 3151 - protein, 95 aa, Streptococcus pneumoniae
MAHLKSFITRYSKVYIGLVLLIWLSFFFIPWDKPLLGIRIDIFIIQKILLAFGILSILMALLSKKVSLFVFELICCLSLWINLFITFAILPIFGN

SEQ ID NO: 3152 - protein, 837 aa, Streptococcus pneumoniae
MANILKTIIENDKGEIRRLEKMADKVFKYEDQMAALTDDQLKAKTVEFKERYQNGESLDSLLYEAFAVVREGAKRVLGLFPYKVQVMGGIVLHHGDVPEMRTGEGKTLTATMPVYLNALSGKGVHVVTVNEYLSERDATEMGELYSWLGLSVGINLATKSPMEKKEAYECDITYSTNSEIGFDYLRDNMVVRAENMVQRPLNYALVDEVDSILIDEARTPLIVSGANAVETSQLYHMADHYVKSLNKDDYIIDVQSKTIGLSDSGIDRAESYFKLENLYDIENVALTHFIDNALRANYIMLLDIDYVVSEEQEILIVDQFTGRTMEGRRYSDGLHQAIEAKEGVPIQDETKTSASITYQNLFRMYKKLSGMTGTGKTEEEEFREIYNIRVIPIPTNRPVQRIDHSDLLYASIESKFKAVVEDVKARYQKGQPVLVGTVAVETSDYISKKLVAAGVPHEVLNAKNHYREAQIIMNAGQRGAVTIATNMAGRGTDIKLGEGVRELGGLCVIGTERHESRRIDNQLRGRSGRQGDPGESQFYLSLEDDLMKRFGSERLKGIFERLNMSEEAIESRMLTRQVEAAQKRVEGNNYDTRKQVLQYDDVMREQREIIYTQRYDVITADRDLAPEIQAMIKRTIGRVVDGHARAKQDEKLEAILNFAKYNLLPEDSITMEDLSGLSDKAIKEELFQRALKVYDSQVSKLRDEEAVKEFQKVLILRVVDNKWTDHIDALDQLRNAVGLRGYAQNNPVVEYQAEGFRMFNDMIGSIEFDVTRLMMKAQIHEQERPQAERHISTTATRNIAAHQASMPEDLDLSQIGRNELCPCGSGKKFKNCHGKRQ

SEQ ID NO: 3153 - protein, 343 aa, Streptococcus pneumoniae
MVFTAKSSKINIEEVRALSKLEGQALERKSQRDQELEAIIRGEDQRILLVIGPCSSDNEEAVLEYAKRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 3154 - protein, 214 aa, Streptococcus pneumoniae
MAFIEKGQEIDMEVIKAETQLSAEALRLKESRDRELADIISGEDDRILLVIGPCSSDNEEAVLEYARRLSALQKKVADKIFMVMRVYTAKPRTNGDGYKGLVHQPDTSKAPSLINGLQAVRQLHYRVITETGLTTADEMLYPSNLILVDDLVSYHAVGARSVEDQEHRFVASGIDAPVGMKNPTSGNLGVMFNAIYAAQNKQTSFIMGRKLEHQ

SEQ ID NO: 3155 - protein, 110 aa, Streptococcus pneumoniae
  UNSURE (52): Xaa at each above location is unknown.
VLCLTPSMLLKTSKLPLSWAGSWNISNSVAHVIFRGAFNEYANYIPNYYYEXLLQAIERYETMGLEILLSSLTRTMMTQASNIWSRFELFARPCRIVIGMRKLKRRFEDL

SEQ ID NO: 3156 - protein, 88 aa, Streptococcus pneumoniae
NPFILINTNHDDSGKQYMEQIRIVRQTLQNRDWNEKIKKTVRGFMIESYLADGRQNQPEVFGCSITDPCLGWENTEALVEEIYVTLTK

SEQ ID NO: 3157 - protein, 120 aa, Streptococcus pneumoniae
MIVGHGIDIEELASIESAVTRHEGFAKRVLTAQEMERFTSLKGRRQIEYLAGRWSAKEAFSKAMGTGISKLGFQDLEVLNNERGAPYFSQAPFSGKIWLSISHTDQFVTASVILEENHES

SEQ ID NO: 3158 - protein, 367 aa, Streptococcus pneumoniae
MKASPHRPTKVLIHLGAIRQNIQQMGAHIPQGTLKWAVVKANAYGHGAVAVAKAIQDDVDGFCVSNIDEAIELRQAGLSKPILILGVSEIEAVALAKEYDFTLTVAGLEWIQALLDKEVDLTGLTVHLKIDSGMGRIGFREASEVEQAQDLLQQHGVRVEGIFTHFATADEESDDYFNAQLERFKTILASMKEVPELVHASNSATTLWHVETIFNAVRMGDAMYGLNPSGAVLDLPYDLIPALTLESALVHVKTVPAGACMGYGATYQADSEQVIATVPIGYADGWTRDMQNFSVLVDGQACPIVGRVSMDQITIRLPKLYPLGTKVTLIGSNGDKEITATQVATYRVTINYEVVCLLSDRIPREYY

SEQ ID NO: 3159 - protein, 671 aa, Streptococcus pneumoniae
MNLHQPLHVLPGVGPKSAEKYAKLGIENLQDLLLYFPFRYEDFKTKQVLELEDGEKAVLSGQVVTPASVQYYGFKRNRLRFSLKQGEVVFAVNFFNQPYLADKIELGATLAVFGKWDRAKASLNGMKVLAQVEDDLQPVYRLAQGISQASLVKVIKTAFDQGLDLLIEENLPQSLLDKYKLMSRCQAVRAMHFPKDLAEYKQALRRIKFEELFYFQMQLQMLKSENRVQGSGLVLNWSQEKVTAVKVSLPFALTQAQEKSLQEILTDMKSDHHMNRLLQGDVGSGKTVVAGLAMFAAVTAGYQAALMVPTEILAEQHFESLQNLFPNLKLALLTGSLKAAEKREVLETIAKGEADLIIGTHALIQDGVEYARLGLIIIDEQHRFGVGQRRILREKGDNPDVLMMTATPIPRTLAITAFGDMDVSIIDQMPAGRKPIVTRWIKHEQLPQVLTWLEGEIQKGSQAYVISPLIEESEALDLKNAIALSEELTTHFAGKAEVALLHGRMKSDEKDQIMQDFKERKTDILVSTTVIEVGVNVPNATVMIIMDADRFGLSQLHQLRGRVGRGDKQSYAVLVANPKTDSGKDRMRIMTETTNGFVLAEEDLKMRGSGEIFGTRQSGLPEFQVADIIEDFPILEEARKVASYISSIETWQEDPEWRMIALHLEKKEHLD

SEQ ID NO: 3160 - protein, 88 aa, Streptococcus pneumoniae
LILFENLFKPRQRRLTVYMLLTSSVLSATSKRCFELTSSVSSTTSKPCFELTSSVSSTTSKQCFEQPAVSFLVCSLIFIEYKFSLEKA

SEQ ID NO: 3161 - protein, 67 aa, Streptococcus pneumoniae
MKIKEQTRKLTAGCSKHCFEVVDETDEVSSKHGFEVVDETDEVSSKHRFEVADRTDEVSNIYTVRRR

SEQ ID NO: 3162 - protein, 326 aa, Streptococcus pneumoniae
MKNPALLEEIKTYRGRDEVPEDFDAFWDGEVKNVSTLPSYHLEERDFHIPQVKCYELTFEGSKEGKVYARIVLPKSEEKVPLIFHFHGYMGRGWDWADMLGFTVAGYGVVSMDVRGQSGYSQDGLRSPLGNTVKGHIIRGAMEGRDHLFYKDVYLDIYQLVEIVASLSQVDEKRLSSYGASQGGALALVAAALNPRIQKTVAIYPFLSDFRRVIEIGNTSEAYDELFRYFKFHDPFHETEEEIMATLAYIDVKNLAHRIQGEVKMITGLDDDVCYPITQFAIYNRLTCDKTYRIMPEYAHEAMNVFVNDQVYNWLCGSEIPFKYLK

SEQ ID NO: 3163 - protein, 205 aa, Streptococcus pneumoniae
VLILFKNLFKPRQLRLAVYMLLTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFEHHATSFLVCSLIFIEYKNR

SEQ ID NO: 3164 - protein, 167 aa, Streptococcus pneumoniae
VADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSNIYTARRS

SEQ ID NO: 3165 - protein, 75 aa, Streptococcus pneumoniae
MIFKAFKTKKQRKRQVELLLTVFFDSFLIDLFLHLFGIVPFKLDKILIVSLIIFPIISTSIYAYEKLFEKVFDKD

SEQ ID NO: 3166 - protein, 937 aa, Streptococcus pneumoniae
MIVGAVVFGTSPVLAQEGASEQPLANETQLSGESSTLTDTEKSQPSSETELSGNKQEQERKDKQEEKIPRDYYARDLENVETVIEKEDVETNASNGQRVDLSSELDKLKKLENATVHMEFKPDAKAPAFYNLFSVSSATKKDEYFTMAVYNNTATLEGRGSDGKQFYGNYNDAPLKVKPGQWNSVTFTVEKPTPELPKGRVRLYVNGVLSRTSLKSGNFIKDMPDVTHVQIGATKRANNTVWGSNLQIRNLTVYNRALTPEEVQKRSQLFKRSDLEKKLPEGAVLTEKTDIFESGRNGKPNKDGIKSYRIPALLKTDKGTLIAGADERRLHSSDWGDIGMVIRRSEDNGKTWGDRVTITNLRDNPKASDPSIGSPVNIDMVLVQDPETKRIFSIYDMFPEGKGIFGMSSQKEEAYKKIDGKTYQILYREGEKGAYTIRENGTVYTPDGKATDYRVVVDPVKPAYSDKGDLYKGDQLLGNIYFTTNKTSPFRIAKDSYLWMSYSDDDGKTWSAPQDITPMVKADWMKFLGVGPGTGIVLRNGPHKGRILIPVYTTNNVSHLDGSQSSRVIYSDDHGKTWHAGEAVNDNRQVDGQKIHSSTMNNKRAQNTESTVVQLNNGDVKLFMRGLTGDLQVATSKDGGVTWEKDIKRYPQVKDVYVQMSAIHTMHEGKEYIILSNAGGPKRENGMVHLARVEENGELTWLKHNPIQKGEFAYNSLQELGNGEYGILYEHTEKGQNAYTLSFRKFNWEFLSKNLISPTEAKVKRTREMGKGVIGLEFDSEVLVNKAPTLQLANGKTATFLTQYDSKTLLFAVDKEDIGQEIIGIAKGSIESMHNLPVNLAGARVPGGVNGSKAAVHEVPEFTGGVNGTEPAVHEIAEYKGSDSLVTLTTKEDYTYKAPLAQQALPETGNKESDLLASLGLTAFFLGLFTLGKKREQ

SEQ ID NO: 3167 - protein, 71 aa, Streptococcus pneumoniae
FDFPDRVVHILFQSTIFYRTDYSESSFRPLMISYQLECHQKKIAGLKTCYLLLFLQNQMFRILLLLFSLFP

SEQ ID NO: 3168 - protein, 150 aa, Streptococcus pneumoniae
MIITKISRLGTYVGVNPHFATLIDFLEKTGLENLTEGSIAIDGNRLFGNCFTYLADGQAGAFFETHQKYLDIHLVLENEEAMAVTSPENVSVTQEYDEEKDIELYTGKVEQLVHLRAGECLITFPEDLHQPKVRINDEPVKKVVFKVAIS

SEQ ID NO: 3169 - protein, 445 aa, Streptococcus pneumoniae
MKKMRKFLCLAGIALAAVALVACSGKKEATTSTEPPTELSGEITMWHSFTQGPRLESIQKSADAFMQKHPKTKIKIETFSWNDFYTKWTTGLANGNVPDISTALPNQVMEMVNSDALVPLNDSIKRIGQDKFNETALNEAKIGDDYYSVPLYSHAQVMWVRTDLLKEHNIEVPKTWDQLYEASKKLKEAGVYGLSVPFGTNDLMATRFLNFYVRSGGGSLLTKDLKADLTSQLAQDGIKYWVKLYKEISPQDSLNFNVLQQATLFYQGKTAFDFNSGFHIGGINANSPQLIDSIDAYPIPKIKESDKDQGIETSNIPMVVWKNSKHPEVAKAFLEALYNEEDYVKFLDSTPVGMLPTIKGISDSAAYKENETRKKFKHAEEVITEAVKKGTAIGYENGPSVQAGMLTNQHIIEQMFQDIITNGTDPMKAAKEAEKQLNDLFEAVQ

SEQ ID NO: 3170 - protein, 294 aa, Streptococcus pneumoniae
MVKERNLTRWIFVLPAMIIVGLLFVYPFFSSIFYSFTNKHLIMPNYKFVGLANYKAVLSDPNFFNAFFNSIKWTVFSLVGQVLVGFVLALALHRVRHFKKLYRTLLIVPWAFPTIVIAFSWQWILNGVYGYLPNLIVKLGLMEHTPAFLTDSTWAFLCLVFINIWFGAPMIMVNVLSALQTVPEEQFEAAKIDGASSWQVFKFIVFPHIKVVVGLLVVLRTVWIFNNFDIIYLITGGGPANATTTLPIFAYNLGWGTKLLGRASAVTVLLFIFLVAICFIYFAIISKWEKEGRK

SEQ ID NO: 3171 - protein, 277 aa, Streptococcus pneumoniae
MKKKSSIYLDILSHVLLVGATIVAIFPLVWIIISSVKGKGELTQYPTRFWPEQFTLDYFTHVINDLHFIDNIRNSLIIALATTLIAIIISAMAAYGIVRFFPKLGAIMSRLLVITYIFPPILLAIPYSIAIAKVGLTNSLFGLMMVYLSFSVPYAVWLLVGFFQTVPIGIEEAARIDGANKFVTFYKVVLPIVAPGIVATAIYTFINAWNEFLYALILINNTGKMTVAVALRSLNGSEILDWGDMMAASVIVVLPSIIFFSIIQNKIASGLSEGSVK

SEQ ID NO: 3172 - protein, 253 aa, Streptococcus pneumoniae
MNKRGLYSKLGISVVGISLLMGVPTLIHANELNYGQLSISPIFQGGSYQLNNKSIDISPLLLDKLSGESQTVVMKFKADKPNSLQALFGLSNSKAGFKNNYFSIFMRDSGEIGVEIRDAQKGINYLFSRPASLWGKHKGQAVENTLVFVSDSKDKTYTMYVNGIEVFSETVDTFLPISNINGIDKATLGAVNREGKEHYLAKGSIGEISLFNKAISDQEVSNIPLSNPFQLIFQSGDSTQANYFRIPTLLKVL

SEQ ID NO: 3173 - protein, 125 aa, Streptococcus pneumoniae
VLYLLFTTNTRKGTEMQEHYTPKGKHLTIDNRRLIERWKNENKSNREIAGLLGKAPQTIHNEVKRGTTLQQVRKGLYKKVYSADYAQTVYQFNRKRSVKKLILTKEIREKILHYHKHISKNFRLK

SEQ ID NO: 3174 - protein, 210 aa, Streptococcus pneumoniae
MMVNKKQVKVGISTIYYWFHNGHLGLTKADMLYPRKRKGVKKQASPNFKPAGKSIEERPDVINLRLENGHYEIDTVLLTKIKNYCLLVLTDRRSRHQIIRLIPNKTAESVNQALTLLLGEHRILSITADNGSEFKRLSEVFPEEHIYYAHAYSSWERGSNENHNRLIRRWLPKGTKKTTPKEVAFIENWINNYPKKCLDYKSPSEFLLGG

SEQ ID NO: 3175 - protein, 466 aa, Streptococcus pneumoniae
VNFFWVANFNLKFGIPTLYTLSSGRVLSSIDARYGGTHDSKSKINIATSYSDDNGKTWSEPIFAMKFNDYEEQLVYWPRDNKLKNSQISGSASFIDSSIVEDKKSGKTILLADVMPAGIGNNNANKADSGFKEINGHYYLKLKKNGDNDFRYTVREKGVVYDETTNKPTNYTINDKYEVLEGGKSLTVEQYSVDFDSGSLRERHNGKQVPMNVFYKDSLFKVTPTNYIAMTTSQNRGESWEQFKLLPPFLGEKHNGTYLCPGQGLALKSSNRLIFATYTSGELTYLISDDSGQTWKKSSASIPFENATAEAQMVELRDGVIRTFFRTTTGKIAYMTSRDSGETWSKVSYIDGIQQTSYGTQVSAIKYSQLIDGKEAVILSTPNSRSGRKGGQLVVGLVNKEDDSIDWRYHYDIDLPSYGYAYSAITELPNHHIGVLFEKYDSWSRNELHLSNVVQYIDLEINDLTK

SEQ ID NO: 3176 - protein, 367 aa, Streptococcus pneumoniae
MVKYGVVGAGYFGAELARYMQKNDGAEITLLYDPDNAEAIAEELGAKVASSLDELVSSDEVDCVIVATPNNLHKEPVIKAAQHGKNVFCEKPIALSYQDCREMVDACKENNVTFMAGHIMNFFNGVHHAKELINQGVIGDVLYCHTARNGWEEQQPSVSWKKIREKSGGHLYHHIHELDCVQFLMGGMPETVTMTGGNVAHEGEHFGDEDDMIFVNMEFSNKRFALLEWGSAYRWGEHYVLIQGSKGAIRLDLFNCKGTLKLDGQESYFLIHESQEEDDDRTRIYHSTEMDGAIAYGKPGKRTPLWLSSVIDKEMRYLHEIMEGAPVSEEFAKLLTGEAALEAIATADACTQSMFEDRKVKLSEIVK

SEQ ID NO: 3177 - protein, 129 aa, Streptococcus pneumoniae
LNFQTIVAFTLGTIQSNHLDVQFCQFINFFHSSRDEGFLRWIITFDNPNDWKFSDFLNFLDIANTVCSDTDCSTLLSRFDQQGNHPSRFCIKRFMRKSLTRNDDSIFDLLNQGFFANLWHPLSSFSLFL

SEQ ID NO: 3178 - protein, 232 aa, Streptococcus pneumoniae
MPQISKEALIEQIKDGIIVSCQALPHEPLYTEAGGVIPLLVKAAEQGGAVGIRANSVRDIKEIKEVTKLPIIGIIKRDYPPQEPFITATMKEVDELAELDIEVIALDCTKRERYDGLEIQEFIRQVKEKYPNQLLMADTSIFEEGLAAVEAGIDFVGTTLSGYTSYSPKVDGPDFELIKKLCDAGVDVIAEGKIHTPEQAKQILEYGVRGIVVGGAITRPKEITERFVASLK

SEQ ID NO: 3179 - protein, 505 aa, Streptococcus pneumoniae
MFKVLQKVGKAFMLPIAILPAAGLLLGIGGALSNPTTIATYPILDNSIFQSIFQVMSSAGEVVFSNLSLLLCVGLCIGLAKRDKGTAALAGVTGYLVMTATIKALVKLFMAEGSAIDTGVIGALVVGIVAVYLHNRYNNIQLPSALGFFGGSRFVPIVTSFSSILIGFVFFVIWPPFQQLLVSTGGYISQAGPIGTFLYGFLMRLSGAVGLHHIIYPMFWYTELGGVETIAGQTVVGAQKIFFAQLADPAHSGLFTEGTRFFAGRFSTMMFGLPAACLAMYHSVPKNRRKKYAGLFFGVALTSFITGITEPIEFMFLFVSPVLYVVHAFLDGVSFFIADVLNISIGNTFSGGVIDFTLFGILQGNAKTNWVLQIPIGLIWSVLYYIIFRWFITQFNVLTPGRGEEVDSKEISESADSTSNTADYLKQDSLQIIRALGGSNNIEDVDACVTRLRVAVKEVNQVDKALLKQIGAVDVLEVKGGIQAIYGAKAILYKNSINEILGVDD

SEQ ID NO: 3180 - protein, 442 aa, Streptococcus pneumoniae
MKFRKLACTVLAGAAVLGLAACGNSGGSKDAAKSGGDGAKTEITWWAFPVFTQEKTGDGVGTYEKSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 3181 - protein, 295 aa, Streptococcus pneumoniae
VKVNKIRMRETVISYAFLAPVLFFFVIFVLAPMVMGFITSFFNYSMTRFEFVGLDNYIRMFKDPVFTKSLINTVILVIGSVPVVVLFSLFVASQTYHQNVIARSFYRFVFFLPVVTGSVAVTVVWKWIYDPLSGILNFVLKSSHIISQNISWLGDKNWALMAIMIILLTTSVGQPIILYIAAMGNIDNSLVEAARVDGATEFQVFWKIKWPSLLPTTLYIAIITTINSFQCFALIQLLTSGGPNYSTSTLMYYLYEKAFQLTEYGYANTIGVFLAVMIAIVSFVQFKVLGNDVEY

SEQ ID NO: 3182 - protein, 279 aa, Streptococcus pneumoniae
MQSTEKKPLTAFTVISTIILLLLTVLFIFPFYWILTGAFKSQPDTIVIPPQWFPKMPTMENFQQLMVQNPALQWMWNSVFISLVTMFLVCATSSLAGYVLAKKRFYGQRILFAIFIAAMALPKQVVLVPLVRIVNFMGIHDTLWAVILPLIGWPFGVFLMKQFSENIPTELLESAKIDGCGEIRTFWSVAFPIVKPGFAALAIFTFINTWNDYFMQLVMLTSRNNLTISLGVATMQAEMATNYGLIMAGAALAAVPIVTVFLVFQKSFTQGITMGAVKG

SEQ ID NO: 3183 - protein, 150 aa, Streptococcus pneumoniae
MIFDDLKNITFYKGIHPNLDKAIDYLYQHRKDSFELGKYDIDGDKVFLVVQENVLNQAENDQFEYHKNYADLHLLVEGHEYSSYGSRIKDEAVAFDEASDIGFVHCHEHYPLLLGYHNFAIFFPGEPHQPNGYAGMEEKVRKYLFKILID

SEQ ID NO: 3184 - protein, 117 aa, Streptococcus pneumoniae
LVSSCQSVYATRASFLDGQGITVDEMAWIIRGIVNALIGRYIKLGTYAAKYGISMARSILNRAAATAAARVGLLTKIFGWILRIAVLAADVYGNFANNIAVAWDAHDKIPNNGRINF

SEQ ID NO: 3185 - protein, 65 aa, Streptococcus pneumoniae
LLGILSCASQATAILLAKLPYTSAASTAIRKIHPKILVNNPTLAAAVAAALFKIERAILIPYLAA

SEQ ID NO: 3186 - protein, 214 aa, Streptococcus pneumoniae
MAQKGVSLIKAAFDTDNFLMRFSEKVLDIVTANLLFVVSCLPIVTIGVAKISLYETMFEVKKSRRVPVFKIYLRSFKQNLKLGLQLGLMELGIVFLTLSDLYLFWGQTALPFQLLKAICLGILIFLTIVMLASYPIAARYDLSWKEILQKGLMLASFNFPWFFLMLAILVLIVMVLYLSAFSLLLGGSVFLLFGFGLLVFIQTGLMEKIFAKYQ

SEQ ID NO: 3187 - protein, 220 aa, Streptococcus pneumoniae
MSDLKKYEGVIPAFYACYDDQGEVSPERTRALVQYFIDKGVQGLYVNGSSGECIYQSVEDRKLILEEVMAVAKGKLTIIAHVACNNTKDSMELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGRRLMGARVVSVVLMVLCQNSS

SEQ ID NO: 3188 - protein, 99 aa, Streptococcus pneumoniae
GGIGGTYGAMPELFLKLNQLIADKDLKTARELQYAINAIIGKLTSAHGNMYGVIKEVLKINEVLNIGSVRSPLTPVTEEDRPVVEAAAALIRETKERFL

SEQ ID NO: 3189 - protein, 294 aa, Streptococcus pneumoniae
MTYYVAIDIGGTNIKYGLVDQEGQLLESHEMPTEAHKGGPHILQKTKDIVASYLEKGPVAGVAISSAGMVDPDKGEIFYAGPQIPNYAGTQFKKEIEESFTIPCEIENDVNCAGLAEAVSGSGKGASVTLCLTIGTGIGGCLIMDRKVFHGFSNSACEVGYMHMQDGAFQDLASTTALVKYVAEAHGEDVDQWNGRRIFKEATEGNKICMEGIDRMVDYLGKGLANICYVANPEVVILGGGIMGQEAILKPKIRTALKEALVPSLAEKTRLEFAHHQNTAGMLGAYYHFKTKQS

SEQ ID NO: 3190 - protein, 283 aa, Streptococcus pneumoniae
MDKPDIATIIDSHFEEMTDLEQEIARYFLQAETITDDLSSQQVTQKLHISQAALTRFAKKCGFTGYREFIFQYQHQAENQANQVSKHSPLTKRVLRSYSNMREQTQDLIDEIQLERIAQLIEDAERIYFFGTGSSGLVAREMKLRFMRLGVVCEALTDQDGFAWTTSIMDENCLVLGFSLSGSTPSILDSLLDAKEMGAKTVLFTSVPNKDSQTYTETVLVATHSQPSYIQRISAQLPMLFFIDLIYAYFLEINRESKEKIFNSYWENKKLNGYRRQKRVRKS

SEQ ID NO: 3191 - protein, 680 aa, Streptococcus pneumoniae
MRKFNSHSIPIRLNLLFSIVILLFMTIIGRLLYMQVLNKDFYEKKLASASQTKITSSSARGEIYDASGKPLVENTLKQVVSFTRSNKMTATDLKETAKKLLTYVSISSPNLTERQLADYYLADPEIYKKTVEALPSEKRLDSDGNRLSESELYNNAVDSVQTSQLNYTEDEKKEIYLFSQLNAVGNFATGTIATDPLNDSQVAVIASISKEMPGISISTSWDRKVLETSLSSIVGSVSSEKAGLPAEEAEAYLKKGYSLNDRVGTSYLEKQYEETLQGKRSVKEIHLDKYGNMESVDTIEEGSKGNNIKLTIDLAFQDSVDALLKSYFNSELENGGAKYSEGVYAVALNPKTGAVLSMSGIKHDLKTGELTPDSLGTVTNVFVPGSVVKAATISSGWENGVLSGNQTLTDQSIVFQGSAPINSWYTQAYGSFPITAVQALEYSSNTYMVQTALGLMGQTYQPNMFVGTSNLESAMEKLRSTFGEYGLGTATGIDLPDESTGFVPKEYSFANYITNAFGQFDNYTPMQLAQYVATIANNGVRVAPRIVEGIYGNNDKGGLGDLIQQLQPTEMNKVNISDSDMSILHQGFYQVAHGTSGLTTGRAFSNGALVSISGKTGTAESYVADGQQATNTNAVAYAPSDNPQIAVAVVFPHNTNLTNGVGPSIARDIINLYQKYHPMN

SEQ ID NO: 3192 - protein, 119 aa, Streptococcus pneumoniae
LGNGNQCLCSRFGCQGGDHQLRLGKWSLVRKPDLDRPVHCLPRFSSHQFLVYSGLRFIPYHSGPSSGVFIKYLYGPNSLRSYGANLSTQYVCRHQQSRVCYGETAFNLWRIWLGYCDRN

SEQ ID NO: 3193 - protein, 170 aa, Streptococcus pneumoniae
LTVILSYQVSGLRRLRVWPFIRLGCLLMMSMNLQKISFSAKRELTYCSICGRLTDDDPCSICTDPTRDQTTILVLEDSRDVAAMENIQEYHGLYHVLHGLISPMNGISPDDINLKSLMTRLMDSEVSEVIVATNATADGEATSMYLSRLLKPAGIKVTRLDTRSRCGSGH

SEQ ID NO: 3194 - protein, 347 aa, Streptococcus pneumoniae
MKQTIILLYGGRSAEREVSVLSAESVMRAVNYDRFTVKTFFISQSGDFIKTQEFSHAPGQEDRLMTNETIDWDKKVAPSAIYEEGAVVFPVLHGPMGEDGSVQGFLEVLKMPYVGCNILSSSLAMDKITTKRVLESAGIAQVPYVAIVEGDDVTAKIAEVEEKLAYPVFTKPSNMGSSVGISKSENQEELRQALKLAFRYDSRVLVEQGVNAREIEVGLLGNYDVKSTLPGEVVKDVAFYDYDAKYIDNKITMDIPAKISDDVVAVMRQNAETAFRAIGGLGLSRCDFFYTDKGEIFLNELNTMPGFTQWSMYPLLWDNMGISYPELIERLVDLAKESFDKREAHLI

SEQ ID NO: 3195 - protein, 457 aa, Streptococcus pneumoniae
MKLTIHEIAQVVGAKNDISIFEDTQLEKAEFDSRLIGTGDLFVPLKGARDGHDFIKTAFENGAAVTLSEKEVSNHPYILVDDVLTAFQSLASYYLEKTTVDVFAVTGSNGKTTTKDMLAHLLSTRYKTYKTQGNYNNEIGLPYTVLHMPEGTEKLVLEMGQDHLGDIHLLSELARPKTAIVTLVGEAHLAFFKDRSEIAKGKMQIADGMASGSLLLAPADPIVEDYLPTDKKVVRFGQGAELEITDLVERKDSLTFKANFLEQALDLPVTGKYNATNAMIASYVALQEGVSEEQIHQAFQGLELTRNRTEWKKAANGADILSDVYNANPTAMKLILETFSAIPANEGGKKIAVLADMKELGDQSIQLHNQMILSLSPDVLDTVIFYGEDIAELAQLASQMFPIGHVYYFKKTEDQDQFEDLVKQVKESLSANDQILLKGSNSMNLAMLVESLENETK

SEQ ID NO: 3196 - protein, 448 aa, Streptococcus pneumoniae
MNSLPNHHFQNKSFYQLSFDGGHLTQYGGLIFFQELFSQLKLKERISKYLVTNDQRRYCRYSDSDILVQFLFQLLTGYGTDYACKELSADAYFPKLLEGGQLASQPTLSRFLSRTDEETVHSLRCLNLELVEFFLQFHQLNQLIVDIDSTHFTTYGKQEGVAYNAHYRAHGYHPLYAFEGKTGYCFNAQLRPGNRYCSEEADSFITPVLERFNQLLFRMDSGFATPKLYDLIEKTGQYYLIKLKKNTVLSRLGDLSLPCPQDEDLTILPHSAYSETLYQAGSWSHKRRVCQFSERKEGNLFYDVISLVTNMTSGTSQDQFQLYRGRGQAENFIKEMKEGFFGDKTDSSTLIKNEVRMMMSCIAYNLYLFFKHLAGGDFQTLTIKRFRHLFLHVVGKCVRTGRKQLLKLSSLYAYSELFSALYSRIRKVNLNLPVPYEPPRRKASLMMH

SEQ ID NO: 3197 - protein, 191 aa, Streptococcus pneumoniae
MIALTDTGLTFTKDPFDCERYEDLRSLLSEMLNQGSDLDAEEVAEVLKPTSAYATPLMDVRAWIVEDEKICLVRGQGEDSWALPGGFGEVGYSPTENILKEIEEETGFKAKVERLLAVFDTNRFQLQSKQYAKFVFECKLLDGQFQENQEIADLQFFAIDQLPNLSEKRITKEQIEILWQVYQGQREQYLD

SEQ ID NO: 3198 - protein, 198 aa, Streptococcus pneumoniae
MNLWDIFFTTQATEPPKFDLFWYVSLFTLLALTFYTAHRYREKKVYQRFFQILQTVQLILLYGWYWVNHMPLSESLPFYHCRMAMFVVLLLPGQSKYKQYFALLGTFGTLAAFVYPVPDAYPFPHITILSFIFGHLALLGNSLVYLLRQYNARLLDVKGIFLMTFALNALIFVVNLVTGGDYGFLTTRPLVGGTRSSS

SEQ ID NO: 3199 - protein, 86 aa, Streptococcus pneumoniae
MPAFSSAWEMADLIAVAAVSISTIIPSFTPLLLALLTPITFNSPFLCSATSTLTELVPISRPVKKPSLAITSLPLYLPSFALRIIP

SEQ ID NO: 3200 - protein, 457 aa, Streptococcus pneumoniae
MAREGFFTGLDIGTSSVKVLVAEQRNGELNVIGVSNAKSKGVKDGIIVDIDTAATAIKSAISQAEEKAGISIKSVNVGLPGNLLQVEPTQGMIPVTSDTKEITDQDVENVVKSALTKSMTPDREVITFIPEEFIVDGFQGIRDPRGMMGVRLEMRGLLYTGPRTILHNLRKTVERAGVQVENVIISPLAMVQSVLNEGEREFGATVIDMGAGQTTVATIRNQELQFTHILQEGGDYVTKDISKVLKTSRKLAEGLKLNYGEAYPPLASKETFQVEVIGEVEAVEVTEAYLSEIISARIKHILEQIKQELDRRRLLDLPGGIVLIGGNAILPGMVELAQEVFGVRVKLYVPNQVGIRNPAFAHVISLSEFAGQLTEVNLLAQGAIKGENDLSHQPISFGGMLQKTAQFVQSTPVQPAPAPEVEPVAPTEPMADFQQASQNKPKLADRFRGLIGSMFDE

SEQ ID NO: 3201 - protein, 419 aa, Streptococcus pneumoniae
MTFSFDTAAAQGAVIKVIGVGGGGGNAINRMVDEGVTGVEFIAANTDVQALSSTKAETVIQLGPKLTRGLGAGGQPEVGRKAAEESEETLTEAISGADMVFITAGMGGGSGTGAAPVIARIAKDLGALTVGVVTRPFGFEGSKRGQFAVEGINQLREHVDTLLIISNNNLLEIVDKKTPLLEALSEADNVLRQGVQGITDLITNPGLINLDFADVKTVMANKGNALMGIGIGSGEERVVEAARKAIYSPLLETTIDGAEDVIVNVTGGLDLTLIEAEEASQIVNQAAGQGVNIWLGTSIDESMRDEIRVTVVATGVRQDRVEKVVAPQARSATNYRETVKPAHSHGFDRHFDMAETAELPKQNPRRLEPTQASAFGDWDLRRESIVRTTDSVVSPVERFEAPISQDEDELDTPPFFKNR

SEQ ID NO: 3202 - protein, 78 aa, Streptococcus pneumoniae
LIPSTANCPRLLPSKPKGRVTTPTVSAPKSLAIRAITGAAPVPEPPPIPAVMKTISAPLIASVSVSSLSSAALRPTSG

SEQ ID NO: 3203 - protein, 223 aa, Streptococcus pneumoniae
MNVKENTELVFREVAEASLSANRESGSVSVIAVTKYVDVPTAEALLPLGVHHIGENRVDKFLEKYEALKDRDVTWHLIGTLQRRKVKDVIQYVDYFHALDSVKLAGEIQKRSDRVIKCFLQVNISKEESKHGFSREELLEILPELAGLDKIEYVGLMTMAPFEASSEQLKEIFKAAQDLQREIQEKQIPNIPMTELSMGMSRDYKEAIQFGSTFVRIGTSFFK

SEQ ID NO: 3204 - protein, 179 aa, Streptococcus pneumoniae
MSLKDRFDRFIDYFTEDEDSSLPYEKRDEPVFTSVNSSQEPALPMNQPSQSAGTKENNITRLHARQQELANQSQRATDKVIIDVRYPRKYEDATEIVDLLAGNESILIDFQYMTEVQARRCLDYLDGACHVLAGNLKKVASTMYLLTPVNVIVNVEDIRLPDEDQQGEFGFDMKRNRVR

SEQ ID NO: 3205 - protein, 87 aa, Streptococcus pneumoniae
MIFLIRMIYNAVDIYSLILIAFAVMSWFPGAYESSLGRWIVALVKPVLAPLQRLPLQIAGLDLSVWVAIVLVRFLGENLVRFLAMIG

SEQ ID NO: 3206 - protein, 261 aa, Streptococcus pneumoniae
MNKGIYQHFSIEDRPFLDKGMEWIKKVEDSYAPFLTPFINPHQEKLLKILAKTYGLACSSSGEFVSSEYVRVLLYPDYFQPEFSDFEISLQEIVYSNKFEHLTHAKILGTVINQLGIERKLFGDILVDEERAQIMINQQFLLLFQDGLKKIGRIPVSLEERPFTEKIDKLEQYRELDLSVSSFRLDVLLSNVLKLSRNQANQLIEKKLVQVNYHVVDKSDYTVQVGDLISVRKFGRLRLLQDKGQTKKEKKKITVQLLLSK

SEQ ID NO: 3207 - protein, 262 aa, Streptococcus pneumoniae
MPITSLEIKDKTFGTRFRGFDPEEVDEFLDIVVRDYEDLVRANHDKNLRIKSLEERLSYFDEIKDSLSQSVLIAQDTAERVKQAAHERSNNIIHQAEQDAQRLLEEAKYKANEILRQATDNAKKVAVETEELKNKSRVFHQRLKSTIESQLAIVESSDWEDILRPTATYLQTSDEAFKEVVSEVLGEPIPAPIEEEPIDMTRQFSQAEMAELQARIEVADKELSEFEAQIKQEVEAPTPVVSPQVEEEPLLIQLAQCMKNQK

SEQ ID NO: 3208 - protein, 930 aa, Streptococcus pneumoniae
MKLKDTLNLGKTEFPMRAGLPTKEPVWQKEWEDAKLYQRRQELNQGKPHFTLHDGPPYANGNIHVGHAMNKISKDIIVRSKSMSGFYAPFIPGWDTHGLPIEQVLSKQGVKRKEMDLVEYLKLCREYALSQVDKQREDFKRLGVSGDWENPYVTLTPDYEAAQIRVFGEMANKGYIYRGAKPVYWSWSSESALAEAEIEYHDLVSTSLYYANKVKDGKGVLDTDTYIVVWTTTPFTITASRGLTVGADIDYVLVQPAGEARKFVVAAELLTSLSEKFGWADVQVLETYRGQELNHIVTEHPWDTAVEELVILGDHVTTDSGTGIVHTAPGFGEDDYNVGIANNLEVAVTVDERGIMMKNAGPEFEGQFYEKVVPTVIEKLGNLLLAQEEISHSYPFDWRTKKPIIWRAVPQWFASVSKFRQEILDEIEKVKFHSEWGKVRLYNMIRDRGDWVISRQRAWGVPLPIFYAEDGTAIMVAETIEHVAQLFEEHGSSIWWERDAKDLLPEGFTHPGSPNGEFKKETDIMDVWFDSGSSWNGVVVNRPELTYPADLYLEGSDQYRGWFNSSLITSVANHGVAPYKQILSQGFALDGKGEKMSKSLGNTIAPSDVEKQFGAEILRLWVTSVDSSNDVRISMDILSQVSETYRKIRNTLRFLIANTSDFNPAQDTVAYDELRSVDKYMTIRFNQLVKTIRDAYADFEFLTIYKALVNFINVDLSAFYLDFAKDVVYIEGAKSLERRQMQTVFYDILVKITKLLTPILPHTAEEIWSYLEFETEDFVQLSELPEAQTFANQEEILDTWAAFMDFRGQAQKALEEARNAKVIGKSLEAHLTVYPNEVVKTLLEAVNSNVAQLLIVSDLTIAEGPAPEAALSFEDVAFTVERAAGEVCDRCRRIDPTTAERSYQAVICDHCASIVEENFADAVAEGFEEK

SEQ ID NO: 3209 - protein, 61 aa, Streptococcus pneumoniae
MKLKTLALISGIVGLVGGILLLIGPFVLLGTTVNTAATTLNGGATAGAFSGVACTLECLED

SEQ ID NO: 3210 - protein, 86 aa, Streptococcus pneumoniae
MEELLQGLFQVLPVLLNALKIENLVLGIIAIVYYKGDKRVGAAPSVLMIVSGGVSLIPFLGWVGGILAIIGGSLFLATLKKFKSEE

SEQ ID NO: 3211 - protein, 62 aa, Streptococcus pneumoniae
MENNDSFTKLKESTQKLFDAQKKRLNNEDRIETTKNNVIAKHCQTVLSFLVLTSFFVKNCVK

SEQ ID NO: 3212 - protein, 71 aa, Streptococcus pneumoniae
LCSIQTHRGEQKPILPLDGFSFKFSEVSPRLSILFYTIFHKKASQNQKGKDCLTMFGNHIVFGCFYSIFII

SEQ ID NO: 3213 - protein, 230 aa, Streptococcus pneumoniae
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPAFKDGKNVFVGAHGNSIRALVKHIKGLSDDEIMDVEIPNFPPLVFEFDEKLNVVSEYYLGK

SEQ ID NO: 3214 - protein, 803 aa, Streptococcus pneumoniae
MIRNKKQDYVLAYKQPASTTYMGWEEEALPIGNGSLGAKVFGLIGSERIQFNEKSLWSGGPLPDSSDYQGGNLQDQYVFLAEIRQALEKRDYNLAKELAEQHLIGPKTSQYGTYLSFGDIHIEFSQQGTTLSQVTDYQRQLNISKALATTSYVYKGTRFEREAFASFPDDLLVQCFTKEGLETLDFTIELSLTCDLASDGKYEQEKSDYKECKLDITDSHILMKGRVKDNDLRFASYLAWETDGDIRVWSDRVQISGASYANLFLAAKTDFAQNPASNYRKKLDLEQQVIDLVDTAKEKGYTQLKSRHIEDYQALFQRVQLDLEADVDASTTDDLLKNYKPQEGQALEELFFQYGRYLLISSSRDCPDALPANLQGVWNAVDNPPWNSDYHLNVNLQMNYWPAYVTNLLETVFPVINYVDDLRVYGRLAAVKYAGIVSQKGEENGWLVHTQATPFGWTAPGWDYYWGWSPAANAWMMQTVYEAYSFYRDQDYLREKIYPMLRETVRFWNAFLHKDQQAQRWVSSPSYSPEHGPISIGNTYDQSLIWQLFHDFIQAAQELGLDEDLLTEVKEKSDLLNPLQITQSGRIREWYEEEEQYFQNEKVEAQHRHASHLVGLYPGNLFSYKGQEYIEAARASLNDRGDGGTGWSKANKINLWARLGDGNRAHKLLAEQLKTSTLQNLWCSHPPFQIDGNFGATSGMAEMLLQSHAAYLVPLAALPDAWSTGSVSGLMARGHFEVSMSWEDKKLLQLTILSRSGGDLRVSYPDIEKSVIKMNQEKIKAKCMGKDCISVATAEGDLVQFYF

SEQ ID NO: 3215 - protein, 236 aa, Streptococcus pneumoniae
VDLMAYIEMKHCYKRYQVGDTEIVANRDVNFEIEKGELVIILGASGAGKSTVLNLLGGMDTNDEGEIWIDGVNIADYSSHQRTNYRRNDVGFVFQFYNLVSNLTAKENVELASEIVTDALNPDQVLTDVGLAHRLNNFPAQLSGGEQQRVSIARAVAKNPKILLCDEPTGALDYQTGKQVLKILQDMSRQKGATVIIVTHNGALAPIADRVIHMHDASVKDVVLNQHPQDIDSLEY

SEQ ID NO: 3216 - protein, 924 aa, Streptococcus pneumoniae
MPVSRMWCSTSILRILTVWSTSMIKRKTYWKDLIQSFTGSKGRFLSILILMMLGSLALVGLKVTSPNMEATANAYLTTAQTLDLAVMSNYGLDQADQEELKQTEGAEVEFGYLTDVTMDNGQDAIRLYSKPERISTFQLRKGRLPQSDKEIALATHLQDQYSVGQEISFKEKEEGHSSLKDHTYTITGFVDSAEILSQRDMGYAGSGSGTLAAYGVILPSQFDQKVYNIARLKYQDLAGLNAFSSAYEEKSKQHQEELEQILSDNGKVRLQLLKKEGQESLDKGQETLDKAQTNLQEGKRRLAAAQARIQAQESQLALFPQVQREQASAQLTQAKQELGKEEAKLKQAEQNLAQEKEKLEKHQQVLDDLAEPRYQVYNRQTMPGGQGYLMYSNASSSIRAVGNIFPVVLYAVAAMVTFTTMTRFVDEERTHAGIFKALGYRSKDIIAKFLLYGLVAGTVGTALGSILGHYLLASVISSVITKGMVVGETQIQFYWTYSLLAFVLSLLASVLSAYLVAWRELHDEAAQLLLPKPPVKGAKILLERIGFIWRRLSFTHKVTARNIFRYKQRMLMTIFGVAGSVALLFAGLGIQSSVAGVPSKQFQQIQQYQMLVSENPSATNQDKVELAEVLKGQEILAYQKIYSKTLDKDFKGKAGLQNITLMMIEKEDLTPFIHLQHHQQELTLKDGIVITAKLAQLAGVKVGQTLEIEGKELKVAAITENYVGHFIYMSQASYEQLYGQLPQANTYLVSLRDTSATSIESQAGLLMNQSAVSSVVQNASAIRLFDSIASSLNQTMTILVIVSVLLAIVILYNLTNINVAERIRELSTIKVLGFHNNEVTLYIYRETIVLSLVGIVLGLIAGFYLHQFLIQMISPATILFYPQVGWEVYVIPVAAVSFILTLLGFFVNYYLRKVDMLEALKSVE

SEQ ID NO: 3217 - protein, 172 aa, Streptococcus pneumoniae
MEEKRLEYPMVTFLGNPVSFTGKQLQVGDKALDFSLTTTDLSKKSLADFDGKKKVLSVVPSIDTGICSTQTRRFNEELAGLDNTVVLTVSMDLPFAQKRWCGAEGLDNAIMLSDYFDHSFGRDYALLINEWHLLARAVFVLDTDNTIHYVEYVDNINSEPNFEAAIAAAKAL

SEQ ID NO: 3218 - protein, 309 aa, Streptococcus pneumoniae
MKKLGTLLVLFLSAIILVACASGKKATTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 3219 - protein, 282 aa, Streptococcus pneumoniae
MIAEFIDGLQKFHFLQNALITAIVVGIVAGAVGCFIILRGMSLMGDAISHAVLPGVALSFILGLDFFIGAIVFGLLAAIIITYIKGNSIIKSDTAIGITFSSFLALGIILIGVAKSSTDLFHILFGNILAVQDTDMFITMGVGAAILLLIWIFFKQLLITSFDELLAKAMGMPVNFYHYLLMVLLTLVSVTAMQSVGTILIVAMLITPAATAYLYANSLKSMIFLSSTFGATASVLGLFIGYSFNVAAGSSIVLTAASFFLISFFIAPKQRYLKLKNKHLLK

SEQ ID NO: 3220 - protein, 251 aa, Streptococcus pneumoniae
MYIKRQEEYKFMIRIENLSVSYKETLALKDISLVLHGPTITGIIGPNGAGKSTLLKGMLGIIPHQGQAFLDDKEVKKSLHRIAYVEQKINIDYNFPIKVKECVSLGLFPSIPLFRSLKAKHWKKVQEALEIVGLADYAERQISQLSGGQFQRVLIARCLVQEADYILLDEPFAGIDSVSEEIIMNTLRDLKKAGKTVLIVHHDLSKIPHYFDQVLLVNREVIAFGPTKETFTETNLKEAYGNQLFFNGGDL

SEQ ID NO: 3221 - protein, 650 aa, Streptococcus pneumoniae
LHSLVIFVKINANTNESENKMTRYQDDFYDAINGEWQQTAEIPADKSQTGGFVDLDQEIEDLMLATTDKWLAGEEVPEDAILENFVKYHRLVRDFDKREADGITPVLPLLKEFQELETFADFTAKLAEFELAGKPNFLPFGVSPDFMDARINVLWASAPSTILPDTTYYAEEHPQREELLTLWKESSANLLKAYDFSDEEIEDLLEKRLELDRRVAAVVLSNEESSEYAKLYHPYSYEDFKKFAPALPLDDFFKAVIGQLPDKVIVDEERFWQAAEQFYSEEAWSLLKATLILSVVNLSTSYLTEDIRVLSGAYSRTLSGVPEAKDKVKAAYHLAQEPFKQALGLWYAREKFSPEAKADVEKKVATMIDVYKERLLKNDWLTPETCKQAIVKLNVIKPYIGYPEELPARYKDKVVNETASLFENALAFARVEIKHSWSKWNQPVNYKEWGMPAHMVNAYYNPQKNLIVFPAAILQAPFYDLHQSSSANYGGIGAVIAHEISHAFDTNGASFDENGSLKDWWTESDYAAFKEKTQKVIDQFDGQDSYGATINGKLTVSENVADLGGIAAALEAAKREADFSAEEFFYNFGRIWRMKGRPEFMKLLASVDVHAPAKLRVNVQVPNFDDFFTTYDVKEGDGMWRSPEERVIIW

SEQ ID NO: 3222 - protein, 209 aa, Streptococcus pneumoniae
MKIHKTVNPVAYENTYYLEGEKHLIVVDPGSHWEAIRQTIEKINKPICAILLTHAHYDHIMSLDLVRETFGNPPVYIAESEASWLYTPVDNLSGLPRHDDMADVVTKPAEHTFVFHEEYQLEEFRFKVLPTPGHSIGGVSLVFPDAHLVLTGDALFRETIGRTDLPTGSMEQLLHSIQTQLFTLPNYDVYPGHGPATTIAHEKAFNPFF

SEQ ID NO: 3223 - protein, 66 aa, Streptococcus pneumoniae
MDFHTSSNLKECTNTLRKSLQTASTLSATSKQCFEQPAASFLVCSLIFIEYKLSIAQLGRIGKDLK

SEQ ID NO: 3224 - protein, 80 aa, Streptococcus pneumoniae
LARFEEIFEEYKNPQDTFFYPLVYKENTYEKTAISIFALLMLGVCCLFLFSQQSYKKLVQYYANDQNLPSRITYSEYSDK

SEQ ID NO: 3225 - protein, 740 aa, Streptococcus pneumoniae
MPKEVNLTGEEVVALTKEYLTEEDVHFVHKALVYAVECHSGQYRKSGEPYIIHPIQVAGILAKLKLDAVTVACGFLHDVVEDTDATLDDLEREFGPDVRVIVDGVTKLGKVEYKSIEEQLAENHRKMLMAMSEDIRVILVKLSDRLHNMRTLKHLRKDKQERISKETMEIYAPLAHRLGISSVKWELEDLSFRYLNPTEFYKITHMMKEKRREREALVDEVVTKLEEYTTERHLKGKIYGRPKHIYSIFRKMQDKRKRFEEIYDLIAIRCILDTQSDVYAMLGYVHEFWKPMPGRFKDYIANRKANGYQSIHTTVYGPKGPIEFQIRTKEMHEVAEYGVAAHWAYKKGIKGQVNSKESAIGMNWIKEMMELQDQADDAKEFVDSVKENYLAEEIYVFTPDGAVRSLPKDSGPIDFAYEIHTKVGEKATGAKVNGRMVPLTTKLKTGDQVEIIANPNSFGPSRDWLNMVKTSKARNKIRQFFKNQDKELSVNKGREMLMAQFQENGYVANKFMDKRHMDQVLQKTSYKTEDSLFAAIGFGEIGAITVFNRLTEKERREEERAKAKAEAEELVKGGEVKVENKETLKVKHEGGVVIEGASGLLVRIAKCCNPVPGDDIVGYITKGRGVAIHRVDCMNLRAQENYEQRLLDVEWEDQYSSSNKEYLAHIDIYGLNRTGLLNDVLQVLSNTTKNISTVNAQPTKDMKFANIHVSFGIANLSTLTTVVDKIKSVPEVYSVKRTNG

SEQ ID NO: 3226 - protein, 80 aa, Streptococcus pneumoniae
LPLYTFLISPVSRNPVLSHLVHFLGSNLEFNRPFWSINSRMDRLITIGLAVGNIVFEATWHRFPKFMHVTKHGINITLGI

SEQ ID NO: 3227 - protein, 147 aa, Streptococcus pneumoniae
MKIIIQRVKKAQVSIEGQIQGKINQGLLLLVGVGPEDQEEDLDYAVRKLVNMRIFSDAEGKMNLSVKDIEGEILSISQFTLFADTKKGNRPAFTGAAKPDMASDFYDAFNQKLAQEVPVQTGIFGADMQVELVNNGPVTIILDTKKR

SEQ ID NO: 3228 - protein, 75 aa, Streptococcus pneumoniae
LYSQIRPRFWRFALQILLWDSLMILSLVSLSDIPLFLQGTLLILGHLIPSYRICQSLKRDFPQAYQEPISFWSIL

SEQ ID NO: 3229 - protein, 140 aa, Streptococcus pneumoniae
VLVMKKLYRIHFIAIAVIDLLLFAFFIIRLETSFEWLLLSDLIFFLTQGLLLFLLIVRLKHQFAEIYPQINKKIRFYYLGVLTIDFLFFVLLAFISSQRFSSLMPIITACHSTFYYMTADYLRENYPDFYDKHISLWECL

SEQ ID NO: 3230 - protein, 235 aa, Streptococcus pneumoniae
MKKSLKIFATSKWFDLFGVALVVGIAIASGYLNSRLDKFVDWGPWTALVPFGLISVTNVGISMLSTRFTGKLSKWGNYFSIVNTILSGAIDYILGNKAAIITYPVTFLIYTFAIKKWKASQEGRPNQMSQKQVKLAVIIISIIAFLFAFVTNYIGYEGKMNLLAYVTTIAFALSLIANALNALKLTTQWGFWLIYNFVQLTKAGIQGNFANIGKYIFYILNAIGALFVWNDEEVR

SEQ ID NO: 3231 - protein, 139 aa, Streptococcus pneumoniae
LIEVFLIHHLDYTSDQIHEEADVLEHTVSDLFVERLDKLLGFPKTCPHGGTIPAKGELLVEINNLPLADIKEAGAYRLTRVHDSFDILHYLDKHSLHIGDQLQVKQFDGFSNTFTILSNDEDLQVNMDIAKQLYVEKIN

SEQ ID NO: 3232 - protein, 79 aa, Streptococcus pneumoniae
MTPNKEDYLKCIYEIGIDLHKITNKEIAARMQVSPPAVTEMIKRMKSENLILKDKECGYLLTDLGLKLVSELYRKHTLD

SEQ ID NO: 3233 - protein, 280 aa, Streptococcus pneumoniae
MTKIALLSDIHGNTTALEAVLADAQQLGVDEYWLLGDILMPGTGRRRILDLLDQLPITARVLGNWEDSLWHGVRKELDSTRPSQRYLLRQCQYVLEEISLEEIEVLHNQPLQIHRQFGDLTVGISHHLPDKNWGRELIHTGKQEEFDRLVTHPPCDIAVYGHIHQQLLRYGTGGQLIVNPGSIGQPFFLDAQLRKDLRAQYMILEFDDKGLVDMDFRRVDYDVAAELQLAKDLRLPYFEVYYESLVNGIHHTHHQEFLRELAQKEGCDRELDDWLKSGND

SEQ ID NO: 3234 - protein, 64 aa, Streptococcus pneumoniae
LEFASSSPFYEATLPLLFFFYYYTLFSCNVNRYHFSTSRLTPGRSPLSEPILSKIPDDEYGGSH

SEQ ID NO: 3235 - protein, 104 aa, Streptococcus pneumoniae
MQIPSRFTIATHMLIIIALEGKESKVTSDFLAASVGVNPVIIRKILSQLKKAELISVARGTGGTEIVKDLKDISLLDVYQGGSNVLVRQVNSSVSMTIRIQIAL

SEQ ID NO: 3236 - protein, 72 aa, Streptococcus pneumoniae
SFRCLSRRVECLGKTGQLFSFHDNPNPNCPVGAHIHDVLDQKLERIQLTMEAELGQTSLEKVVADAESQMKD

SEQ ID NO: 3237 - protein, 100 aa, Streptococcus pneumoniae
MYLVIGIVLAFIVSFWKDNRSLWNPVLFLLSLISSYFYLSYLFYKNGYENVQLAFYVFAFVLLPFLLFLSGIFLIYNGVILLKREGRSKPHYLSMLFDFY

SEQ ID NO: 3238 - protein, 357 aa, Streptococcus pneumoniae
MANIFDYLKDVAYDSYYDLPLNELDILTLIEITYLSFDNLVSTLPQRLLDLAPQVPRDPTMLTSKNRLQLLDELAQHKRFKNCKLSHFINDIDPELQKQFAAMTYRVSLDTYLIVFRGTDDSIIGWKEDFHLTYMKEIPAQKHALRYLKNFFAHHPKQKVILAGHSKGGNLAIYAASQIEQSLQNQITAVYTFDAPGLHQELTQTAGYQRIMDRSKIFIPQGSIIGMMLEIPAHQIIVQSTALGGIAQHDTFSWQIEDKHFVQLDKTNSDSQQVDTTFKEWVATVPDEELQLYFDLFFGTILEAGISSINDLASLKALEYIHHLFVQAQSLTPEERETLGRLTQLLIDTRYQAWKNR

SEQ ID NO: 3239 - protein, 225 aa, Streptococcus pneumoniae
MHKILLIEDDQVIRQQVGKMLSEWGFEVVLVEDFMKVLSLFVQSEPHLVLMDIGLPLFNGYHWCQEIRKISKVPIMFLSSRDQAMDIVMAINMGADDFVTKPFDQQVLLAKVQGLLRRSYEFGRDESLLEYAGVILNTKSMDLHYQGQVLNLTKNEFQILRVLFEHAGNIVARDDLMRELWNSDFFIDDNTLSVNVARLRKKLEEQGLVGFIETKKGIGYGLKHA

SEQ ID NO: 3240 - protein, 324 aa, Streptococcus pneumoniae
MLDWKQFFLAYLRSRSRLFIYLLSLAFLVLLFQFLFASLGIYFLYFFFLCCFVTILFFTWDILVETQVYRQELLYGEREAKSPLEIALAEKLEAREMELYQQRSKAERKLTDLLDYYTLWVHQIKTPIAASQLLVAEVVDRQLKQQLEQEIFKIDSYTNLVLQYLRLESFHDDLLLKQVQIEDLVKEIIRKYALFFIQKGLNVNLHDLDKEIVTDKKWLLVVIEQIISNSLKYTKEGGLEIYMDDQELCIKDTGIGIKNSDVLRVFERGFSGYNGRLTQQSSGLGLYLSKKISEELGHQIRIESEVGKGTTVRIQFAQVNLVLE

SEQ ID NO: 3241 - protein, 660 aa, Streptococcus pneumoniae
MLRNYEIIKKENIMINITFPDGAVREFESGVTTFEIAQSISNSLAKKALAGKFNGKLIDTTRAITEDGSIEIVTPDHEDALPILRHSAAHLFAQAARRLFPDIHLGVGPAIEDGFYYDTDNTAGQISNEDLPRIEEEMQKIVKENFPSIREEVTKDEAREIFKNDPYKLELIEEHSEDEGGLTIYRQGEYVDLCRGPHVPSTGRIQIFHLLHVAGAYWRGNSDNAMMQRIYGTAWFDKKDLKNYLQMREEAKERDHRKLGKELDLFMISQEVGQGLPFWLPNGATIRRELERYIVNKELASGYQHVYTPPLASVELYKTSGHWDHYQEDMFPTMDMGDGEEFVLRPMNCPHHIQVFKHHVHSYRELPIRIAEIGMMHRYEKSGALTGLQRVREMSLNDGHLFVTPEQIQEEFQRALQLIIDVYEDFNLTDYRFRLSLRDPQDTHKYFDNDEMWENAQTMLRAALDEMGVDYFEAEGEAAFYGPKLDIQIKTALGKEETLSTIQLDFLLPERFDLKYIGADGEDHRPVMIHRGVISTMERFTAILIENYKGAFPTWLAPHQVTLIPVSNEKHVDYAWEVAKKLRDRGVRADVDERNEKMQFKIRASQTSKIPYQLIVGDKEMEDETVNVRRYGQKETQTVSVDNFVQAILADIANKSRVEK

SEQ ID NO: 3242 - protein, 129 aa, Streptococcus pneumoniae
MKVEPRCDVLSRMSHFFIRILIMELQELVERSWAIRQAYHELEVKHHDSKWTVEEDLLALSNDIGNFQRLVMTKQGRYYDETPYTLEQKLSENIWWLLELSQRLDIDILTEMENFLSDKEKQLNVRTWK

SEQ ID NO: 3243 - protein, 96 aa, Streptococcus pneumoniae
ACRIAQLRSTNSCNSIISILIKKCDILERTSQRGSTFIYVPQKRGTPLIGSNVATVLCFHKKLKSSISLDFLCVSSNHALSSRKGLSDLSLWIIIA

SEQ ID NO: 3244 - protein, 69 aa, Streptococcus pneumoniae
VIIMRRFYSHLPYYLVILFFYWPLYELFLLVVSDPLTLKELYINNLLFFTPLVILIISLLYSYRFRFSL

SEQ ID NO: 3245 - protein, 209 aa, Streptococcus pneumoniae
MKLAVIAANGQAGKAIVEEAVKRGHEVTAIVRSENKSQAESIIKKDLFELTKDDLTGFDAVISAFGAYTPDTLPLHSKSIELFNQLLAGTQTRFLVVGGAGSLYIDETKTTRLLDTSDFPEEFKSLAKDQADELDLLRTKNNLNWTFVSPAVDFIPDGEKTGNYILAGEIFTTNEKGISQISYADYAIGLVDELEKGHHIKERISLLEK

SEQ ID NO: 3246 - protein, 89 aa, Streptococcus pneumoniae
MAISKEKKNEIIAQYARHEGDTGSVEVQVAVLTWEINHLNEHIKQHKKDHATYRGLMKKIGRRRNLLAYLRKNDVNRYRELINSLGLRR

SEQ ID NO: 3247 - protein, 74 aa, Streptococcus pneumoniae
SINDLSSKNHDAKGVKNPYENREMTQCSMSTRSFIFFTRILARAQISSLTSEGFFIEVLSVTILETTKTSNGIS

SEQ ID NO: 3248 - protein, 158 aa, Streptococcus pneumoniae
MGQTIISAIGVYISTSIDYLIILIILFAQLSQNKQKWHIYAGQYLGTGLLVGASLVAAYVVNFVPEEWMVGLLGLIPIYLGIRFAIVGEDAEEEEEEIIERLEQSKANQLFWTVTLLTIASGGDNLGIYIPYFASLDWSQTLVALLVFVIGIIIFCEN

SEQ ID NO: 3249 - protein, 249 aa, Streptococcus pneumoniae
MFYTYLRGLVVLLLWSINGNAHYHNTDKIPNQDENYILVAPHRTWWDPVYMAFATKPKQFIFMAKKELFTNRIFGWWIRMCGAFPIDRENPSASAIKYPINVLKKSDRSLIMFPSGSRHSNDVKGGAALIAKMAKVRIMPVTYTGPMTLKGLISRERVDMNFGNPIDISDIKKMNDEGIETVANRIQTEFQRLDEETKQWHNDKKPNPLWWFIRIPALILAIILAILTIIFSFIASFIWNPDKKREELA

SEQ ID NO: 3250 - protein, 778 aa, Streptococcus pneumoniae
MDKNKIMGLTQREVKERQAEGLVNDFTASASTSTWQIVKRNVFTLFNALNLAIALALAFVQAWSNLVFFAVICFNAFSGIVTELRAKHMVDKLNLMTKEKVKTIRDGQEVALNPEELVLGDVIRLSAGEQIPSDALVLEGFAEVNEAMLTGESDLVQKEVDGLLLSGSFLASGSVLSQVHHVGADNYAAKLMLEAKTVKPINSRIMKSLDKLAGFTGKIIIPFGLALLLEALLLKGLPLKSSVVNSSTALLGMLPKGIALLTITSLLTAVIKLGLKKVLVQEMYSVETLARVDMLCLDKTGTITQGKMQVEAVLPLTETYGEEAIASILTSYMAHSEDKNPTAQAIRQRFVGDVAYPMISNLPFSSDRKWGAMELEGLGTVFLGAPEMLLDSEVPEAREALERGSRVLVLALSQEKLDHHKPQKPSDIQALALLEILDPIREGAAETLDYLRSQEVGLKIISGDNPVTVSSIAQKAGFADYHSYVDCSKITDEELMAMAEETAIFGRVSPHQKKLIIQTLKKAGHTTAMTGDGVNDILALREADCSIVMAEGDPATRQIANLVLLNSDFNDVPEILFEGRRVVNNIAHIAPIFLIKTIYSFLLAVICIASALLGRSEWILIFPFIPIQITMIDQFVEGFPPFVLTFERNIKPVEQNFLRKSMLRALPSALMVVFSVLFVKMFGASQGWSELEISTLLYYLLGSIGFLSVFRACMPFTLWRVLLIVWSVGGFLATALFPRIQKLLEISTLTEQTLPVYGVMMLVFTVIFILTSRYQAKK

SEQ ID NO: 3251 - protein, 76 aa, Streptococcus pneumoniae
SLLSRKRSNNVSICSCFLDTIHLLYESIISLSKNNILRILSFAMDIFVFIKNMISNRTEPHYAKIILPFLHNIYFS

SEQ ID NO: 3252 - protein, 487 aa, Streptococcus pneumoniae
VSRKQEQMETLLLLLRDSKDYISAKVLGEKLNCSDKTVYRLVKGINKDCPVEAFILSEKGRGFKLNPRSSLVDVDGNFTEAFDPEVRREKLLERLLLTAPKPHSIYDLGEEFYVSESVVLKDRQILQESLAIYGLDLKMRQRKLFIDGDEAQIRSAILNLLPMFNQLDLEQITQNKVQPLDGELAHFCLGLLITLERELGVNIPYPYNINIFSHLYIFISRNRRSTSIHVVAPSKPTIVDEKIYSVCQKIIQEIEQYFRMKVDAVEIDYLYQYVVSSRLQKPFSSGKLPFSQRVLDVTHYYFSRMCMDNREIETTDPDFVDLASHISPLLRRLDNRVQIKNSLLSQILLTYPNLVKELTTISKEVSLVFGFASLSLDEIGFLVLYFARFQEKRARPLKTVVMCTSGVGTSELLRARLEKQFSELDIIDVVAYHQLDELINLYPDLDFIVTTVALQEPASVPFVLVSVFLTEGDKQRLQAKIQEINYE

SEQ ID NO: 3253 - protein, 142 aa, Streptococcus pneumoniae
MNNLSLVLMDISVQNRQEAYKELANQISLLVSEDTEKIEELLYYRERQGSIEVAKGVLLPHCEGNFQHHVLVITRLKSPIREWSKDIQCVDLIIGLAIAVSQDKSCIKTLMRRLADESFINQLKQLTKEELREIIYGNQRYS

SEQ ID NO: 3254 - protein, 150 aa, Streptococcus pneumoniae
YMEIKDILNVSLIQTDLQMQSKEEVFEALAQLLVETGYVSDRDQFIEGLYQREAEGQTGIGNYIAIPHSKSSAVEKAGVVIAINHNEIPWETIDGKGVKVIVLFAVGDDTEAAREHLKTLSLFARKLGNDEVVAKLVRAQTSDDVIAAFC

SEQ ID NO: 3255 - protein, 103 aa, Streptococcus pneumoniae
MKIVGVAACTVGIAHTYIAQEKLENAAKVAGHVIHVETQGTIGVENELSQEQIDAADVVILAVDVKISGMERFEGKKIIKVPTEVAVKSPNKLIAKAVEIVTK

SEQ ID NO: 3256 - protein, 368 aa, Streptococcus pneumoniae
KYLRRKYMLKHLNLKGHLLTAISYMIPIVCGAGFLVAIGLAMGGGVPDALVAGKFTIWDALATMGGKALGLLPVVIATGLSYSIAGKPGIAPGFVVGLIANSVGSGFIGGILGGYIAGFLVQAIIKKVKVPNWIKGLMPTLIIPFVASLVSSLIMIYIIGAPIAAFTNWLTSLLQSLGSASNGLMGAVIGVLSAVDFGGPLNKTVYAFVLTLQAEGVKEPLTALQLVNTATPVGFGLAYFIAKLLKKNIYTQEEIETLKSAVPMGIVNIVEGVIPIVMNNLVPGLIATGIGGAVGGAVSLTMGADSAVPFGGVLMLPTMTRPVAGICALLANIVVTGLVYAILRKPIKHTEPVMTVEEEIDLSDIEIL

SEQ ID NO: 3257 - protein, 231 aa, Streptococcus pneumoniae
MSRIEFSPSLMTMDLDKFKEQITFLNDKVASYHIDIMDGHFVPNITLSPWFIQEVQKISDTPLSVHLMVTDPTFWVDQVLDLQCEYICIHAEVLNGLAFRLIDKIHDAGLKAGVVLNPETPVSTIFPYIDLLDKVTIMTVDPGFAGQRFLESTLYKIQELRQLRVQNGYHYIIEMDGSSSRKTFKQIDVAGPDIYVIGRSGLFGLDDDIAKAWDICSRDYEEMTGKTMPIK

SEQ ID NO: 3258 - protein, 656 aa, Streptococcus pneumoniae
MSLQSVNAIRFLGVDAINKSNSGHPGIVMGAAPMAYSLFTKHLRITPEQPNWINRDRFILSAGHGSMLLYALLHLTGYKDVSMDEIKNFRQWGSKTPGHPEVTHTSGVDATSGPLGQGISTAVGFAQAERFLAAKYNKDGFPIFDHYTYVIAGDGDFMEGVSAEAASYAGHQALDKLIVLYDSNDICLDGETKDTFSENVRARYDAYGWHTVLVEDGTDLAAISTAIETAKFSGKPSLIEVKTVIGYGSPNKSGTNAVHGAPLGAEETGATRKFLGWDYDPFEVPEEVYSDFKTNVADRGQEAYDAWASLVSDYKVAYPEVASEIDAIVAGKSPVTITEKDFPVYENGFSQATRNSSQDAINTAAAVLPTFLGGSADLAHSNMTYIKADGLQDKYNPLNRNIQFGVREFAMGTILNGMALHGGLRVYGGTFFVFSDYVKAAIRLSAIQELPVTYVFTHDSIAVGEDGPTHEPVEHLAGLRSMPNLTVIRPADARETQAAWHHALTSTTTPTVIVLTRQNLVVEEGTDFGKVAKGAYVVYDTPGFDTIIIATGSEVNLAIKAAKELVLQGGKVRVVSMPSTELFDAQDATYKEDILPSKTRRRVAIEMAATQSWYKYVGLDGAVIGIDIFGASAPAQTVIDNYGFTVENIVAQVKSL

SEQ ID NO: 3259 - protein, 190 aa, Streptococcus pneumoniae; identical to SEQ ID NO: 2680

SEQ ID NO: 3260 - protein, 190 aa, Streptococcus pneumoniae; identical to SEQ ID NO: 2680

SEQ ID NO: 3261 - protein, 277 aa, Streptococcus pneumoniae
MTEFSLDLLLKAIKLARSTYYYHLKQLDKTDKDQELKAEIQSIFIEHKGNYAYHRIYLELRNRGYLVNHKRVQGLIKVLNLQAKMRQKRKYSSHKGDVGKKAENLIQGQFEGSKTMEKCYTDVTEFAIPASTQKLYLLPVLDGFNSEIIAYNLSTSPNLEQVQTMLEQAFTEKHYENTILHSDQGWQYQHDSYHRFLESKGIQASMSRKGNSPDNGMMESFFGILKSEMFYGYEKNFRSLENLEQAIVDYIDYYNNKRIKVKLKGLSLVQYRTKSFG

SEQ ID NO: 3262 - protein, 176 aa, Streptococcus pneumoniae
LLDEKRKNYVEDKRQNFPSLPNWKMDLFSEEEKRNYFQTTCEISSKDSAINKYKMEKIIKRSNKGNVYRAIRKSDGQKVIIKQSRPFVNYDAEGEWTALDDIKNEAHMLKKLADKSYTTNLTDEFYIVDDYFLVQEQVDGLNFEEFIRETEHSLNIREKTLYNIVNIVSDIHKLGI

SEQ ID NO: 3263 - protein, 138 aa, Streptococcus pneumoniae
MDLLEKECLKCDKNFQQGDIWNYYYLSDKVPAQGWKIHISSQIKDAVNIFKIVYKLSQLNNCSFKVVKNLEELKKINSPREMSPTANKFITLYPKSESEAKSMICNLTNRLSEFKAPKILSDYQCGMHSLVHYRYGAF

SEQ ID NO: 3264 - protein, 225 aa, Streptococcus pneumoniae
MISKRLELVASFVSQGAILLDVGSDHAYLPIELVERGQIKSAIAGEVVEGPYQSAVKNVEAHGLKEKIQVRLANGLAAFEETDQVSVITIAGMGGRLIARILEEGLGKLANVERLILQPNNREDDLRIWLQDHGFQIVAESILEEAGKFYEILVVEAGQMKLSASDVRFGPFLSKEVSPVFVQKWQKEAEKLEFALGQIPEKNLEERQVLVDKIQAIKEVLHVSK

SEQ ID NO: 3265 - protein, 265 aa, Streptococcus pneumoniae
MLASEVIQAYEAFCPQEFSMEGDSRGLQIGTLDKGIQRVMVALDIREETVAEAIEKGVDLIIVKHAPIFRPIKDLLASRPQNQIYIDLIKHDIAVYVSHTNIDIVENGLNDWFCQMLGIEETTYLQETGPERGIGRIGNIQPQTFWELAQQVKQVFDLDSLRMVHYQENDLQKPISRVAICGGSGQSFYKDALAKGADVYITGDIYYHTAQDMLSDGLLALDPGHYIEVLFVEKIAALLTQWKEKKGWELEILPSQASTNPFRHI

SEQ ID NO: 3266 - protein, 367 aa, Streptococcus pneumoniae
MKKVAIIGAGIVGATAAYYLSRESDLEVTVFDHEQGQATKAAAGIISPWFSKRRNKAWYKMARLGADFYVDLLADLEKSGQKIDFYQRSGVFLLKKDESKLEELYQLALQRREESPLIGQLAILDQASANELFPGLQGFDRLLYASGGARVDGQLLVTRLLEASHVKLVKEKVTLTLLSSGYQIGEEVFDQVILATGAWLGDMLEPLGYEVDVRPQKGQLRDYQLAQDMEAYPVVMPEGEWDLIPFAGGKLSLGATHENDMGFDLTVDEPLLQQMEEAALPHYPVLARATSRAERVGIRAYTSDFSPFFGQVPELAGVYAGSGLGSSGLTTGPIIGYHLAQLIQDKELTLDPLNYPIENYVKRVKSE

SEQ ID NO: 3267 - protein, 63 aa, Streptococcus pneumoniae
MKIKEQTRKLAAGYSKHCFEVVDRTDEVSSKHCFEVVDRTDEVSNHTHGKATLTWFELDFRRV

SEQ ID NO: 3268 - protein, 339 aa, Streptococcus pneumoniae
MQEKILVTGGAGFIGTHTVIELIQAGHQVVVVDNLVNSNRKSLEVVERITGVEIPFYEADIRDTDTLRDIFKQEEPTGVIHFAGLKAVGESTRIPLAYYDNNIAGTVSLLKAMEENNCKNIIFSSSATVYGDPHTVPILEDFPLSVTNPYGRTKLMLEEILTDIYKADSEWNVVLLRYFNPIGAHESGDLGENPNGIPNNLLPYVTQVAVGKLEQVQVFGDDYDTEDGTGVRDYIHVVDLAKGHVAALKKIQKGSGLNVYNLGTGKGYSVLEIIQNMEKAVGRPIPYRIVERRPGDIAACYSDPAKAKAELGWEAELDITQMCEDAWRWQSKHPNGFED

SEQ ID NO: 3269 - protein, 317 aa, Streptococcus pneumoniae
MMISIIVPCLNEEEVLPLFYQALEALLPDLETEIEYVFVDDGSSDGTLELLKAYREQNPAVHYISFSRNFGKEAALYAGLQYATGDLVVVMDADLQDPPSMLFEMKNVLDKNVDLDCVGTRRTSREGEPFFRSFCAVLFYRLMQKISPVALPSGVRDFRMMRRSVVDAILSLTESNRFSKGLFAWVGFKTHYLDYPNVERQAGKTSWSFRQLFFYSIEGIVNFSDFPLTIAFVAGLLSCFLSLLMTFFVVVRTLILGNPTSGWTSLMAVILFLGGIQLLTIGILGKYISKIYLETKKRPLYLIKEKSDDRLKKIEFI

SEQ ID NO: 3270 - protein, 221 aa, Streptococcus pneumoniae
MLSKEDYTEEIGLIKKQNYVEAELYPIVADIIKPTLKDSLSKRYVFGRQRRGLGQIYYGLSNFPDIVILDKTYENKSRKSIKIEEWKKLRGCVEVKNLNYSLITEEKIKSTISNSFEHITGEMEQLTGEMGQLIGDLLWYKKVIYTNGIEWRFLSLDDKEEIDNTIVEVVNKRIETEEAGNSFDWWKNIKDLSFNYTDICLSKDCRQEWNEFVKRVKEIEW

SEQ ID NO: 3271 - protein, 68 aa, Streptococcus pneumoniae
MKITLIPERCIACGLCQTYSDLFDYHDNGIVRFYDDPDQLEKEISPSQDVLEAVKNCPTRALIGNQEA

SEQ ID NO: 3272 - protein, 158 aa, Streptococcus pneumoniae
MAKEPWQEDIYDQEESRAGRRHRNHGGADRMANRILTILASIFFVIVVVMVIVLIYLSSGGSNRTAALKDFHDSDASVVQISSSSSSQPEQSSEPESTSSSSEEAANPEGTIKVLAGEGEAAIAARAGISIAQLEALNPGHMATGSWFANPGDVIKIK

SEQ ID NO: 3273 - protein, 223 aa, Streptococcus pneumoniae
MKTIQIAIDGPASSGKSTVAKIIAKDFGFTYLDTGAMYRAATYMALKNQLGVEEVEALLALLDQHPISFGRSETGDQLVFVGDVDITHPIRENEVTNHVSAIAAIPQVREKLVSLQQEIAQQGGIVMDGRDIGTVVLPQAELKIFLVASVDERAERRYKENIAKGIETDLETLKKEIAARDYKDSHRETSPLKQAEDAVYLDTTGLNIQEVVEKIKAEAEKRM

SEQ ID NO: 3274 - protein, 112 aa, Streptococcus pneumoniae
MNNLPNCPKCNSEYVYEDGALLVCPECAHEWNPAEVAEVEEGLVAIDANGNKLADGDIVTLIKDLKVKGAPKDLKQGTRVKNIRIVEGDHNIDCKIDGFGAMKLKSEFVRKI

SEQ ID NO: 3275 - protein, 209 aa, Streptococcus pneumoniae
MSKHYKLVFYSRIFLFLAAFTGVYLEITRHGGFGMLLYYTVLSNLLVTIFTLYLLKVMSRVGENWQRPSLLRLKGGVTMSIMITCVIYHFLLAPIATNFYTLENFLCHYIVPIWFLADTLFFDKQGQYKIWDPAVWTILPFLYMMFALFNGLVLKLNIPNAKDNPFPYFFLNVNKGWNVVFKWCLIIFVAYMVAGFIFYFIKQIKRKSS

SEQ ID NO: 3276 - protein, 75 aa, Streptococcus pneumoniae
VVSDYLCCLYGSRIYFLLYQANQEKVILILFENLFKPRQFPSATSKHCFEQPAASFLVCSLIFIEYKIQGIHFRI

SEQ ID NO: 3277 - protein, 383 aa, Streptococcus pneumoniae
MKQFLERASILALSLVLITSFSISSALPAMFDYYQGYSKEQIELLVSLPSFGIMMMLLLNGFLEKIFPERLQISLGLLILSLSGTAPFWYQAYPFVFGTRLLFGLGLGMINAKAISIISERYQGKRRIQMLGLRASAEVVGASIITLAVGQLLAFGWTAIFLAYSAGFLVLPLYLLFVPYGKSKKEVKKRAKEASRLTREMKGLIFTLAIEAAVVVCTNTAITIRIPSLMVERGLGDAQLSSFVLSIMQLIGIVAGVSFSFLISIFKEKLLLWSGITFGLGQIVIALSSSLWVVVAGSVLAGFAYSVVLTTVFQLVSERIPAKLLNQATSFAVLGCSFGAFTTPFVLGAIGLLTHNGMLVFSILGGWLIVISIFVMYLLQKRA

SEQ ID NO: 3278 - protein, 249 aa, Streptococcus pneumoniae
MTRYKATISYDGYAFDGFQRQPHARSVQEEIEKTLTRLNKGQTITVHGAGRTDSGVHALGQVIHFDLPYQMDEEKLRFALDTQSPEDIDVISIELVADDFHCRYAKHSKTYEFIVDRGRPKNPMRRHYATHFPYPLDVERMQIAIKKLEGTHDFTGFTASGTSVEDKVRTITEASLIVDETGQFLTFTFSGNGFLYKQIRNMVGTLLKIGNNRMPVEQIALILEKKDRQLAGPTAAPNGLYLKEIRYEE

SEQ ID NO: 3279 - protein, 257 aa, Streptococcus pneumoniae
MKNNRILALSGNDIFSGGGLSADLATYTLNGLHGFVAVTCLTALTEKGFEVFPTDDTIFQHELDSLRDVEFGGIKIGLLPTVSVAEKALDFIKQRPGVPVVLDPVLVCKETHDVAVSELCQELIRFFPYVSVITPNLPEAELLSGQEIKTLEDMKTAAQKLHDLGAPAVIIKGGNRLSQDKAVDVFYDGQTFTILENPVIQGQNAGAGCTFASSIASHLVKGDKFLPAVESSKAFVYRAIAQADQYGVRQYEANKNN

SEQ ID NO: 3280 - protein, 153 aa, Streptococcus pneumoniae
MKQTKTTKIALVSLLTALSVVLGYFLKFPTPTGILTLLDAGVFFAAFYFGSREGAVVGGLASFLIDLLSGYPQWMFFSLVNHGLQGFFAGFKGKSQWLGLILATIAMVGGYALGSTLMNGWAAALPEILPNFMQNMVGMIVGFILSQSIKKIK

SEQ ID NO: 3281 - protein, 190 aa, Streptococcus pneumoniae; identical to SEQ ID NO: 2680

SEQ ID NO: 3282 - protein, 90 aa, Streptococcus pneumoniae
MTEFSLVLLLKAIKLARSTYYYHLKQLDKTDKDQELKAEIQSIFIEHKGNYAYRCIHLELRNRAYLVNHKRVQGLIKVLNLQAKMRQKRK

SEQ ID NO: 3283 - protein, 197 aa, Streptococcus pneumoniae
KYSIYKLKCDRNENKGDVGKKAENLIQGQFEGSKAMEKCYTDVTEFAIPASTQKLYLSPVLDGFNSEIIAYNLSTSPNLEQVKSMLEQAFTEKHYENTILHSDQGWQYRHDSYHRFLESKGIQASMSRKGNSPDNGMMESFFGILKSEMFYGFEKSFQSLKQLEQAIIDYIDYYNNKRIKVKLKGLIPVQYRTKSFG

SEQ ID NO: 3284 - protein, 158 aa, Streptococcus pneumoniae
MKWTALPVRSSKKLVMVSTSTTVSGMVSVWMSMNSHLSWKETTWSSKKACASLLNQVSISLVKSVFVLKTAVLLPRMASTSLQAPAKICFILIKLYSPYAFLSKYLGAILLSFFCYYAKEIGCNNLTLSVWNDNEGALRFYQRQGMKPQETTMEMIID

SEQ ID NO: 3285 - protein, 360 aa, Streptococcus pneumoniae
MSKLQQILTYLESEKLDVAVVSDPVTINYLTDFYSDPHERQMFLFVLADQEPLLFVPALEVERASSTVSFPVVGYVDSENPWQKIKHALPQLDFKRVAVEFDNLILTKYHGLKTVFETAEFDNLTPRIQRMRLIKSADEVQKMMVAGLYADKAVHVGFDNISLDKTETDIIAQIDFAMKREGYEMSFDTMVLTGDNAANPHGIPAANKVENDALLLFDLGVLVNGYASDMTRTVAVGKPDQFKKDIYNLTLEAQQAALDFIKPGVTAHEVDRAAREVIEKAGYGEYFNHRLGHGIGMDVHEFPSIMEGNDMVIEEGMCFSVEPGIYIPGKVGVRIEDCGVVTKDGFDLFTSTSKDLLYFD

SEQ ID NO: 3286 - protein, 260 aa, Streptococcus pneumoniae
MVYTSLSSKDGNYPYQLNIAHLYGNLMNTYGDNGNILMLKYVAEKLGAHVTVDIVSLHDDFDENHYDIAFFGGGQDFEQSIIADDLPAKKESIDNYIQNDGVVLAICGGFQLLGQYYVEASGKRIEGLGVMGHYTLNQTNNRFIGDIKIHNEDFDETYYGFENHQGRTFLSDDQKPLGQVVYGNGNNEEKVGEGVHYKNVFGSYFHGPILSRNANLAYRLVTTALKKKYGQDIQLPAYEDILSQEIAEEYSDVKSKADFS

SEQ ID NO: 3287 - protein, 447 aa, Streptococcus pneumoniae
MNLKTTLGLLAGRSSHFVLSRLGRGSTLPGKVALQFDKDILQNLAKNYEIVVVTGTNGKTLTTALTVGILKEVYGQVLTNPSGANMITGIATTFLTAKSSKTGKNIAVLEIDEASLSRICDYIQPSLFVITNIFRDQMDRFGEIYTTYNMILDAIRKVPTATVLLNGDSPLFYKPTIPNPIEYFGFDLEKGPAQLAHYNTEGILCPDCQGILKYEHNTYANLGAYICEGCGCKRPDLDYRLTKLVELTNNRSRFVIDGQEYGIQIGGLYNIYNALAAVAIARFLGADSQLIKQGFDKSRAVFGRQETFHIGDKECTLVLIKNPVGATQAIEMIKLAPYPFSLSVLLNANYADGIDTSWIWDADFEQITDMDIPEINAGGVRHSEIARRLRVTGYPAEKITETSNLEQVLKTIENQDCKHAYILATYTAMLEFRELLASRQIVRKEMN

SEQ ID NO: 3288 - protein, 438 aa, Streptococcus pneumoniae
MLTYDLIVIGFGKAGKTLAGKLASAGKKVALVERSKAMYGGTCINIGCIPTKTLLVAAEKDLSFEEVIATKNTITGRLNGKNYTTVAGTGVNIFDAEAHFLSNKVIEIQAGDEKQELTAETIVINTGAVSNVLPIPGLATSKNVFDSTGIQSLDKLPEKLGVLGGGNIGLEFAGLYNKLGSKVTVLDALDTFLPRAEPSIAALAKQYLEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 3289 - protein, 290 aa, Streptococcus pneumoniae
MKSNRYIIALAGVILHLMLGSTYAWSVYRNPIIEKTGWDQASVAFAFSLAIFCLGLSAAFMGRLVEKFGPKVMGSLSAFLYAGGNILTGFAIDRQELWLLYLAYGILGGLGLGAGYITPVSTIIKWFPDKRGLATGLAIMGFGFASLLTSPIAQHLIAGVWIVETFYILGASYFIIMLLASQFIKRPNEQELAILSSSGKEKTASLTQGMAANQALKSNRFYMLWIIFFINIPCGLGLISAASPMAQEMAGLSTSHAAVMVGVLGIFNGFGRLLWASLSDYIGPPLTFNI

SEQ ID NO: 3290 - protein, 81 aa, Streptococcus pneumoniae
LIPAILSDILRTKELAALHGYILTAWTMAGLARPILLAETYKMAHSYTQTLFVFLILYSIALALSYYLGRSIKKESQKPLT

SEQ ID NO: 3291 - protein, 524 aa, Streptococcus pneumoniae
VKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 3292 - protein, 262 aa, Streptococcus pneumoniae
MAHLLEKTRKITSILKRSEEQLQDELPYNAITRQLADIIHCNACIINSKGRLLGYFMRYKTNTDRVKQFFQTKIFPDDYVQGANMIYETEANLPVEHDMSIFPVESRDDFPDGLTTIAPIHVSGIRLGSLIIWRNDKKFEDEDLVLVEIASTVVGIQLLNFQREEDEKNIRRRTAVTMAVNTLSYSELRAVSAILGELNGNEGKLTASVIADRIGITRSVIVNALGKLEYAGIIESRSLGMKGTYLKVLISDIFEEVKKRDH

SEQ ID NO: 3293 - protein, 68 aa, Streptococcus pneumoniae
DFVADSGKLTAGAPAQAISDAISKVSLLAFEREDHIFFTIDAHEEIDCFHPESKLFPPHNLLGTSGRN

SEQ ID NO: 3294 - protein, 151 aa, Streptococcus pneumoniae
LLNEKIISSLQLMLMKKSIVSIRKVSYFLLIISLGRVDGIKMEIWGSFIKSNGSDSRVIWMDKRHYSAFSGTDLDIRLRERRVSTVILTGVLTDICVLHTAIDAYNLGYDIEIVKPAVASIWPENHQFALGHFKNTLGAKLVDENLNELSE

SEQ ID NO: 3295 - protein, 77 aa, Streptococcus pneumoniae
MVELNLKNIYKKYPNSEHYSVEDFNLNIKDKEFIVFVGPSGCGKSTTLRMIAGLEDITEGTASIDGVVVNDVAPKDQ

SEQ ID NO: 3296 - protein, 51 aa, Streptococcus pneumoniae
LTTTPSIDAVPSVMSSRPAIIRSVVDLPHPEGPTKTINSLSLMFKLKSSTE

SEQ ID NO: 3297 - protein, 284 aa, Streptococcus pneumoniae
LFIDNMAFGLKLRKYSKEDINKRVQEAAEILGLKEFLERKPADLSGGQRQRVAMGRAIVRDAKVFLMDEPLSNLDAKLRVSMRAEIAKIHRRIGATTIYVTHDQTEAMTLADRIVIMSATKNPAGTGTIGRVEQIGTPQEVYKNPVNKFVAGFIGSPAMNFINVKLVGSEIVSDGFRLKVPEGALKVLREKGYEGKELIFGIRPEDVNAEPAFLETFPDCVVKATISVSELLGSESHLYCQVGKDEFVAKVDARDYLQTGATVELGFDLNKAHFFDVETEKTIY

SEQ ID NO: 3298 - protein, 252 aa, Streptococcus pneumoniae
MSEAGHKFLAKLGKKRLRPGGKRATDWLIAEGGLSKEKRILEVACNRGTTAIELAQRFGCKITAVDMDAQALEVAKKSAGTAGVAHLISFERANAMKLPYQDASFDIVINEAMLTMQADQAKKKCVMEYLRVLKPGGLLLTHDVLLKEAKESIRQELSQAIHVNVGPLTQDGWEQVMIESGYCDVKVLTGEMTLMKLSGMIYDEGWLGTLKICVNACKKENRKQFLTMYKMFAKNKQKLGFIAMASYKSSKR

SEQ ID NO: 3299 - protein, 176 aa, Streptococcus pneumoniae
LKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 3300 - protein, 314 aa, Streptococcus pneumoniae
MPIRIDKKLPAVEILRTENIFVMDDQRAAHQDIRPLKILILNLMPQKMVTETQLLRHLANTPLQLDIDFLYMESHRSKTTRSEHMETFYKTFPEVKDEYFDGMIITGAPVEHLPFEEVDYWEEFRQMLEWSKTHVYSTLHICWGAQAGLYLRYGVEKYQMDSKLSGIYPQDTLKEGHLLFRGFDDSYVSPHSRHTEISKEEVLNKTNLEILSEGPQVGVSILASRDLREIYSFGHLEYDRDTLAKEYFRDRDAGFDPHIPENYFKDDDVNQVTCLCWSSSAALFFSNWVNHAVYQETPFDWRKIEDDASAYGYL

SEQ ID NO: 3301 - protein, 225 aa, Streptococcus pneumoniae
MTYLDAFKSGTLVLPSALLLHFKELFPSSDDFLVWQFFYLQNTTGLEEMSPSQIAERIGKEISDVNQSISNLTERGLLQYRTIELNGEIELLFDASLALERLDDLFGAVHSSSDQLTPQNQLKDLVETFQQELGRLLTPFEIEDLTKTLKEDGTSADLIKEALREAVLNGKPNWKYIQAILRNWRHEGIKSVAQIEAKRAEREASNPQLTQVSADFRNAMDLWKD

SEQ ID NO: 3302 - protein, 124 aa, Streptococcus pneumoniae
LFIFQLPAINGLRDISHTSFFNLFSIYSITIIHSLQILLGFQAYLHGLILPEIHGISEICRYLCQLRIACFSFCSLGLNLSHTLDSFMAPVSQNRLNVLPVWFSIQNSFTKSLLNQVSTGSIFL

SEQ ID NO: 3303 - protein, 252 aa, Streptococcus pneumoniae
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 3304 - protein, 501 aa, Streptococcus pneumoniae
MSVTFFIGEQRLKTKIGLASICLLGLATSHVAANETEVAKTSQDTTTASSSSEQNQSSNKTQTSAEVQTNAAAHWDGDYYVKDDGSKAQSEWIFDNYYKAWFYINSDGRYSQNEWHENYYLKSGGYMAQNEWIYDSNYKSWFYLKSDGAYAHQEWQLIGNKWYYFKKWGYMAKSQWQGSYFLNGQGAMMQNEWLYDPAYSAYFYLKSDGTYANQEWQKVGGKWYYFKKWGYMARNEWQGNYYLTGSGAMATDEVIMDGARYIFAASGELKEKKDLNVGWVHRDGKRYFFNNREEQVGTEHAKKIIDISEHNGRINDWKKVIDENEVDGVIVRLGYSGKEDKELAHNIKELNRLGIPYGVYLYTYAENETDAENDAKQTIELIKKYNMNLSYPIYYDVENWEYVNKSKRAPSDTDTWVKIINKYMDTMKQAGYQNVYVYSYRSLLQTRLKHPDILKHVNWVAAYTNALEWENPYYSGEKGWQYTSSEYMKGIQGRVDVSVWY

SEQ ID NO: 3305 - protein, 172 aa, Streptococcus pneumoniae
MVELKKEAVKDVTSLTKAAPVALAKTKEVLNQAVADLYVAHVALHQVHWYMHGRGFLVWHPKMDEYMEALDGQLDEISERLITLGGSPFSTLTEFLQNSEIEEEAGEYRNVEESLERVLVIYRYLSELFQKGLDVTDEEGDDVTNGIFAGAKTETDKTIWMLAAELGQAPGL

SEQ ID NO: 3306 - protein, 212 aa, Streptococcus pneumoniae
MNVSDNHFIKVRFKSLKNLLPTDNVEILFLSLIPVKNRLDVLKSSNPIYLFFRITRQNQGFPFWKQATPHPIKGHTPHQDSMIQSCFFKVLQFCWQMPRQTIFLTNHTLFILGPNSYDFLSHASILFTDSTILSKNSKKDWFGIAYKIEKICKKFPTDLSMFPYFLQTRCLSKFGCKHPNCFICFSFSACKDTVCHIVTFFISDIQTFLEKF

SEQ ID NO: 3307 - protein, 168 aa, Streptococcus pneumoniae
MTKKIVAIWAQDEEGVIGKENRLPWHLPAELQHFKETTLNHAILMGRVTFDGMGRRLLPKRETLILTRNPEEKIDGVATFQDVQSVLDWYQAQEKNLYIIGGKQIFQAFEPYLDEVIVTHIHARVEGDTYFPEELDLSLFETVSSKFYAKDEKNPYDFTIQYRKRKEV

SEQ ID NO: 3308 - protein, 68 aa, Streptococcus pneumoniae
FYHPIPQEKGSLMERSLFGLFTAFLCFICFLAGAQAFRKKRYGLSILLWLNAFTNLVNSIHAFYMTLF

SEQ ID NO: 3309 - protein, 410 aa, Streptococcus pneumoniae
MSTNRKNDMMVYCSFCGKNQEEVQKIIAGNNAFICNECVELAQEIIREELVEEVLADLSEVPKPIELLHILNHYVIGQDRAKRALAVAVYNHYKRINFHDTREESEDVDLQKSNILMIGPTGSGKTFLAQTLAKSLNVPFAIADATALTEAGYVGEDVENILLKLLQVADFNIERAERGIIYVDEIDKIAKKSENVSITRDVSGEGVQQALLKIIEGTVASVPPQGGRKHPQQEMIQVDTKNILFIVGGAFDGIEEIVKQRLGEKVIGFGQNNKAIDENSSYMQEIIAEDIQKFGIIPELIGRLPVFAALEQLTVDDLVRILKEPRNALVKQYQTLLSYDDVELEFDDEALQEIANKAIERKTGARGLRSIIEETMLDVMFEVPSQENVKLVRITKETVDGTDKPILETA

SEQ ID NO: 3310 - protein, 195 aa, Streptococcus pneumoniae
MELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 3311 - protein, 126 aa, Streptococcus pneumoniae
MAKTIHTDKAPKAIGPYVQGKIVGNLLFASGQVPLSPETGEIVGENIQEQTEQVLKNIGAILAEAGTDFDHVVKTTCFLSDMNDFVPFNEVYQTAFKEEFPARSAVEVARLPRDVKVEIEVIAEIG

SEQ ID NO: 3312 - protein, 296 aa, Streptococcus pneumoniae
MTKKQLHLVIVTGMSGAGKTVAIQSFEDLGYFTIDNMPPALLPKFLQLVEIKEDNPKLALVVDMRSRSFFSEIQAVLDELENQDGLDFKILFLDAADKELVARYKETRRSHPLAADGRILDGIKLERELLAPLKNMSQNVVDTTELTPRELRKTLAEQFSDQEQAQSFRIEVMSFGFKYGIPIDADLVFDVRFLPNPYYLPELRNQTGVDEPVYDYVMNHPESEDFYQHLLALIEPILPSYQKEGKSVLTIAMGCTGGQHRSVAFAKRLVQDLSKNWSVNEGHRDKDRRKETVNRS

SEQ ID NO: 3313 - protein, 325 aa, Streptococcus pneumoniae
MRKPKITVIGGGTGIPVILKSLREKDVEIAAIVTVADDGGSSGELRKNMQQLTPPGDLRNVLVAMSDMPKFYEKVFQYRFSEDAGAFAGHPLGNLIIAGLSEMQGSTYNAMQLLSKFFHTTGKIYPSSDHPLTLHAVFQDGTEVAGESHIVDHRGIIDNVYVTNALNDDTPLASRRVVQTILESDMIVLGPGSLFTSILPNIVIKEIGRALLETKAEIAYVCNIMTQRGETEHFTDSDHVEVLHRHLGRPFIDTVLVNIEKVPQEYMNSNRFDEYLVQVEHDFVGLCKQVSRVISSNFLRLENGGAFHDGDLIVDELMRIIQVKK

SEQ ID NO: 3314 - protein, 303 aa, Streptococcus pneumoniae
MSFTVAVKEEILGQHHLSWHELSAIIKMSGSIGLSTSGLTLSVVTENAKLARHLYESFLHFYEIKSEIRHHQRSNLRKNRVYTVFTDEKVQDLLSDLHLADSFFGLETGIDEAILSDEEAGRAYLCGAFLANGSIRDPESGKYQLEISSVYLDHAQGIASLLQQFLLDAKVLERKKGAVTYLQRAEDIMDFLIVIGAMQARDDFERVKILRETRNDLNRANNAETANIARTVSASMKTINNISKIKDIMGLENLPVDLQEVAQLRIQHPDYSIQQLADSLSTPLTKSGVNHRLRKINKIADEL

SEQ ID NO: 3315 - protein, 322 aa, Streptococcus pneumoniae
MSQLYDITIVGGGPVGLFAAFYAHLRQAKVQIIDSLPQLGGQPAILYPEKEILDVPGFPNLTGEELTNRLIEQLNGFDTPIHLNETVLEIDKQEEEFAITTSKGSHLTKTVIIAMGGGAFKPRPLELEGVEGYENIHYHVSNIQQYAGKKVTILGGGDSAVDWALAFEKIAPTTLVHRRDNFRALEHSVQALQESSVTIKTPFAPSQLLGNGKTLDKLEITKVKSDETETIDLDHLFVNYGFKSSVGNLKNWGLDLNRHKIIVNSKQESSQAGIYAIGDCCYYDGKIDLIATGLGEAPTAVNNAINYIDPEQKVQPKHSTSL

SEQ ID NO: 3316 - protein, 271 aa, Streptococcus pneumoniae
LFASPWTIAINLIDILIVAYILYHFTKGIAGTKIMILVRGVLVFILAQILANMIGLTTIYWLFNQIITYGVIAAVVIFSPEIRTGLERLGRATDFFSNAPISAEEQMIRAFVKSVEYMSPRKIGALVAIQRVRTLQEYISTGIPLDAKISAELLINIFIPNTPLHDGAVIIKEERIAVTSAYLPLTKNTGISKEFGTRHRAAIGLSEVSDALTFVVSEETGGISITYNGRFKHNLTLDEFETELREILLPKEEVGLSFKERWLGGWKHEKK

SEQ ID NO: 3317 - protein, 259 aa, Streptococcus pneumoniae
MKKNSLYIISSLFFACVLFVYATATNFQNSTSARQVKTETYTNTVTNVPIDIRYNSDKYFISGFASEVSVVLTGANRLSLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 3318 - protein, 63 aa, Streptococcus pneumoniae
FVFELVAFVDEDVSDELLVLEFDVLELGATGFVVTFIIVSNGVITAGKTTPLRSIACKGTEPL

SEQ ID NO: 3319 - protein, 450 aa, Streptococcus pneumoniae
MGKYFGTDGVRGEANLELTPELAFKLGRFGGYVLSQHETEAPKVFVGRDTRISGEMLESALVAGLLSVGIHVYKLGVLATPAVAYLVETEGASAGVMISASHNPALDNGIKFFGGDGFKLDDEKEAEIEALLDAEEDTLPRPSAEGLGILVDYPEGLRKYEGYRVSTGTPLDGMKVALDTANGAASTSARQIFADLGAQLTVIGETPDGLNINLNVGSTHPEALQEVVKESGSAIGLAFDGDSDRLIAVDENGDIVDGDKIMYIIGKYLSEKGQLAQNTIVTTVMSNLGFHKALNREGINKAVTAVGDRYVVEEMRKSGYNLGGEQSGHVILMDYNTTGDGQLSAVQLTKIMKETGKSLSELAAEVTIYPQKLVNIRVENVMKEKAMEVPAIKAIIEKMEEEMAGNGRILVRPSGTEPLLRVMAEAPTTEEVDYYVDTITDVVRAEIGID

SEQ ID NO: 3320 - protein, 120 aa, Streptococcus pneumoniae
VNKNLLVSIILMRVYFEWENENGAPETKVDVNFQLLQHDQENQVTSLIVILSFMIVFDKFVISGTISQVNHIDGRIVNEPSELNQEEVETLARPCLNMLNRLTYEVTEIALDLPGINLEF

SEQ ID NO: 3321 - protein, 282 aa, Streptococcus pneumoniae
MKLAVFTDSSAYLSEETLQREDLFVLDIPVNIDGEEYVEGINLSAEEFYQKMAQASELPKTSQPSIAKLDEILTSLKEQGYTHALGLFLSSGISGFYQNIQYMVDDYEGLTIAFPDTLITSAPLGIMVESVFNWRDQGDDFASIQDKLAIQISRTSAFIMVDDLDHLVKGGRLSNGAAILGNLLSIKPILYFNDQGVIEVYEKVRTEKKATKRLIEIIKETTASGQYRVIVIHGNAPEKAEELRQHLLDFGLGSDVSLATFGSVIGTHLGAGSIALGYIPVI

SEQ ID NO: 3322 - protein, 255 aa, Streptococcus pneumoniae
MSIRVIIAGFKGKMGQAACQMVLTDPDLDLVAVLDPFESESEWQGIPVFKDKADLAGFEADVWVDFTTPAVAYENTRFALENGFAPVVGTTGFTSEEIAELKEFSRAQDLGGLIAPNFALGAVLLMQFATQAAKYFPNVEIIELHHDKKKDAPSGTAIKTAELMAEVRESIQQGAADEEELIAGARGADFDGMRIHSVRLPGLVAHQEVIFGNQGEGLTLRHDSYDRISFMTGVNLGIKEVVKRHELVYGLEHLL

SEQ ID NO: 3323 - protein, 399 aa, Streptococcus pneumoniae
MRLTQMPSEFQKALPVLEKIKEAGFEAYFVGGSVRDALLHSPIHDVDIATSSYPEETKQIFPRTADIGIEHGTVLVLDGDEEYEVTTFRTEDVYVDYRRPSAVSFVRSLEEDLKRRDFTVNAFALDETGEIVDLFHGLEDLEKQVLRAVGVASERFNEDALRIMRGFRFQASLGFALEPETFKAMKTLTPLLEKISVERTFVEFDKLLLAPFWRRGLASMIESQAYDYLPDMASSQDKLNRLFDLETDFTFESSEQAWAALLWALEIENAQSFLKSWKTSRQFAKQVQDLLIILALRENGELSKRDCYRFDIDLLLQAENLRQAQGKEVNPQAITEKYQSLTIHDKKEIQINGGILIKEYGYQPGPDLGEILTEIEFAIVDGELENNREAIHAYLREKK

SEQ ID NO: 3324 - protein, 623 aa, Streptococcus pneumoniae
MSDFIVEKLSKSVGDKTVFRDISFIIHDLDRIGLIGVNGTGKTTLLDVLSGVSGFDGDVSPFSAKNDYQIGYLTQDPDFDDRKTVLDTVLSSELKEIQLIREYELIMLDYSEDKQARLERVMAEMDSLQAWEIESQVKTVLSKLGIQDLSTPVGELSGGLRRRVQLAQVLLGNHDLLLLDEPTNHLDIAIIEWLTLFLKNSKKTVLFITHDRYFLDALSTRIFELDRAGLTEYQGNYQDYVRLKAEQDERDAALLHKKEQLYKQELAWMRRQPQARATKQQARINRFHDLKKEVSGSSAETDLTMNFETSRIGKKVIEFQAVSFAYENKPILQNFNLLVQAKDRIGIVGDNGVGKSTLLNLIAGSLEPTAGQVVIGETVRIAYFSQQIEGLDESKRVINYLQEVAEEVKTSGGSTTSIAELLEQFLFPRSTHGTLIEKLSGGEKKRLYLLKLLLEKPNVLLLDEPTNDLDIATLTVLENFLQGFAGPVLTVSHDRYFLDKVATKILAFEDGKIRPFFGHYTDYLDEKAFETDMANQVQKAEKEKVVKVREDKKRMTYQEKQEWASIEGDIETLEKRIAAIEEEMQANGSDFGKLATLQKELDEKNEALLEKYERYEYLSEFDS

SEQ ID NO: 3325 - protein, 143 aa, Streptococcus pneumoniae
LHFDFRIVLTIKFTEILIAFVFFKECFIFLIQFFLESSQLTKVRAVSLHFLFNSSDTFFQGFNITFNTCPLLLFLVGHAFLVFSNLDHFFLFGLLHLIGHICFKSFFIKIVGVMTKERTNLAILKSENLGRYLIQEIAVVTDC

SEQ ID NO: 3326 - protein, 393 aa, Streptococcus pneumoniae
MKHLSKSKLAERGAIISISTYLILSAAKLAAGHLLHSSSLVADGFNNVSDIIGNVALLIGIRMARQPADRDHRFGHWKIEDLASLITSIIMFYVGFDVLRDTIQKILSREETVIDPLGATLGIISAAIMFVVYLYNTRLSKKSNSKALKAAAKDNLSDAVTSLGTAIAILASSFNYPIVDKLVAIIITFFILKTAYDIFIESSFSLSDGFDDRLLEDYQKAIMEIPKISKVKSQRGRTYGSNIYLDITLEMNPDLSVFESHEIADQVESMLEERFGVFDTDVHIEPAPIPEDEILDNVYKKLLMREQLIDQGNQLEELLTDDFVYIRQDGEQMDKEAYKTKKELNSAIKDIQITSISQKTKLICYELDGIIHTSIWRRHETWQNIFHQETKKE

SEQ ID NO: 3327 - protein, 898 aa, Streptococcus pneumoniae
MSKEQKRQAFYTQSPEEVLQAVDATEQGLSSSEAEKRLAEFGHNELEEGEKRSILVKFIEQFKDLMIIILVAAAILSVVTSGGEDIADAIIILAVVIINAAFGVYQEGKAEEAIEALKSMSSPVARVLRDGHMAEIDSKELVPGDIVALEAGDVVPADLRLLEANSLKIEEAALTGESVPVEKDLSVELATDAGIGDRVNMAFQNSNVTYGRGMGVVVNTGMYTEVGHIAGMLQDADETDTPLKQNLNNLSKVLTYAILVIALVTFVVGVFIQGKNPLGELLTSVALAVAAIPEGLPAIVTIVLSLGTQVLAKRHSIVRKLPAVETLGSTEIIASDKTGTLTMNKMTVEKVFYDAVLHDSADDIELGLEMPLLRSVVLANDTKIDVEGNLIGDPTETAFIQYALDKGYDVKGFLEKYPRVAELPFDSDRKLMSTVHPLPDGRFLVAVKGAPDQLLKRCLLRDKAGDIAPIDEKVTNLIHTNNSEMAHQALRVLAGAYKIIDSIPENLTSEELENDLIFTGLIGMIDPERPEAAEAVRVAKEAGIRPIMITGDHQDTAEAIAKRLGIIDANDTEDHVLTGAELNELSDEDFEKVVGQYSVYARVSPEHKVRIVKAWQKQGKVVAMTGDGVNDAPALKTADIGIGMGITGTEVSKGASDMILADDNFATIIVAVEEGRKVFSNIQKTIQYLLSANTAEVLTIFLSTLFGWDVLQPVHLLWINLVTDTFPAIALGVEPAEPGVMNHKPRGRKASFFSGGVLSSIIYQGVLQAALVMSVYGLAIAYPVHVGDNHAIHADALTMAFATLGLIQLFHAYNVKSVYQSILTVGPFKSKTFNWSILVSFILLMATIVVEPLEGIFHVTKLDLSQWGIVMAGSFSMIIIVEIVKFIQRKLGFDKNAI

SEQ ID NO: 3328 - protein, 96 aa, Streptococcus pneumoniae
MLTRSPIPASVASSTDKSFSTGTDSPVKAASSILRELASSKRRSAGTTSPASRATISPGTNSLESISAMCPSRRTRATGLDMDLRASIASSAFPSW

SEQ ID NO: 3329 - protein, 82 aa, Streptococcus pneumoniae
IFEKTLRPSSTATIIVAKLSSARIISEAPLETSVPVIPIPIPMSAVFRAGASLTPSPVMATTLPCFCQALTIRTLCSGDTRA

SEQ ID NO: 3330 - protein, 263 aa, Streptococcus pneumoniae
MSAYQLPTVWQDEASNQGAFTGLNRPTVGARFEQNLPKGEQAFQLYSLGTPNGVKVTILLEELLEAGFKEAAYDLYKIAIMDGDQFGSDFVKLNPNSKIPALLDQSGTEDVRVFESAHILLYLAEKFGAFLPSNPVEKVEVLNWLFWQAGAAPFLGGGFGHFFNYAPEKLEYPINRFTMEVKRQLDLLDKELAQKPYIAGNDYTIADIAIWSWYGQLVQGNLYQGSAKFLDASSYQNLVKWAEKIANRPAVKRGLEVTYTEIK

SEQ ID NO: 3331 - protein, 151 aa, Streptococcus pneumoniae
YSKKQEECEEVEKKIVKDILFLSQVSQPASQEDLYLARDLQDTLLANHDTCVGLAANMIGVQKRVIIFNLGLVPVVMFNPVLLSFEGSYEAEEGCLSLVGVRSTKRYETTRLAYRDSKWQEQTISLTGFPAQIFQHELDHLEGPIIFEESQ

SEQ ID NO: 3332 - protein, 531 aa, Streptococcus pneumoniae
MKRIVFELIFIATTWYIFLPPLNLTSWEFLFFLCGHLLVVAILFGFGKGINLVKTVHVRHGKAEAALNLEGFKINRLGKILLASIGGILLLAALVSLVTSSMFQAKNYANVVTVTEKDFTEFPRSDTSKVPILDRSTAEKIGDRYLGSLTDKVSQYVAADTYTQLTIDGKPYRVTPLEYADPIKWFNNQAKGIGEYIKVDMVTGNADLVDLKTPIKYSDSEYFNRDVKRHLRLKYPTKIFKTPSFEVDDEGNPFYVATVYQKQFGLAVPRPASVIILDATNGETKEYSLSDVPEWVDRIYPAEETIEQINYNGKYKDGFLNAMISKKNVTQTTKGYNYLSIGNDIYLYTGVTSANADESNLGFILENMRTGEITKYSLASATEESARESAEGAVQEKSYKATFPILINLNDKPLYIMGLKDNAGLVKEYALVDAVEYQNVIVATTVEEMLSKYANKNDLEIDNATTESINGVVADLKSAVIKGDTVYFFKVDGKIYKVKASVSDDLPYLENGKTFEGQVGKDNYLKTFKLR

SEQ ID NO: 3333 - protein, 59 aa, Streptococcus pneumoniae
MEDKEMGFYLMVASMLLGLLALKIGFSQFKEKKDKFLSILTSLAGTRLVLVAVWLGWPK

SEQ ID NO: 3334 - protein, 242 aa, Streptococcus pneumoniae
MKILIPTAKEMNTDLPSIEAISLTPESQAVLDALALYSASQLESFYKVSAEKAAEEFQKYPSFEKADYSPYPALILFDGLMYRNIKRDKLTEAEQDYLENHVFITSALYGVVPALSPMAPHRLDFLMKLKVAGKTLKSHWKAVYDEALKMEEVIFSLLSSEFETVFSKEIRAKMVTFNFMEDRERSLKIHSTISKKARGAFLTALIENQVQTVGEARRLNFAGFVYREDLSQPQGLVFVKEV

SEQ ID NO: 3335 - protein, 209 aa, Streptococcus pneumoniae
LQVVLLWCNIFYNNEKILVNLRKRRHIMSKKVLFIVGSLRQGSFNHQMALEAEKALAGKAEVSYLDYSALPLFSQDLEVPTHPAVAAAREAVLAADAIWIFSPVYNFSIPGTVKNLLDWLSRALDLSDTRGASALQDKFVTVSSVANAGHDQLFAIYKDLLPFIRTQGVGDFTAARVNDSAWADGKLVLEETVLNSLEKQAQDLIEAIK

SEQ ID NO: 3336 - protein, 162 aa, Streptococcus pneumoniae
VKKRQNKAKNNLLWQYGLGMTILFVVISASFLYMVSLSMKPYQTAKSEGEKLAQQYAGLEQADQVDLYNGLESYYSVLGRNKQQEALAVLIGKDDHKIYVYQLNQGVSQEKAETVSKEKGAGEIDKIIFGRYQDKPIWEVKSGSDFYLVDFETGALVNKEGL

SEQ ID NO: 3337 - protein, 395 aa, Streptococcus pneumoniae
MKLSNRVLEMEESVTLAAGARAKALKAEGRDILSLTLGEPDFTTPKNIQDAAIASIRDGRASFYTVTSGLPELKAVVNSYFERFYGYSVAPNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEKRLNTIYPLLAEVPGFEVVKPQGAFYLFPNVKKAMEMKGYTDVTDFTTAILEEAEVALVTGAGFGAPENVRLSYATDLDTLKEAVERLKAFMGSEND

SEQ ID NO: 3338 - protein, 123 aa, Streptococcus pneumoniae
VRMIDHFEIKVKDLQISEGFYRSFLAPLDYKLAFKTSSLISFLSPNSPHPGGDFWLTQGTQDPVHFAFLAENKEEVQACYEAGIEAGGRDNGVPGYRSEHPIYYAAFMIDLDGNNIEVVCHKE

SEQ ID NO: 3339 - protein, 447 aa, Streptococcus pneumoniae
MTKRVTIIDVKDYVGQEVTIGAWVANKSGKGKIAFLQLRDGTAFFQGVAFKPNFVEKFGEEVGLEKFDVIKRLSQETSVYVTGIVKEDERSKFGYELDITDIEVIGESQDYPITPKEHGTDFLMDNRHLWLRSRKQVAVLQIRNAIIYATYEFFDKNGFMKFDSPILSGNAAEDSTELFETDYFGTPAYLSQSGQLYLEAGAMALGRVFDFGPVFRAEKSKTRRHLTEFWMMDAEYSYLTHDESLDLQEAYVKALLQGVLDRAPQALETLERDTELLKRYIAEPFKRITYDQAIDLLQEHENDEDADYEHLEHGDDFGSPHETWISNHFGVPTFVMNYPAAIKAFYMKPVPGNPERVLCADLLAPEGYGEIIGGSMREEDYDALVAKMDELGMDRTEYEFYLDLRKYGTVPHGGFGIGIERMVTFAAGTKHIREAIPFPRMLHRIKP

SEQ ID NO: 3340 - protein, 128 aa, Streptococcus pneumoniae
MGVFLFLWFDTVQHTWEWNSFTDMFCSCCEGYHTFDTDTKSSVWNCTVFTKVKVEFIFCTIHAKFIHLSDKGIVIFLTHRPTDNFSIAFWSKQVCTKHALWISRNWFHVEGLDGCWIVHDKCWHTKVV

SEQ ID NO: 3341 - protein, 96 aa, Streptococcus pneumoniae
MAKYEILYIIRPNIEEEAKNALVARFDSILTDNGATVVESKTWEKRRLAYEIQDFREGLYHIVNVEANDDAALKEFDRLSKINADILRHMIVKIDA

SEQ ID NO: 3342 - protein, 156 aa, Streptococcus pneumoniae
MINNVVLVGRMTRDAELRYTPSNVAVATFTLAVNRTFKSQNGEREADFINVVMWRQQAENLANWAKKGSLIGVTGRIQTRSYDNQQGQRVYVTEVVAENFQMLESRSVREGHTGGAYSAPTANYSAPTNSVPDFSRNENPFGATNPLDISDDDLPF

SEQ ID NO: 3343 - protein, 86 aa, Streptococcus pneumoniae
TYKGEKTWLNNVVADSNAVKKLITSQQTKLNMLITKILSFLAVSFQNVGKSFPRRVTGTSAKNQRKVTTAIKRARVMALMPFVNED

SEQ ID NO: 3344 - protein, 111 aa, Streptococcus pneumoniae
SRQIPYFQKVYHFYFNFLDEKKDIFMKKLHRAFNVFSCFQTRKKGATEPNSLSHFKACEKRPVGVLIRFLVFKLMKKRPNRVFSLIFVYERHQSHYASAFDSCCYFTLVFS

SEQ ID NO: 3345 - protein, 466 aa, Streptococcus pneumoniae
MDAKLRYKAKKIKIVFFDIDDTLRNSKTGFIPTTIPTVFKQLREKGILTGIASGRGIFGVVPEIRDLKPDFFVTLNGAYIEDKKGQVIYQHQIEKSYVEEYISWAKQEGIEYGLVGSHDAKLSTRTDMMSEAINPIYPDLDVDPDFHEKEDIYQMWTFEDKGDDLHLPDSLSDKLRMVRWHQHSSDIVPISGSKATGVEKVVEHLGLKPEKVMVFGDGLNDLELFDYAGISVAMGISHDKIKEKADYITKTLEEDGIFDALEVFGMVEKELHFPQVDIETVEGPLATIKTNHGDLRIKLFPEHAPKTVANFVSLSKDGYYDGVIFHRIIKDFMIQGGDPTGTGMGGESIYGESFEDEFSEELYNIRGALSMANAGPNTNGSQFFIVQNQHLPYSKKEITRGGWPEPIAEIYANQGGTPHLDRRHTVFGQLADEASYAVLDVIAAVETGAMDKPVEDVVIETIEIED

SEQ ID NO: 3346 - protein, 83 aa, Streptococcus pneumoniae
MKIGDKLKGRITGIQPYGAFVELETGDTGLIHISEIRTGFIENIHETLKVDEEVQVQVVDLDEFTGESQSFYPHFGGRKVPVS

SEQ ID NO: 3347 - protein, 86 aa, Streptococcus pneumoniae
MEEEQLLKSGERINQLFSTDIKIIQNREVFSYSVDSVLLSRFPRFPKKGLIVDFCAGNGAVGLFASTRTQAQILSVEISGAFGGYG

SEQ ID NO: 3348 - protein, 66 aa, Streptococcus pneumoniae
LWISVLGMEQWGFLLALVLKHRYCLLRFQERLADMAERSVRLNGLEEQMQVICDDLKNMPAHIQGK

SEQ ID NO: 3349 - protein, 128 aa, Streptococcus pneumoniae
LCNPPYFKVNPYSNLNESEHYLLARHEITTNLEEICRSAQSILKSNGRLAMVHRPDRLLDILDTLKRHNLAPKRLQFVYPKREKEANMLLIEAIKDGSTSGFKVLPPLIVHNDDGSYTPEIEEIYYGS

SEQ ID NO: 3350 - protein, 92 aa, Streptococcus pneumoniae
MDHKAYMYVLECRDGSYYIGYTTDMRRRLAIHNSGKGAKYTRARLPVKLIYAQGFASKEEAMSAEALLKRKKRPQKEEFLSENQDRNLLRLF

SEQ ID NO: 3351 - protein, 59 aa, Streptococcus pneumoniae
LTDHNEFQQSVSDIAEVEVYGVVDHHRVLTLKLQAHFTCVWSQLDQRLQSFTVCSKNMV

SEQ ID NO: 3352 - protein, 221 aa, Streptococcus pneumoniae
SRSLRCCRPPPCANFETASPLYMRLEPVGSASSIVYRMFKEHGVAVPKEIAGLMLSGLISDTLLLKSPTTHPTDKIIAPELAELAGVNLEEYGLAMLKAGTNLASKSAEELIDIDAKTFELNGNNVRVAQVNTVDIAEVLERQAEIEAAMQAANESNGYSDFVLMITDIVNSNSEILALGANMDKVEAAFNFKLENNHAFLAGAVSRKKQVVPQLTESFNT

SEQ ID NO: 3353 - protein, 170 aa, Streptococcus pneumoniae
MLENGDLIFVRDGSDMGQAIQTSTGNYSHVAIYLDGMIYHASGQAGVVCQEPADFFESNHLYDLYVYPEMDIQSVKERACRHLGAPYNASFYPDAAGFYCSQYIAEILPIFETIPMKFGDGEQEISDFWREYYIELGLPVPLNQAGTNPSQLAASPLLQCKERNLHDSDF

SEQ ID NO: 3354 - protein, 104 aa, Streptococcus pneumoniae
LIRYLDQYEDVILREIKAQFPDVAVDKLMEEYIKAGLILRENKRYYLNFPTLESLDSLELDQEIFVREASPVYQALLEQSFETELRNQINAAILVERRTLRALK

SEQ ID NO: 3355 - protein, 94 aa, Streptococcus pneumoniae
MTLSNYFYKVKQQYPLTEKQQELYDILGDVNPEYALKYMTAFLLKFLKKDQLMQKCRDIFVDSLVVLGYIVQNEDRKYELAIDFDKERLTFYLA

SEQ ID NO: 3356 - protein, 64 aa, Streptococcus pneumoniae
MSLENKLEQATGAVKEGFGKVTGDSKTELEGAVEKTVAKAKDVVEDAKGAVEGAVEGLKNVFTK

SEQ ID NO: 3357 - protein, 503 aa, Streptococcus pneumoniae
MIKIEPVLDILKKDGLFREIIDQGHYHYNYSKVIFDSISYDSRKVTEDTLFFAKGAAFKKEYLLSAITQGLAWYVAEKDYEVDIPVIIVNDIKKAMSLIAMEFYGNPQEKLKLLAFTGTKGKTTATYFAYNILSQGHRPAMLSTMNTTLDGETFFKSALTTPESIDLFDMMNQAVKMTVPTSSWKSPVKPIHDESGCENDRTHLIMEVSSQAYLVHRVYGLTFDVGVFLNITPDHIGPIEHPSFEDYFYHKRLLMENSRAVIINSDMDHFSVLKEQVEDQDHDFYGSQFDNQIENSKAFSFSATGKLAGDYDIQLIGNFNQENAVAAGLACLRLGASLEDIKKGIAATRVPGRMEVLTQKNGAKVFIDYAHNGDSLKKLINVVETHQTGKIALVLGSTGNKGESRRKDFGLLLNQHPEIQVFLTADDPNYEDPMAIADEISSYINHPVEKIADRQEAIKAAMAITNHELDAVIIAGKGADCYQIIQGKKESYPGDTAVAENYL

SEQ ID NO: 3358 - protein, 191 aa, Streptococcus pneumoniae
MIKIEPVLDILKKDGLFREIIDQGHYHYNYSKVIFDSISYDSRKVTEDTLFFAKGAAFKKEYLLSAITQGLAWYVAEKDYEVDIPVIIVNDIKKAMSLIAMEFYGNPQEKLKLLAFTGTKGKTTATYFAYNILSQGHRPAMLSTMNTTLDGETFFKSALTTPESIDLFDMMNQAVKMTVPTSSWKSPVKPI

SEQ ID NO: 3359 - protein, 540 aa, Streptococcus pneumoniae
MSHENNHQQAQMLRGTALLTASNFISRLLGAVYIIPWYIWMGAYAAKANGLFTMGYTIYAWFLLVSTAGIPVAVAKQVAKYNTMREEEHSFALIRSFLGFMTGLGLVFALVLYVFAPWLADLSGVGKDLIPIMQSLAWGVLIFPSMSVIRGFFQGMNNLKPYAMSQIAEQVIRVIWMLLATFIIMKLGSGDYLAAVTQSTFAAFVGMVASFAVLIYFLAQESSLKRVFETGDKINSKRLLVDTIKEAIPFILTGSAIQIFQILDQLTFINSMSWFTNYSNEDLVVMFSYFSANPNKITMILISVGVSIGSVGLPLLTENYVKGDLKAASRLVQDSLTLLFMFLLPATVGVVMVGEPLYTVFYGKPDSLALGLFVFAVLQSIILGLYMVLSPMLQAMFRNRKAVLYFIYGSIAKLVLQLPTIALFHSYGPLISTTIALIIPNVLMYRDICKVTGVKRKVILKRTILISLLTLVMFLLIGTIQWLLGFFFQPSGRLWSFFYVALVGAMGGGLYMVMSLRTYLLDKVIGKAQADRLRAKFKLS

SEQ ID NO: 3360 - protein, 652 aa, Streptococcus pneumoniae
MKKSKSKYLTLAGLVLGTGVLLSACGNSSTASKTYNYVYSSDPSSLNYLAENRAATSDIVANLVDGLLENDQYGNIIPSLAEDWTVSQDGLTYTYKLRKDAKWFTSEGEEYAPVTAQDFVTGLQYAADKKSEALYLVQDSVAGLDDYITGKTSDFSTVGVKALDDQTVQYTLVKPELYWNSKTLATILFPVNADFLKSKGDDFGKADPSSILYNGPFLMKALVSKSAIEYKKNPNYWDAKNVFVDDVKLTYYDGSDQESLERNFTAGAYTTARLFPNSSSYEGIKEKYKNNIIYSMQNSTSYFFNFNLDRKSYNYTSKTSDIEKKSTQEAVLNKNFRQAINFAFDRTSYGAQSEGKEGATKILRNLVVPPNFVSIKGKDFGEVVASKMVNYGKEWQGINFADGQDPYYNPEKAKAKFAEAKKELEAKGVQFPIHLDKTVEVTDKVGIQGVSSIKQSIESVLGSDNVVIDIQQLTSDEFDSSGYFAQTAAQKDYDLYHGGWGPDYQDPSTYLDIFNTNSGGVLQNLGLEPGEANDKAKAVGLDVYTQMLEEANKEQDPAKRYEKYADIQAWLIDSSLVLPSVSRGGTPSLRRTVPFAAAYGLTGTKGVESYKYLKVQDKIVTTDEYAKAREKWLKEKEESNKKAQEELAKHVK

SEQ ID NO: 3361 - protein, 184 aa, Streptococcus pneumoniae
GVFMKLKLLRVDTKVIMGSFLLVLSSLLALLLPLILKGLIDGSSIENIGSKVFQSFLIFIGQALFSSIGYYLFSQSGEKKIAKIRKKVIEGLIYAEKSFFDKSQSGELTSAIVNDMSVIREFLITTFPNIILSLVMVLGSIVVLFSLDWNLSLLLFITLPCMMFIILPLSNISEKYSRRLQEEI

SEQ ID NO: 3362 - protein, 179 aa, Streptococcus pneumoniae
LTEKIQEHELIKTNQAEKSVQDVLDNCIERVQNNSLKSDRVTSFETPFALLFIFATIAVMLTYGGYRVSAGYISVGTLVSFLIYLFQLLNPISNIANFVTVYSRSKGSSVALDNLLAVPKEKFEGGKSVSGQGLNFNHVYFGYDENRPVLKDITCSIFKGQKLLLLDHLDQENQRLCVC

SEQ ID NO: 3363 - protein, 181 aa, Streptococcus pneumoniae
MEQSSIYDFNLKEWRSKIAWVSQNNAVLSGSIRDNLCLGLNRLVTDDELMKVLDLVSLGDEIRSMKEGLDTEVGERGRFLSGGQSQRLQIARTYLKDAEILIFDEATANLDADSEYAIISSLYSVLKEKTVVIIAHSLSTVKDVDCIFFLEEGKITGSGTHKELLENHERYARFVQEQMIE

SEQ ID NO: 3364 - protein, 364 aa, Streptococcus pneumoniae
MSKELHINTILAQAGIKSDEATGALVTPLHFSTTYQHPEFGRSTGFDYTRTKNPTRSKAEEVLATIESADYALATSSGMSAIVLAFSGFPVGSKVLAVRDLYGGSFRWFNQVEQEGRFHFTYANTEEELIAELEKDVDVLYIETPTNPLMLEFDIEKLAKLAHAKGAKVVVDNTFYSPIYQRPIEDGADIVLHSATKYLAGHNDVLAGVVVTNSLELYEKLFYNLNTTGAVLSPFDSYQLLRGLKTLSLRMERSTANAQEVVAFLKDSPAVKEVLYTGRGGMISFKVADETRIPHILNSLKVFSFAESLGGVESLITYPTTQTHADIPAEVRHSYGLTDDLLRLSIGIEDARDLIADLRQALEG

SEQ ID NO: 3365 - protein, 388 aa, Streptococcus pneumoniae
MGKYDFTSLPNRLGHHTYKWKETETDSEVLPAWIADMDFVVLPEIRQAVQTYADQLVYGYTYASEDLIKEVQKWEATQYGYNFDKEALVFIEGVVPAISTAIQTFTKEGEAVLINTPVYPPFARSVKLNNRRLITNSLVEKDGLFEIDFDQLEKDLVEEEVKLYILCNPHNPGGRVWEKEVLEKIGQLCQKHGVLLVSDEIHQDLTLFGHKHQSFNTINPAFKNFAIVLSSATKTFNIAGTKNSYAVIENPKLRLAFQKRLLANNQHEISGLGYLATEAAYRYGKDWLEELKQVFEDHINYVVDLFGKETKIKVMKPQGTYLIWLDFSAYDLTDETLQELLRNEAKVILNRGLDFGEEGSLHARINIAMPKSLLQEVCQRIVATFAKR

SEQ ID NO: 3366 - protein, 1032 aa, Streptococcus pneumoniae
MAKLIPGKIRIEGVALYETGKVDIIKEKNNRLYARVAEEELRYSLEDDLVFCACDFFQKRGYCVHLAALEHFLKNDERGQEILWSLEEGHEEKEAVETKVTLGGKFLDRILSPKSECAYELSAVGQVEAGTNHILWTLRIGQINSQKYYVIRDIPLFLRIVEQRKSYMIGKIYEESLSWEAFDDASQELLTFLHGLTEEGLVSDLFCQNQGRHLFFPLTFFEQGVNLLMALPHFQFDHQVDSYQTLLFQDMHADANLFAFTVTEYSDYFEMEISESPRVNVFYQGAVLFHKGQVYFLTDQQMRLLKEIKALPVGQQGKKYLQFDSSDRDKLASCLTLFIQMGTVSAPERLQIKTFAPSFYFDREEDNRIRLEIQFDYGNRQVSSRQELEELPFSSDADLEERIFQVCLAAGFEADFQSWRQALKAESVYHFFHDIIPVFEKLGHVDLSDKLEELYSLASPQVQIASKGGLLEIQFDFQDIAQEEIDQAMQALVANQDFYIDSSNQVYFFDEETKKIRQNLQELGQFELKDGTLQARKSLAYSLAHLFEGRDRVSFSQEFQNLAQDLTHPEDFPRQATQVQADLRDYQEKGIGWLQMLHHYGFGGILADDMGLGKTLQTIAFLTSQVTKESRVLILAPSGLIYNWADEFQKFAPQLDVAVVHGLKASREEILAESHQIYVTSYATFRQDSEFYQGMAFYFLFLDEAQVMKNAQTKIAQTLRQFVVPSVFALSGTPIENHLGELWSIFQIVMPGLLPSKKEFMKLPAERVAQFIKPFVMRRKKEEVLTELPDLIEVVYKNELEDQQKAIYLAQLQQMRDHLAQVSEQEFQRSRVEILSGLMRLRQICDTPALFMEDYQGASGKLDSLRDLLVQVADGRHRVLIFSQFKGMLEKIEQELPDLGLTSFKITGSTPAKERQDMTKAFNQGERDAFLISLKAGGVGLNLTGADTVILVDLWWNPAVEAQAIGRAHRMGQEETVEVYRLVTKGTIEEKIQELQEQKKHLVSQVLDGTESRGSLTLAEIREILGISEANT

SEQ ID NO: 3367 - protein, 205 aa, Streptococcus pneumoniae
MKQERFPLVSDDEVMLTEMPVMNLYDESDLISNIKGEYRDKNYLEWAPITEEKPVKPIEKQVEKPKKAPLGVKKEGKSYAEVAREEARADLKKKRSANYLTQDFSLARRHSQPSLVRQGNQPTAPFQKENPGEFVKYSQKLTQSHYILAEEVHSIPTKNEEVSAPAPKKNNYDFLKKSQIYNKKSKQTEQERRVAQELNLTRMTE

SEQ ID NO: 3368 - protein, 444 aa, Streptococcus pneumoniae
MSKTYHFIGIKGSGMSALALMLHQMGHKVQGSDVEKYYFTQRGLEQAGITILPFDEKNLDGDMEIIAGNAFRPDNNVEIAYADQNGISYKRYHEFLGSFMRDFVSMGVAGAHGKTSTTGMLSHVLSHITDTSFLIGDGTGRGSANAKYFVFESDEYERHFMPYHPEYSIITNIDFDHPDYFTSLEDVFNAFNDYAKQITKGLFVYGEDAELRKITSDAPIYYYGFEAEGNDFVASDLLRSTTGSTFTVHFRGQNLGQFHIPTFGRHNIMNATAVIGLLYTAGFDLNLVREHLKTFAGVKRRFTEKIVNDTVIIDDFAHHPTEIIATLDAARQKYPSKEIVAVFQPHTFTRTIALLDDFAHALNQADAVYLAQIYGSAREVDHGDVKVEDLANKINKKHQVITVENVSPLLDHDNAVYVFMGAGDIQTYEYSFERLLSNLTSNVQ

SEQ ID NO: 3369 - protein, 154 aa, Streptococcus pneumoniae
MEIPIKIIQASKSDLPEIGALQTSSFPAEKQQLSHILEESIRKCADTFLLARDENQLLGYILSSPQSDNPQCLKVHSLVIESDHQRQGLGTLLLAALKEVAVELDYKGIRLESPDELLSYFEMNGFVDEEATLLYATSQGYSMIWFNPFYLEEQ

SEQ ID NO: 3370 - protein, 118 aa, Streptococcus pneumoniae
MKIRQARLEDLDRIVELEFENFSVEEAIPPSVFEAHLREIQTSFLVAEKEGRIMGYIEGPVGLHRHLQDQSFTEEIKDSRHEPGGYISVTWLSIAKEAQGLGLGQKLLTALKEVALEE

SEQ ID NO: 3371 - protein, 70 aa, Streptococcus pneumoniae
VRKGIIICFFGTFKIKNNGIIHKEEKLLSEKSRKKEKLSFKEQILRDLEKVKGYDEVLKEDKAVGSHSCK

SEQ ID NO: 3372 - protein, 501 aa, Streptococcus pneumoniae
MADSLSPVEKIMRKAPTVPTHPSQGVPASPADEIQRETPGVPSHPSQDVPSSPAEESGSRPGPGPVRLKKLEREYNETPTRVAVSYTTAEKKAEQAGPETPTPATETVDIIRDTSRRSRREGAKPVKPKKEKKSHVKAFVISFLVFLALLSAGGYFGYQYVLDSLLPIDANSKKYVTVGIPEGSNVQEIGTTLEKAGLVKHGLIFSFYAKYKNYTDLKAGYYNLQKSMSTEDLLKELQKGGTDEPQEPVLATLTIPEGYTLDQIAQTVGQLQGDFKESLTAEAFLAKVQDETFISQAVAKYPTLLESLPVKDSGARYRLEGYLFPATYSIKESTTIESLIDEMLAAMDKNLSPYYSTIKSKNLTVNELLTIASLVEKEGAKTEDRKLIAGVFYNRLNRDMPLQSNIAILYAQGKLGQNISLAEDVAIDTNIDSPYNVYKNVGLMPGPVDSPSLDAIESSINQTKSDNLYFVADVTEGKVYYANNQEDHDRNVAEHVNSKLN

SEQ ID NO: 3373 - protein, 160 aa, Streptococcus pneumoniae
MAEKTYPMTLEEKEKLEKELEELKLVRRPEVVERIKIARSYGDLSENSEYEAAKDEQAFVEGQISSLETKIRYAEIVNSDAVAQDEVAIGKTVTIQEIGEDEEEVYIIVGSAGADAFAGKVSNESPIGQALIGKKTGDTATIETPVGSYDVKILKVEKTA

SEQ ID NO: 3374 - protein, 60 aa, Streptococcus pneumoniae
VLHSLLFPFCYSSKISSNHVSVALPYVWLLTSSVSSTTSKQCFEQPAASFLVFSLIFIEY

SEQ ID NO: 3375 - protein, 162 aa, Streptococcus pneumoniae
LISKTLLEIRLNSLIDLRMFYFISLYFRLENKESHKSQEIGNLIRVYNRSKREEAESEPLNLYVEDEKGNLLAGLIAETFGNWLELEIEYLFVKEELRGQGIGSKLLQQAESEAKNRNCCFAFVNTYQFQAPDFYQKHGYKEVFSLQDYLYIRQRYYYQKNL

SEQ ID NO: 3376 - protein, 65 aa, Streptococcus pneumoniae
LIPNFGATIILSSISSRKTQFLGYNWYLSIVTHIHQSTSILMCEPLFVLYLHTHLTDSFGNNIFA

SEQ ID NO: 3377 - protein, 69 aa, Streptococcus pneumoniae
PRNCVFLDDIEDNIIVAPKLGIKTYQVKKRSDVVDILNNLFKLKTLYLLIRDSPLGFCVAFIKFTGKTC

SEQ ID NO: 3378 - protein, 147 aa, Streptococcus pneumoniae
VLYLLFNHKHKKGTEMQDNYTTKGKHLTIDSRRLIERWKKEGKSNREIASLLGKAPQTIHTKIKRRTVRKCLGKGRFKEVYSADYAQQSYENNRKHSVKRSSVTKELKEKILHYHNQKFLPEMMVMAKGVNVGISTIYYWIHHGKLG

SEQ ID NO: 3379 - protein, 163 aa, Streptococcus pneumoniae
LENGHYEIDTVLLTRAKNYCLLVLTDRKSRHQIIRLIPNKSAEVVNQALKLILNNTRFFPSGQIMDRNSIACLMYFLRSTIYYAHPYASWERGTNENHNRLIRRWLPKGTKKMTPKEVAFIEKWINNYPKKCLDYKSPREDFWMANLNLKFSKMEIIFIKRFQ

SEQ ID NO: 3380 - protein, 66 aa, Streptococcus pneumoniae
MNLTFLGLCIACMGVSVGEGLLMNGLFKSVARQPDMLSEFRSLMFLGVAFIEGTFFVTLVFSFIIK

SEQ ID NO: 3381 - protein, 238 aa, Streptococcus pneumoniae
MEESINPIISIGPVIFNLTMLAMTLLIVGVIFVFIYWASRNMTLKPKGKQNVLEYVYDFVIGFTEPNIGSRYMKDYSLFFLCLFLFMVIANNLGLMTKLQTIDGTNWWSSPTANLPYDLTLSFLVILLTHIESVRRRGFKKSIKSFMSPVFVIPMNILEEFTNFLSLALRIFGNIFAGEVMTSLLLLLSHQAIYWYPVAFGANLAWTAFSVFISCIQAYVFTLLTSVYLGNKINIEEE

SEQ ID NO: 3382 - protein, 164 aa, Streptococcus pneumoniae
MHVTVGELIGNFILITGSFILLLVLIKKFAWSNITGIFEERAEKIASDIDRAEEARQKAEVLAQKREDELAGSRKEAKTIIENAKETAEQSKANILADAKLEAGHLKEKANQEIAQNKVEALQSVKGEVADLTISLAGKIISQNLDSHAHKALIDQYIDQLGEA

SEQ ID NO: 3383 - protein, 178 aa, Streptococcus pneumoniae
MDKKTVKVIEKYSMPFVQLVLEKGEEDRIFSDLTQIKQVVEKTGLPSFLKQVAVDESDKEKTIAFFQDSVSPLLQNFIQVLAYNHRANLFYDVLVDCLNRLEKETNRFEVTITSAHPLTDEQKTRLLPLIEKKMSLKVRSVKEQIDESLIGGFVIFANHKTIDVSIKQQLKVVKENLK

SEQ ID NO: 3384 - protein, 501 aa, Streptococcus pneumoniae
LAINAQEISALIKQQIENFKPNFDVTETGVVTYIGDGIARAHGLENAMSGELLNFENGSYGMAQNLESTDVGIIILGDFTDIREGDTIRRTGKIMEVPVGESLIGRVVDPLGRPVDGLGEIHTDKTRPVEAPAPGVMQRKSVSEPLQTGLKAIDALVPIGRGQRELIIGDRQTGKTTIAIDTILNQKDQDMICIYVAIGQKESTVRTQVETLRQYGALDYTIVVTASASQPSPLLFLAPYAGVAMAEEFMYQGKHVLIVYDDLSKQAVAYRELSLLLRRPPGREAFPGDVFYLHSRLLERSAKVSDELGGGSITALPFIETQAGDISAYIATNVISITDGQIFLGDGLFNAGIRPAIDAGSSVSRVGGSAQIKAMKKVAGTLRIDLASYRELEAFTKFGSDLDAATQAKLNRGRRTVEVLKQPVHKPLPVEKQVTILYALTHGFLDTVPVDDIVRFEEEFHAFFDAQHPEILETIRDTKDLPEEAVLDAAITEFLNQSSFQ

SEQ ID NO: 3385 - protein, 292 aa, Streptococcus pneumoniae
MAVSLNDIKTKIASTKNTSQITNAMQMVSAAKLGRSEEAARNFQVYAQKVRKLLTDILHGNGAGASTNPMLISRSVKKTGYIVITSDRGLVGGYNSSILKAVMELKEEYHPDGKGFEMICIGGMGADFFKARGIQPLYELRGLADQPSFDQVRKIISKTVEMYQNELFDELYVCYNHHVNTLTSQMRVEQMLPIVDLDPNEADEEYSLTFELETSREEILEQLLPQFAESMIYGAIIDAKTAENAAGMTAMQTATDNAKKVINDLTIQYNRARQAAITQEITEIVAGASALE

SEQ ID NO: 3386 - protein, 468 aa, Streptococcus pneumoniae
MSSGKIAQVIGPVVDVLFAAGEKLPEINNALVVYKNDERKTKIVLEVALELGDGMVRTIAMESTDGLTRGMEVLDTGRPISVPVGKETLGRVFNVLGDTIDLEAPFTEDAERQPIHKKAPTFDELSTSSEILETGIKVIDLLAPYLKGGKVGLFGGAGVGKTVLIQELIHNIAQEHGGISVFAGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLVQLGIYPAVDPLASSSRALAPEIVGEEHYAVAAEVKRVLQRYHELQDIIAILGMDELSDEEKTLVARARRIQFFLSQNFNVAEQFTGQPGSYVPVAETVRGFKEILDGKYDHLPEDAFRGVGSIEDVIAKAEKMGF

SEQ ID NO: 3387 - protein, 139 aa, Streptococcus pneumoniae
MAQLTVQIVTPDGLVYDHHASYVSVRTLDGEMGILPRHENMIAVLAVDEVKVKRIDDKDHVNWIAVNGGVIEIANDMITIVADSAERARDIDISRAERAKLRAERAIEEAQDKHLIDQERRAKIALQRAINRINVGNRL

SEQ ID NO: 3388 - protein, 250 aa, Streptococcus pneumoniae
MDRGYESYNLMAHFQEKGWLYIIRIRDGKQSMPSSFNLPNTECFDQKVSLKLSRKQTNQLKKLYRDFPNDYHFIPHNSIFDFLPETSRKQDPVTLYELLFRMVRLEVEKGKYETLVTNTDYSVQELKNLYASRWGIETSFRDLKYSIGLVNFHAKKKGGILQEIFARFTNFNFCRWVTSQVAIDSSHKKQRYKVCFSDAAYACRLFFNGSLSSLQLKNYLKKQLSIIRPNRKYSRKIKAQSVVDFIYRVT

SEQ ID NO: 3389 - protein, 64 aa, Streptococcus pneumoniae
LFFVTTVDGNLRGYPTTKVKICKASKDFLENPSLLFGVKIDQANTVFQVTKTSLYAPSTGVEIF

SEQ ID NO: 3390 - protein, 181 aa, Streptococcus pneumoniae
MIKQIKAHLNKSIQSIIGQKVEFVKQDEQAFTRKRRLSLETMIRTILGMGGKSLSKELLDARLTVSNSAFVQRRYQIKPEAFYALFKEFTAPIPLNTDFPIFAADGSDICIPRNPMDTETSIQTQTDVKSYNLIHINALYDLTTGVYRDVSIQDKHAQHERLALIQMMEASPFRESSCYHG

SEQ ID NO: 3391 - protein, 337 aa, Streptococcus pneumoniae
MKETVYFGTYTRRTSQGIYKADFDTETGQLSNLELFAAEPSPTYLAFDQHQHLYTVGSQDDKGGIAAYQTDGTVLNHVVEEGAPHCYVAVDEKRDLVYAANYHKGQVLVYKRQEDGSLLLSDMDQHSGQGPHENQASPHVHYTDLTPDHYLVTCDLGTDQVITYDLDQEGKLSKLYTYHSKPGAGSRHIIFHNHYKIAYLICELNSTIEVLIYDGVGEFERMQVISTLPEAYEGFNGTAAIHLSKDGKYLYASNRGHDSIAVYTILADGSLELLEIVPTHGQTPRDFDLTPDQKFLIVVHQDSDNATVFKRNCDNGRLAELSNDFHVPEAVCIRFAP

SEQ ID NO: 3392 - protein, 77 aa, Streptococcus pneumoniae
MTGNITTAKKSKTGENRKLILLKIKRFSPNNKVTKNTVIALLSKNHLKNQDRLKCFSFCSINTSFLLFSHYTIFETK

SEQ ID NO: 3393 - protein, 388 aa, Streptococcus pneumoniae
MEQKEKHFSLSWFFKWFLDNKAITVFLVTLLLGLNLFILSKISFLFSPVLDFLAVVMLPVILSGLLYYLLNPIVDWMEKHKVNRVIAITIVFVIIALFIIWGLAVAIPNLQRQVLTFARNVPVYLEDIDRIVNGLVAQHLPDDFRPQLEQVLTNFSSQATVLASKVSSQAVNWVSAFISGASQVIVALIIVPFMLFYLLRDGKGLRNYLTQFIPRKLKEPVGQVLSDVNQQLSNYVRGQVTVAIIVAVMFIIFFKIIGLRYAVTLGVTAGILNLVPYLGSFLAMLPALVLGLIAGPVMLLKVVIVFIVEQTIEGRFVSPLILGSQLNIHPINVLFVLLTSGSMFGIWGVLLGIPVYASAKVVISAIFEWYKVVSGLYELEGEEVKSEQ

SEQ ID NO: 3394 - protein, 409 aa, Streptococcus pneumoniae
VNNSQQMLQALEEQDLTKAEHYFAKALENDSSDLLYELATYLEGIGFYPQAKEIYLKIVEDFPEVHLNLAAIASEDGQIEEAFTYLEEIQADSDWYVSSLALKADLYQLEGLTDVAREKLLEALTYSEDSLLILGLAELDSELENYQAAIQAYAQLDNRSIYEQTGISTYQRIGFAYAQLGKFETATEFLEKALELEYDDLTAFELASLYFDQEEYQKATLYFKQLDTISPDFEGYEYGYSQALHKEHQVQEALRIAKQGLEKNPFETRLLLAASQFSYELHDASGAENYLLTAKEDAEDTEEILLRLATIYLEQERYEDILELQSEEPENLLTKWMIARSYQEMDDLDTAYEYYQELTGDLKDNPEFLEHYIYLLRELGHFEEAKVHAHTYLKLVPDDVQMQELFERL

SEQ ID NO: 3395 - protein, 213 aa, Streptococcus pneumoniae
MSYLFEILPSLLNGASTTVQVFALVLLFSIPLGVLIAFALQVHWKPLHYLINIYIWVMRGTPLLLQLIFIYYVLPSIGIRLDRLPAAIIAFVLNYAAYFAEIFRGGIDTIPRGQYEAAKVLKFSPFDRVRYIILPQVTKIVLPSVFNEVMSLVKDTSLVYALGISDLILASRTAANRDASLVPMFLAGAIYLILIGIVTIISKKVEKKYSYYR

SEQ ID NO: 3396 - protein, 209 aa, Streptococcus pneumoniae
MLELRNINKVFGDKQILSNFSLSIPEKQILAIVGPSGGGKTTLLRMLAGLETIDSGQIFYNGQPLELDELQKRNLLGFVFQDFQLFPHLSVLENLTLSPVKTMGMKQEEAEKKASGLLEQLGLGGHAEAYPFSLSGGQKQRVALARAMMIDPEIIGYDEPTSALDPELRLEVEKLILQNRELGMTQIVVTHDLQFAENIADVLLKVEPK

SEQ ID NO: 3397 - protein, 278 aa, Streptococcus pneumoniae
MKKWMLVLVSLMTALFLVACGKNSSETSGDNWSKYQSNKSITIGFDSTFVPMGFAQKDGSYAGFDIDLATAVFEKYGITVNWQPIDWDLKEAELTKGTIDLIWNGYSATDERREKVAFSNSYMKNEQVLVTKKSSGITTAKDMTGKTLGAQAGSSGYADFEANPEILKNIVANKEANQYQTFNEALIDLKNDRIDGLLIDRVYANYYLEAEGVLNDYNVFTVGLETEAFAVGARKEDTNLVKKINEAFSSLYKDGKFQEISQKWFGEDVATKEVKEGQ

SEQ ID NO: 3398 - protein, 115 aa, Streptococcus pneumoniae
MEQFLDNIKDLEVTTVVRAQEALDKKETATFFIGRKTCPYCRKFAGTLSGVVAETKAHIYFINSEEPSQLNDLQAFRSRYGIPTVPGFVHITDGQINVRCDSSMSAQEIKDFAGL

SEQ ID NO: 3399 - protein, 572 aa, Streptococcus pneumoniae
MSYQENYQKWVDFVELPDYLRQDLENMDEKTKEDAFYTNLEFGTAGMRGLVGAGTNRINIYVVRQATEGLARLIESKGGNEKERGVAIAYDSRHFSPEFAFESAAVLAKHGIKSYVFESLRPTPELSFAVRHLNCFAGIMVTASHNPAPFNGYKVYGEDGGQMPPHDADALTTYIRAIENPFAVEVADVETEKASGLIEVIGEAVDVEYLKEVKDVNINPALIEEFGKDMKIVYTPLHGTGEMLARRALAQAGFDSVQVVEAQATADPDFSTVTSPNPESQAAFALAEELGRQVGADVLVATDPDADRVGVEVLQKDGSYLNLSGNQIGAIMAKYILEAHKNAGTLPENAALCKSIVSTDLVTKIAESYGATMFNVLTGFKFIAEKIQEFEEKHNHTYMMGFEESFGYLIKPFVRDKDAIQAVLVVAELAAYYRSRGLTLADGIEEIYKEYGYYAEKTISVTLSGVDGAEQIKAIMAKFRNNAPKEWNATAITVVEDFKAQTATVADGTVTNLTTPPSDVLKYTLADGSWIAVRPSGTEPKIKFYIAVVGETNEESQAKIANIEAEINAFVK

SEQ ID NO: 3400 - protein, 108 aa, Streptococcus pneumoniae
MAYNTDFKQGALDSIKGGHRHVEAAKVFWCWRQNSLHVGKERREQRNLERKKRVVKKRKIPLEELKAFVEAHPDAFLREIAAHFDCAVPSVWAALKQIKVTLKKDDDL

SEQ ID NO: 3401 - protein, 99 aa, Streptococcus pneumoniae
MIYKKSMTSDFFVEWFKTQLLPALKTPHVIVMGNASFHPKNILDELCIQDKHFFLPLPPYSPDLNPIEQAWAILKKKVTDVLREVSTIFECLECFFKTR

SEQ ID NO: 3402 - protein, 94 aa, Streptococcus pneumoniae
EKTVYDQTIHRVAEIVQNEDLYKKGLNVELAHQQIKGFFEAEFKNRINGVLNTKIKNSTLNRVNKKTIHQSNKNSMINLKQKQRKMLKNKAILC

SEQ ID NO: 3403 - protein, 84 aa, Streptococcus pneumoniae
VLNVDQDFMSISKSNKSGSDWKKTFTVRTTNRLANDLNNVLKQADKDTPNTPTWLNSAASKAKDDDRAYKLLKTLIPGENYLSC

SEQ ID NO: 3404 - protein, 70 aa, Streptococcus pneumoniae
RLLYQEKITYHVKDNQLEVETDKYTYTAARNGSKEVGIQESDIAATLSADEYNSNRQTFEREYKYKSKCP

SEQ ID NO: 3405 - protein, 370 aa, Streptococcus pneumoniae
VPMNIILIAKLLRENTNTKANALNNGWARSGSEEFKKFSHFVGVDKGIVRTNVLTGKKLSDKIRKEVGSGDSKLGKGGYFSTGDVLLGKDVVSYTVQVFSENNERVGVNTQSHRVQYNLPILADFSVIQDTVEPSRTVVEKIIPKLNIPEEEKGKITEEIKKKKKTSELAELISENVKVRYVDEQGRLLSLKNDTGIGEKESDGTYITNKKQLIGTSYNVTDKKLSSMTTTDGKYYTFKEADTNSASLTGNIVSEGRTVTLVYRESEAPTTATVTANYYKEGSQEKLAESVIKADLAIGSEYTTESKTIEGKTTTEDKEDRVITRKTTYTLVATPANAYQKTVQQLTITTVRMLRKQWFPKQQPLLRRRL

SEQ ID NO: 3406 - protein, 173 aa, Streptococcus pneumoniae
VVPKTATSTETKTITRIIHYVDKVTNQNVKEDVVQPVTLSRTKTENKVTGVVTYGEWTTGNWDEVVSGKIDKYKDPDIPTVESQEVTSDSSDKEITVRYDRLSTPDKPTPDPGTPKTETPVNPDPEVPTYETGKREELPNTGTEANATLASAGIMTLLASLGLGFFKKKEDEK

SEQ ID NO: 3407 - protein, 289 aa, Streptococcus pneumoniae
MDFTWALKYATEFLGTAILIILGNGAVANVELKGTKGHQSGWIVIAVGYGMGVMIPALMFGNVSGNHINPAFTLGLAVSGLFPWAQVVPYIIAQVLGAIFGQALVVATYRPFYLKTENPNNILGTFSTISSIDHGTKESRYAATVNGLINEFVGSFVLFFAALGLTKNFFGAEVLQFMKQKAIEAGQTVDFSDLAIKAQVAPHTASGLSVAHLALGFLVMALVTSLGGPTGPALNPARDLGPRLLHAFLPKSVLGEHKGDSKWWYSWVPVVAPIAAAIAAVAVFKFLYL

SEQ ID NO: 3408 - protein, 398 aa, Streptococcus pneumoniae
MAKEKYDRSKPHVNIGTIGHVDHGKTTLTAAITTVLARRLPSSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDSKYEDIVMELMNTVDEYIPEPERDTDKPLLLPVEDVFSITGRGTVASGRIDRGIVKVNDEIEIVGIKEETQKAVVTGVEMFRKQLDEGLAGDNVGVLLRGVQRDEIERGQVIAKPGSINPHTKFKGEVYILTKEEGGRHTPFFNNYRPQFYFRTTDVTGSIELPAGTEMVMPGDNVTIDVELIHPIAVEQGTTFSIREGGRTVGSGMVTEIEA

SEQ ID NO: 3409 - protein, 127 aa, Streptococcus pneumoniae
VSSLIPTISISSLTLTIPRSIRPEATVPRPVIENTSSTGRSNGLSVSRSGSGIYSSTVFINSITMSSYLESPSRALSAEPWITGRSSPGKSYSDNRSRISISTNSSNSSSSTKSTLFMKTIRCLTPT

SEQ ID NO: 3410 - protein, 137 aa, Streptococcus pneumoniae
LKRFSKSIILDSNQKALYNSNMKSTKEEIQTIKTLLKDSRTAKYHKRLQIVLFRLMGKSYKEIIELLDCNQTTIWRNVKKYEEFGLDSLLQETRGGRNHAYMTVEEEKAFLARHLKATEAGEFVTIPYFRLISFLHT

SEQ ID NO: 3411 - protein, 61 aa, Streptococcus pneumoniae
LLQYLISGLYRSYTRDAFYQLLKRHGWRNIMPRPEHPKKADAQTIVASKNKISIQEEKKAL

SEQ ID NO: 3412 - protein, 217 aa, Streptococcus pneumoniae
MVGEILCHVQNILRKQTLKPLSRLKIKSQFKKKRKRFKTSRRFHKVRSMYQDEAGFGRISKLGSCWSPIGVGPHVHSHYIREFRYCYGAVDAHTGESFFLRAGGCNTEWMNAFLEELSQAYPDDYLLLVMDNAIWHKSSTLKIPTNIGFAFIPPYTPEINPVEQVWKEIRKRGFKNKAFRTLEDVMNQLQDIIQGLEKEVIKPIVNRRWTRMLFESR

SEQ ID NO: 3413 - protein, 360 aa, Streptococcus pneumoniae
MKTKLPTEWQELSDQLGFQEFTPIQTQLFDPLLTGENLLGVSQTGTGKTLAYLLPSLLRLQKKKAQQLLILAPNTELAGQIFDVCKTWAEAIGLTAQLFLSGSSQKRQIERLKKGPEILIGTPGRIFELIKLKKIKMMNVETIILDEFDQLLDDSQIHFVEKITHYAPRDHQLVYMSATTKFDQEKIVPNTRTIDLSNQKLDNIQHFYMQVDQRHRVDILRKLAHVEDFRGLVFFNSLSDLGNAEEKLQYRDILAVSLASDVNVKFRKVILEKFKDNQLTLLLATDLLARGIDIDSLECVVNFDIPRDSETYTHRAGRTGRMGKEGYVITLVTHPEEIKKLKKFASIREIVLKNQELYIK

SEQ ID NO: 3414 - protein, 353 aa, Streptococcus pneumoniae
LKFSPLCWIVPSIYVIMKEGFKIGKGVFMLKLGVIGTGAISHHFIEAAHTSGEYQLVAIYSRKLETAATFASRYQNIQLFDQLEVFFKSSFDLVYIASPNSLHFAQAKAALSAGKHVILEKPAVTQPQEWFDLIQTAEKNNCFIFEAARNYHEKAFTTIKNFLADKQVLGADFNYAKYSSKMPDLLTGQTPNVFSDRFAGGALMDLGIYPLYAAVRLFGKANDATYHAQQLDNSIDLNGDGILFYPDYQVHIKAGKNITSNLPCEIYTTDGTLTLNTIEHIRSAIFTDHQGNQVQLPIQQTHHTMTEEVAAFAHMIQQPDLNLYQTWLDDAGSVHELLYTMRQTAGIRFEAEK

SEQ ID NO: 3415 - protein, 61 aa, Streptococcus pneumoniae
ESSFSSFYYSTFLNLGLLDSMLLSIYSEKKAFLQKKANSLFEIFSSLLDSPVYLCYNERRI

SEQ ID NO: 3416 - protein, 125 aa, Streptococcus pneumoniae
MICQFIRDMLDLPAKNVTILEGSNIHVLPSMPYSAQDFYTSIDVLAELDNGIQVIIEIQVHHQNFFINRLWAYLCSQVNQNLEKIRQREGDTHQSYKQIAPVYAIAIVDSNYFSDDLAFHSFIVK

SEQ ID NO: 3417 - protein, 480 aa, Streptococcus pneumoniae
LPNCIIEIIAQICYDINMNKSRLGRGRHGKTRHVLLALIGILAISICLLGGFIAFKIYQQKSFEQKIESLKKEKDDQLSEGNQKEHFRQGQAEVIAYYPLQGEKVISSVRELINQDVKDKLESKDNLVFYYTEQEESGLKGVVNRNVTKQIYDLVAFKVEETEKTSLGKVHLTEDGQPFTLDQLFSDASKAKEQLIKELTSFIEDKKIEQDQSEQIVKNFSDQDLSAWNFDYKDSQIILYPSPVVENLEEIALPVSAFFDVIQSSYLLEKDAALYQSYFDKKYQKVVALTFDDGPNPATTPQVLETLAKYDIKATFFVLGKNVSGNEDLVKRIKSEGHVVGNHSWSHPILSQLSLDEAKKQITDTEDVLTKVLGSSSKLMRPPYGAITDDIRNSLDLSFIMWDVDSLDWKSKNEASILTEIQHQVANGSIVLMHDIHSPTVNALPRVIEYLKNQGYTFVTIPEMLNTRLKAHELYYSRDE

SEQ ID NO: 3418 - protein, 255 aa, Streptococcus pneumoniae
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQFVAYCREKGILLEAWGPFGQGELFDSKQVQEIAANHGKSIAQIALAWSLAARDFYHFQNLSQPLVFKLILIALELN

SEQ ID NO: 3419 - protein, 76 aa, Streptococcus pneumoniae
QASARNRSKSRKIDCSDSLGLELGSKGFLPLPKSVTTSRIQANLDCFGIELSHEERETLKTIAVQSGAPRVDDVDF

SEQ ID NO: 3420 - protein, 253 aa, Streptococcus pneumoniae
VDNLYLVKDDSQLAAFRDFVVRNTEKLKDYQSFLKNELAVCDLPQAVIWSSFNAATQIIRESAVPAYTNNRRMVMTPDLAVWKELYLYQLMDYECSQQTQAIESHYHSLSENFLLQIVGHELAHWSEYFLDDFDGYDSYIWFEEGMVEYISRKYFLTEEEFQAEKICNQSLVELFQKKYGWHSLNDFGSSTYDKNYASIFYEYWRSFLTIDKLVENLGSVQAVFDSYHLWANTDKTLPLLNWFVQQKLIEKEI

SEQ ID NO: 3421 - protein, 305 aa, Streptococcus pneumoniae
MSKKLTFQEIILTLQQFWNDQGCMLMQAYDNEKGAGTMSPYTFLRAIGPEPWNAAYVEPSRRPADGRYGENPNRLYQHHQFQVVMKPSPSNIQELYLESLEKLGINPLEHDIRFVEDNWENPSTGSAGLGWEVWLDGMEITQFTYFQQVGGLATGPVTAEVTYGLERLASYIQEVDSVYDIEWANGVKYGEIFIQPEYEHSKYSFEISDQEMLLENFDKFEKEAGRALEEGLVHPAYDYVLKCSHTFNLLDARGAVSVTERAGYIARIRNLARVVAKTFVAERKRLGYPLLDEETRVKLLAEDAE

SEQ ID NO: 3422 - protein, 678 aa, Streptococcus pneumoniae
MTKNLLVELGLEELPAYVVTPSEKQLGEKMAAFLKENRLSFEAIQTFSTPRRLAVRVTGLSDKQSDLTEDFKGPAKKIALDSDGNFTKAAQGFVRGKGLTVEDIEFREIKGEEYVYVTKEEVGQSVEAIVPGVVDVLKSLTFPVSMHWAGNSFEYIRPVHTLTVLLDEQEFDLDFLDIKGSRVSRGHRFLGKETKIQSALSYEEDLRKQFVIADPCEREQMIVDQIKEIEAKHGVRIEIDADLLNEVLNLVEYPTAFMGSFDAKYLEVPEEVLVTSMKEHQRYFVVRDQDGKLLPNFISVRNGNAERLKNVIKGNEKVLVARLEDGEFFWREDQKLVISDLVEKLNNVTFHEKIGSLREHMIRTGQITVLLAEKAGLSVDETVDLARAAAIYKFDLLTGMVGEFDELQGIMGEKYTLLAGETPAVAAAIREHYMPTSAEGELPESKVGAVLAIADKLDTILSFFSVGLIPSGSNDPYALRRATQGVVRILDAFGWHIAMDELIDSLYALKFDSLTYENKAEVMDFIKARVDKMMGSTPKDIKEAVLAGSNFVVADMLEAASALVEVSKEEDFKPSVESLSRAFNLAEKAEGVATVDSALFENDQEKALAEAVETLVLSGPASQQLKQLFALSPVIDAFFENTMVMAEDQAVRQNRLAILSQLTKKAAKFACFNQINTK

SEQ ID NO: 3423 - protein, 85 aa, Streptococcus pneumoniae
MDPKKIARINELAKKKKTEGLTPEEKVEQAKLREEYIEGYRRAVRHHIEGIKIVDEEGNDVTPEKLRQVQREKGLHGRSLDDPNS

SEQ ID NO: 3424 - protein, 414 aa, Streptococcus pneumoniae
MKFVGLVGSNYDQSYNRKLLEFIRRNFKFKFELEVLEIDEVPMFNQDEKWDESFQLRFLYNKITRADGVIIATPEHNHTISASLKSVLEWLSYEVHPFENKPVMIVGASYYDQGTSRAQVHLRKILDAPGVNAYTLPGNEFLLGKAKEAFDNNGNITNEGTVKFLETCLDNFVKYVGVVSKLKKPKPIESEDLDCGKPIATTITEVDPDDPEWVEKVAAITGAVSGDTYVKLDHGILTVNQIDMFLKAMPFELTYADDNNQFLYYNNAHQDPDTMFAKRVPPQSGSRMSTVHGSLPPARMKNVEWVIGTLRNGNQEYVRTIVPGSPAGVINTHNYQAMYYPDGSYAGINEIVFNFQPWLDWYLKETGQRLVGGSGPFAPAAGGHGDADATSGASDSGDVGGHGGDADATAGASY

SEQ ID NO: 3425 - protein, 78 aa, Streptococcus pneumoniae
MIDRSLIQQVQQISFFRSPILQIFPVKVFSIFAKQFLRIAQFLSNLHEDTEVIKDGIQFLDNIKVNQVATWVKCLKRV

SEQ ID NO: 3426 - protein, 201 aa, Streptococcus pneumoniae
MLKLIAIVGTNSKRSTNRQLLQYMQKHFADKAEIELVEIKAIPVFNKPADKQVPAEILEIAAKIEEADGVIIGTPEYDHSIPAVLMSALAWLSYGIYPLLNKPIMITGASYGTLGSSRAQLQLRQILNAPEIKANVLPDEFLLSHSLQAFNPSGDLVDLDVIKKLDAIFDDFRIFVKITEKLRNAQELLRKDAEDFDWENL

SEQ ID NO: 3427 - protein, 307 aa, Streptococcus pneumoniae
LTLRSHSERLMGTTITISLVDEQADIFLQKSFDLLKELEYRFNANSQESELMEINYQAGVSPVTVHPDLFELISLGLEHSLALSSHLNISIGPLIQTWRIGFSDAKVAQPQEIESVLPLINPHGIELDSSTSTVFLKQKGMKIDLGCLAKGYSADKVAQFLRKEGVTSALINLGGNILTIGKNQARGDNPWQIGIQDPANPRGNHLMTIPVVNKSVVTSGIYERHLTVDGQDYHHIFDSQTGYPVETELASLTIISDKSVDGEIWTTRLFGERPASILWQVESLEGIEVILIDKEGHLSCSSGIPTL

SEQ ID NO: 3428 - protein, 90 aa, Streptococcus pneumoniae
IYLTSIPFTVSVYKGGTIISAFFIKNNSPFILFSSLMNFMSIFLDFFQILFVKILTLWYSNNMKIKCKGFNLDNYLILQLIFYKRKELVA

SEQ ID NO: 3429 - protein, 459 aa, Streptococcus pneumoniae
MSKIVVVGANHAGTACINTMLDNFGNENEIVVFDQNSNISFLGCGMALWIGEQIDGAEGLFYSDKDKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 3430 - protein, 297 aa, Streptococcus pneumoniae
MMRIKQMTENRYELNKNLAQMLKGGVIMDVQNPEQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDLQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 3431 - protein, 77 aa, Streptococcus pneumoniae
MPDSDLSHYWNTNRFLDFLNHLWVAHAGNSSSCTNISRNSFQGHHSCRTSSFCDTSLFRILHIHNNTTLEHLCQVFI

SEQ ID NO: 3432 - protein, 62 aa, Streptococcus pneumoniae
RTAWTISPVPGSPLVRIMEAPSAIRRKASPKSLAPQTKGTWNSFLSTWKRSSAGDRTSLSSI

SEQ ID NO: 3433 - protein, 51 aa, Streptococcus pneumoniae
MALARLTGSPDLKIPEPTKTPSAPNCIINAASAGVATPPAAKFTTGNFPCS

SEQ ID NO: 3434 - protein, 193 aa, Streptococcus pneumoniae
MKIGILALQGAFAEHAKVLDQLGVESVELRNLDDFQQDQSDLSGLILPGGESTTMGKLLRDQNMLLPIREAILSGLPVFGTCAGLILLAKEITSQKESHLGTMDMVVERNAYGRQLGSFYTEAECKGVGKIPMTFIRGPIISSVGEGVEILATVNNQIVAAQEKNMLVSSFHPELTDDVRLHQYFINMCKEKS

SEQ ID NO: 3435 - protein, 215 aa, Streptococcus pneumoniae
MNTSLKLSKQLSFGEEIANSVTHAVGAVIMLILLPISSIYSYEAHGFLSSIGVSIFVISLFLMFLSSTIYHSMAYGSTHKYVLRIIDHSMIYVAIAGSYTPVVLTLMNNWFGYLIIVIHWGTTIFGTLYKIFAINVNDKFSLALYLIMGWLVLAIIPAIINQTTPVFWSLMVTGGLCYTVGAGFYAKKKPYFHMIWHLFILAASVLQYIAIVYYM

SEQ ID NO: 3436 - protein, 150 aa, Streptococcus pneumoniae
LKMKTTFSYPKWAEIPNIDLYLDQVLLYVNQVCAPISPNKDKGLTASMVNNYVKNGYLTKPDKKKYQRQQIARLIAITTLKSVFSIQEIAQTLNTLQTQASSDQLYDAFVDYMNQGIDPANPIIQTSCQTVKLYHQTLDLIDHTQEEVIQ

SEQ ID NO: 3437 - protein, 164 aa, Streptococcus pneumoniae
MEIRLAFPNEVDAIMQVMEDAKKCLADAGSDQWQNGYPNADVIIDDIISGQAYVALEEGELLAYAAVTKSPEEAYEAIYEGNWQAGESEYLVFHRIAVAADVQGKGVAQTFLEGLIEGFDYLDFRSDTHAENKVMQHIFEKLGFKQVGKVPVDGERLAYQKLKK

SEQ ID NO: 3438 - protein, 176 aa, Streptococcus pneumoniae
MQKKYVKILYSSPIGILSLVADDHYLYGIWVQEQKHFERGLGDETIEEVVSHPILDPVIACLDDYFKGKPQDLSNLLLAPIGTNFEKRVWDYLQGIPYGQTVTYGQIAQDLQVASAQAIGGAVGRNPWSILVPCHRVLGAGKRLTGYAAGVEKKAWLLEHEGVDFKDRNNRRRSTC

SEQ ID NO: 3439 - protein, 118 aa, Streptococcus pneumoniae
MLEFIEYPKCSTCKKAKQELNQLGVDYKAVHIVEETPSQEVILNWLETSGFELKQFFNTSGIKYRELGLKDKVGSLSNQEAAELLASDGMLLKRPILVENGTVKQIGYRKSYEELGLK

SEQ ID NO: 3440 - protein, 125 aa, Streptococcus pneumoniae
MSCTKIGVPFKKLTKKACKGYKILTRLIFTMAKRSAKTKPKRAPPIVNIIVVGSCWTILGIPSKTERRLNSLPSGINCIKFWYQSDAKIVVTFIKTSSSDNDSFYHASAVNEIICYGQIQTLSTY

SEQ ID NO: 3441 - protein, 266 aa, Streptococcus pneumoniae
MNVTTILASDWYQNLMQLIPDGKLFSLRSVFDGIPRIVQQLPTTIMLTIGGALFGLVLALLFAIVKINRVKILYPLQAFFVSFLKGTPILVQLMLTYYGIPLALKALNQQWGTGLNINAIPAAAFAIVAFAFNEAAYASETIRAAILSVNPGEIEAARSLGMTRAQVYRRVIIPNAAVVATPTLINSLIGLTKGTSLAFSAGVVEVFAQAQILGGADYRYFERFISVALVYWVVNIGIESLGRFIERKMAISAPDTVQTDVKGDLR

SEQ ID NO: 3442 - protein, 247 aa, Streptococcus pneumoniae
MIKISNLSKSFSGQTVLDHLNLDIQKGEVVALIGSSGAGKSTFLRSLNYLETPDSGSIQIDGFSVDFSKITQEEILALRCKLSMVFQQFNLFERRTALDNVKEGLVVVKKLSDQEATKIAKEELAKVGLSDRENHYPRHLSGGQKQRVALARALAMKPDVLLLDEPTSALDPELVGEVEKSIADAAKSGQTMILVSHDMSFVAQVADKILFLDKGKIIESGTPDEIIHTPKEERTKEFFASYKRTYI

SEQ ID NO: 3443 - protein, 78 aa, Streptococcus pneumoniae
MREIMLLQLFSLYFESLILTTILVLIFLGIWIGLRAMSGVDKTAKARQAHLYDMIMIGVLVVPVLSFAVMSLILVFKA

SEQ ID NO: 3444 - protein, 73 aa, Streptococcus pneumoniae
IASSSIQGRSHPCRSSTDNNSIEHIDSFFLVVTIFILTLSCQSRKDYALKTRIKLITAKDNTGTTKTPIIIIS

SEQ ID NO: 3445 - protein, 265 aa, Streptococcus pneumoniae
MNNTSDIENYPGYANISGPELAEKMFEPLENLGVEHIYGYVENVEDHGDFKKVMTDDQTYETRTVIVATGSKHRPLGVPGEEELNSRGVSYCAVCDGAFFRDQDLLVVGGGDSAVEEALFLTRFAKTVTIVHRRDQLRAQKVLQDRAFANEKISFIWDSVVREIKGENRVESVVFENVKTGQVTEQVFGGVFIYVGLDPLSDFVKELNIQDQAGWIVTDNHMKTAVDGIFAVGDVRLKDLRQVTTAVGDGAIAGQEAYKFITEHS

SEQ ID NO: 3446 - protein, 253 aa, Streptococcus pneumoniae
LQDGVLCYNRDMKTNDIVYGVHAVTEALLANTGNKLYLQEDLRGKNVEKVKELATEKKVSISWTSKKSLSEMTEGAVHQGFVLRVSEFAYSELDYILAKTRQEENPLLLILDGLTDPHNLGSILRTADATNVSGVIIPKHRAVGVTPVVAKTATGAIEHVPIARVTNLNQTLYKLKDEGFWTFGTDMNGTPCHKWNTKGKIALIIGNEGKGISSNIKKQVDEMITIPMNGHVQSLNASVAAAILMYEVFRNRL

SEQ ID NO: 3447 - protein, 203 aa, Streptococcus pneumoniae
MSAIERITKAAHLIDMNDIIREGNPTLRAIAEEVTFPLSDQEIILGEKMMQFLKHSQDPVMAEKMGLRGGVGLAAPQLDISKRIIAVLVPNIVEEGETPQEAYDLEAIMYNPKIVSHSVQDAALGEGEGCLSVDRNVPGYVVRHARVTVDYFDKDGEKHRIKLKGYNSIVVQHEIDHINGIMFYDRINEKDPFAVKDGLLILE

SEQ ID NO: 3448 - protein, 83 aa, Streptococcus pneumoniae
VKEILICDIIKRKGLHKKVGRTKTTKKTKSKSGWFSFSFYEGLGKLFRSYRKWSNKGFVAILLLAVGLSMGLVLLFESFQGIP

SEQ ID NO: 3449 - protein, 160 aa, Streptococcus pneumoniae
VLDLAHNHILDSQIEGVISTADIIEKAGITPIGVYTHEPRDQAPLVIKEVNAIKVALLAYSYGFNGIEQYIFQEDYNRYLSDLNEDKIKAEVERAEKEADITIIMPQMGVEYRLEPTEEQKALYHKMIDWGADIIFGGHPHVVEPSETVEKDGDKKLIIY

SEQ ID NO: 3450 - protein, 125 aa, Streptococcus pneumoniae
MSFSCSDSCFSILLLDGDIHENTTFSPLSILFISHRFNPLIGNEVPHLIDNEFLISIFFNRFRWFNNVRMPSKDNIRSPIDHLVIKSFLFFSWFQSILNTHLRHDNGDICFLLCPFNFSLYLIFV

SEQ ID NO: 3451 - protein, 275 aa, Streptococcus pneumoniae
MMIKVIATDMDGTLLDARGQLDLPRLEKILDQLDQRGIRFVIATGNEIHRMRQLLSPLVDRVVLVVANGARIFENNELIQAQTWDDAIVNKALAHFKGRACQNQFVVTGMKGDFVKEGTIFTDLESFMTPEMIEKFYQRMQFVDELTSDLFGGVLKMSMVVGEERLSSVLEEINALFDGRVRAVSSGYGCIDILQAGIHKAWGLEELLKRWDLKSQEIMAFGDSENDVEMLEMAGIAYAMENADEKAKAVATALAPANSQGGVYQVLENWLEKGE

SEQ ID NO: 3452 - protein, 211 aa, Streptococcus pneumoniae
VVVQLLENWLLKEQEKIQTKYRHLNHISVVEPNILFIGDSIVEYYPLQELFGTSKTIVNRGIRGYQTGLLLENLDAHLYGGAVDKIFLLIGTNDIGKDVPVNEVLNNLEAIIQSVARDYPLTEIKLLSILPVNEGEKYQQAVYIRSNEKIQNWNQAYQELASAYMQVEFVPVFDCLTDQAGQLKKEYTTDGLHLSIAGYQALSKSLKDYLY

SEQ ID NO: 3453 - protein, 241 aa, Streptococcus pneumoniae
MNVNQIVRIIPTLKANNRKLNETFYIETLGMKALLEESAFLSLGDQTGLEKLVLEEAPSMRTRKVEGRKKLARLIVKVENPLEIEGILSKTDSIHRLYKGQNGYAFEIFSPEDDLILIHAEDDIASLVEVGEKPEFQTDLASISLSKFEISMELHLPTDIESFLESSEIGASLDFIPAQGQDLTVDNTVTWDLSMLKFLVNELDIASLRQKFESTEYFIPKSEKFFLCKDRNNVELWFEEV

SEQ ID NO: 3454 - protein, 311 aa, Streptococcus pneumoniae
MKWTKIIKKIEEQIEAGIYPGASFAYFKDNQWTEFYLGQSDPEHGLQTEAGLVYDLASVSKVVGVGTVCTFLWEIGQLDIDRLVIDFLPESDYPDITIRQLLTHATDLDPFIPNRDLLTAPELKEAMFHLNRRSQPAFLYSDVHFLLLGFILERIFNQDLDVILKDQVWKPWGMTETKFGPVELAVPTVRGVEAGIVHDPKARLLGRHAGSAGLFSTIKDLQIFLEHYLADDFARDLNQNFSPLDDKERSLAWNLEGDWLDHTGYTGTFIMWNRQKQEATIFLSNRTYEKDERAQWILDRNQVMNLIRKEE

SEQ ID NO: 3455 - protein, 298 aa, Streptococcus pneumoniae
MSNSLKGTLLTVVAGIAWGVSGTSGQYLMAHGISALVLTNLRLLIAGGILMILAYATAKDKILVFLKDRKSLLSLLIFALIGLFLNQFAYLSAIQETNAGTATVLQYVCPVGILIYSCIKDRVAPTLGEIVSIIFAIGGTFLIATHGQLDQLSMTPAGLFWGLFSALTYALYIILPIALIKKWGSSLVIGVGMVIAGLVALPFTGVLQANIPTSLDFLLAFAGIILIGTVFAYTAFLKGASLIGPVKSSLLASIEPISAVFFAFLIMNEQFYPIDFLGMAMILFAVTLISLKDLFLEK

SEQ ID NO: 3456 - protein, 232 aa, Streptococcus pneumoniae
MLPAYMKIHDQIKKDIDEHRWAIGERLPSERDLAEQFAVSRMTLRQAVSLLVEEGVLERRVGSGTFVSSTRVQEKMRGTTSFTEIVKSQGKVPSSQLISYKKTIPNEQEVAKLGIFPTDNIIRMERVRYADQVPLVYEVASIPEKFIKDFKKEEITSHFFQTLQKHGYRIGKSQQTIYARLAKEKIAHYLEVEKGHAILGLTQVSYLEDGTAFEYVKSQYVGERFEFYLENN

SEQ ID NO: 3457 - protein, 520 aa, Streptococcus pneumoniae
MSNISTDLQDVEKIIVLDYGSQYNQLISRRIREIGVFSELKSHKISAAEVREVNPVGIILSGGPNSVYEDGSFDIDPEIFELGIPILGICYGMQLLTHKLGGKVVPAGDAGNREYGQSTLTHTPSALFESTPDEQTVLMSHGDAVTEIPADFVRTGTSADCPYAAIENPDKHIYGIQFHPEVRHSVYGNDILRNFALNICKAKGDWSMDNFIDMQIKKIRETVGDKRVLLGLSGGVDSSVVGVLLQKAIGDQLICIFVDHGLLRKGEADQVMDMLGGKFGLNIVKADAAKRFLDKLAGVSDPEQKRKIIGNEFVYVFDDEASKLKDVKFLAQGTLYTDVIESGTDTAQTIKSHHNVGGLPEDMQFELIEPLNTLYKDEVRALGTELGMPDHIVWRQPFPGPGLAIRVMGEITEEKLETVRESDAILREEIAKAGLDRDIWQYFTVNTGVRSVGVMGDGRTYDYTIAIRAITSIDGMTADFAKIPWEVLQKISVRIVNEVDHVNRIVYDITSKPPATVEWE

SEQ ID NO: 3458 - protein, 61 aa, Streptococcus pneumoniae
MPQPIVPVEIPQSRLFDSKKRNDILLKIRIGKLEVSFFQSLNLEMVEQLLDKVLLYDNSSI

SEQ ID NO: 3459 - protein, 95 aa, Streptococcus pneumoniae
MTIHLSSLGQVYLVCGKTDMRQGIDSLAYLVKTHFELDPFSGQVFLFCGGRKDRFKALYWDGQGFWLLYKRFENGRLTWLSTEKDVKALAPEQVD

SEQ ID NO: 3460 - protein, 64 aa, Streptococcus pneumoniae
LKIIQQQSATIDSLTNELALLREQVAYLTQKLYGKSSEKSVCPSGQLNLFEEESPSEEDGDVPS

SEQ ID NO: 3461 - protein, 129 aa, Streptococcus pneumoniae
MENPLRKVFAPLDNSTFLRKSLHLRKMEMFPVETEEITYKRKKSKGKRQALLAQFDSEEVHHQVEERICPDCQGDLKEIGGSLQGQELVFIPAQLKRIDHIQHAYKCQACSDKNPSDKIVKAPIPKAPL

SEQ ID NO: 3462 - protein, 142 aa, Streptococcus pneumoniae
LVLISLAHSFGSVSIIAHTIHQKFNLKVPNYRQEEDWARMGLPITRKEISNWHIKASQYYLESLYNLLREKLLEQPLLHADETSYRVLESDSHLTYYWTFLSGKAENQAITLYHHDQRRSGLVVQEFLGDYSGYVHCDMLRQ

SEQ ID NO: 3463 - protein, 149 aa, Streptococcus pneumoniae
LVNCEPLEAYRQLEEAALVGCWAHVRRKFFEATPKQADKSSLGAKGLAYCDQLFSLERDWEALPADERLQKRQEELQPLIEDFFAWCRRQSVLAGSKLGRAIEYSLKYEETFKTILKDGHLVLSNNLAECAIKSLVMGRSKRVQWTLLA

SEQ ID NO: 3464 - protein, 77 aa, Streptococcus pneumoniae
PKLSLKKRGWLFSQSFEGAKARAIIMSLLETAKRHQLNSEKYLSYLLECLPNEETLVNKEVLEAYLPWTKVVQEKCK

SEQ ID NO: 3465 - protein, 454 aa, Streptococcus pneumoniae
MVEIKNLSLDYGEEHILDDISLSIAEGECVLFTGKSGNGKSSLINSINGLAVRYDNAKTKGEIIIDGKNIKNLELYQISMLVSTVFQNPKTYFFNVNTTLELLFYLENIGLAREEMDRRLKDILEIFPIKNLLNRNIFNLSGGEKQILCIAASYIAGTKIIVMDEPSSNLDIKSISVLAKMLKILKEKGISIIVAEHRIYYLMDIVDRVFLIDKGKLKKTYTRSEFLKLDKNELNALSLRDKELSKLKVPYLKEGGEYQIKNLSYKFTDDECLSLKDISFKLGKIYGIIGSNGRGKSTLLRCLIGLEKKSKEEIYFKGEKLSKKERLKNSSLVMQDVNHQLFTDEVFNELRLGVKNFDEEKAKIILKDLCLDEFIERHPMSLSGGQKQRLAIASVMCKNSPFVFFDEPSSGMDYSNMIKISELINKYKTMDKIIFIVSHDIEFLNEVADEIFEL

SEQ ID NO: 3466 - protein, 73 aa, Streptococcus pneumoniae
SIPLEGSSKKTNGEFLHITDAIASLCFCPPDKLIGCLSINSSRHKSFKMIFAFSSSKFFTPNLSSLNTSSVNN

SEQ ID NO: 3467 - protein, 231 aa, Streptococcus pneumoniae
MPTFSSNAPFNPNPISKILVVFITGLTVMHSINIRFELAIVCLIGILLYLNGYKKTLFKWIILCGILYSLPNFMVLSELNPIVKMFLSIPIVIRMFILPFMAASFMIKTSDVGAIISSMDKLKISKNVSIPIAVMFRFFPSFKEEKKNIKMAMRVRGINFKNPVKYLEYVSVPLLIISSNISDDIAKAAETKAIENPIAKTRYIRVKIQLIDFVYVLAVAGLIVGGLIWLK

SEQ ID NO: 3468 - protein, 194 aa, Streptococcus pneumoniae
MDNKKLKVKDLVSIGVFGVIYFAFMFGVGMMGLIPILFLIYPTVLAIVAGTVVMLFMAKVQKPWALFIFGMISPLVMFAAGHTYVVVVLSLIVMIIAELIRKIGNYNSFKYNMLSYAIFSTWICSSLMQMLLAKEKYMEWSLMTMGKDYVDVLEKLITYPHMALVALGAFLGGILGAYIGKALLKKHFEKAGIV

SEQ ID NO: 3469 - protein, 581 aa, Streptococcus pneumoniae
LRMNGGFQMKEFYKKRFALTDGGARNLSKATLASFFVYCINMLPAILLMIFAQEVLENMGKSNGFYIVFSVLILIAMYILLSIEYDKLYNTTYQESADLRIRTAENLSKLPLSYFSKHDISDISQTIMADIEGIEHAMSHSIPKVGGMVLFFPLISVMMLAGNVKMGLAVIIPSILSFIFIPLSKKYQVNGQNRYYDVLRKNSESFQENIEMQMEIKAYNLSKDIKDDLYKKMEDSEKVHLKAEVTTILTLSISSIFSFISLAVVIFVGVNLIINKEINSLYLIGYLLAAMKIKDSLDASKEGLMEIFYLSPKIERLKEIQNQDLQEGDDYSLKKFDIDLKDVEFAYNKDEKVLNGVSFKAKQGEVTALVGASGCGKTTILKLISRLYDYDKGQILIDGKDIKEISTESLFDKVSIVFQDVVLFNQSVMENIRIGKQDASDEEVKRAAKLANCTDFIEKMDKGFDTVIGENGAELSGGERQRLSIARAFLKDAPILILDEITASLDVNNEKKIQESLNNLVKDKTVVIISHRMKSIENADKIVVLQNGRVESEGKHEELLQKSKIYKNLIEKTKMAEEFIY

SEQ ID NO: 3470 - protein, 586 aa, Streptococcus pneumoniae
MLMKIYKKLFAYVQDKKYLGVLAIIFSAISAALTVYGYYLIYKFLDKLIINSNLSGAESIALKSVITLTSGAIFYFVSGMFSHILGFRLETNLRKRGIDGLEKASFRFFDLNPSGQIRKIIDDNAAQTHQVVAHMIPDSSQAIITPVLVLALGFIVSIRVGIILLALTIIGGLILGAMMGEQEFMKIYQESLSKLSAETVEYVRGMQVVKIFKANVESFKSFYKAIKDYSKYAYDYSLSCKRPYVLYQWLFFGLIAILIIPIVYFMTSLASAKVILLELIMILFLSGVLFVSFMRMMWYSMYISQGNYAVDTLEALYEDMQKDKLVHGNVNNFKNYNIEFENVSFAYNDKAVIENLSFNLEEGKSYALVGSSGSGKSTVAKLISGFYNVNKGSIKIGGIAISEYSDEALIKAISFVFQDSKLFKKSIYDNVALANKDATKDDVMRALKLAGCDLILDKFPERENTIIGSKGVYLSGGEKQRIAIARAILKDSKIIIMDEASASIDPDNEFELQKAFKNLMKDKTVIMIAHRLSTIKDLDEIIVMDSGKIIERGSDKELMSKDTRYKSLQEMFNIANEWRVSNERVL

SEQ ID NO: 3471 - protein, 158 aa, Streptococcus pneumoniae
ILNCKMDAPAADFFFKAKANEWISIVIDTYLNRKKYKIEIDDDKALEDVARFLDDHFATNVNQGTLEKISKMSGTKLKNLFKEKYCQSITEYTQRKRMNVAETLLLNTELPIKEIAESVGYSSASKFSIYYKRYKGKLPSEVRNLACKHHNFKCDYCD

SEQ ID NO: 3472 - protein, 68 aa, Streptococcus pneumoniae
SSKNLATSSSALSSSISILYFFLFKYVSITILIHSFAFALKKKSAAGASILQFNISIATLSKAFVSII

SEQ ID NO: 3473 - protein, 396 aa, Streptococcus pneumoniae
MTVLKGDNLEILKTIESSSIDLIYMDPPFFTQKTQKLSNNKNIMYSFEDTWTSIEDYKEFLSVRLEECKRVLKNSGSIFVHCDKIANHHIRLILDNIFGADMFQSEIIWNYKRWSNSKKGLLNNHQNIYFYSKSKDFKFNTIFTEYSSTTNIDQILVERKRDGNSKTIYKVDNNGNYILAKEKNGVPLSDVWNIPFLNPKAKERVGYPTQKPILLLEQIIKIATDKNDIVLDPFCGSGTTLVASKILNRNYMGIDLSEEAINITQQRLENVIKTSSNLLNKGIEAYRTKTEEEENILKLLQAKIVQRNKGIDGFLPKHFQKKPIPIKIQKNNECLNESISLLQNAINSKKLDFGVVIKTHSDNLLFDFDTIPENIIVVDHFELTIEKWLSKSQQLL

SEQ ID NO: 3474 - protein, 62 aa, Streptococcus pneumoniae
MFYYPNRTQAIKIQQTLETLYNGIGGKYYGDSAWEHLRAVTGIDLLSILTDIANKKTGVKSK

SEQ ID NO: 3475 - protein, 60 aa, Streptococcus pneumoniae
MANDNKSHYLIYRVLGISFEEGENIDLYQNKGRFLYKYAGSFLEEAAVLSFNEKFGTENT

SEQ ID NO: 3476 - protein, 70 aa, Streptococcus pneumoniae
MNRDVANKLNNIFGKMRNSNITRTFRNNQYLKRKKLKEFIKPCYNRYSYNFIYNKRIEMTELERKNRKIS

SEQ ID NO: 3477 - protein, 428 aa, Streptococcus pneumoniae
MTKTLKRPEVLSPAGTLEKLKVAVQYGADAVFIGGQAYGLRSRAGNFTFEQMEEGVQFAAKYGAKVYVAANMVMHEGNEAGAGEWFRKLRDIGIAAVIVSDPALIMIAATEAPGLEIHLSTQASATNYETLEFWKELGLTRVVLAREVSMEELAEIRKRTDVEIEAFVHGAMCISYSGRCTLSNHMSMRDANRGGCSQSCRWKYDLYDMPFGKERKSLQGEIPEEFSMSAVDMSMIDHIPDMIENGVDSLKIEGRMKSIHYVSTVTNCYKAAVDAYLESPEKFEAIKQDLVDEMWKVAQRELATGFYYGIPSENEQLFGARRKIPEYKFVAEVVSYDDAVQTATIRQRNVINEGDQVEFYGPGFRHFETYIEDLHDAKGNKIDRAPNPMELLTIKVPQPVQSGDMVRALKEGLINFYKEDGTSVTVRA

SEQ ID NO: 3478 - protein, 242 aa, Streptococcus pneumoniae
SMRDANRGGCSQSCRWKYDLYDMPFGKERKSLQGEIPEEFSMSAVDMSMIDHIPDMIENGVDSLKIEGRMESIHYVLTVTNCYKAAVDAYLESPEKFEAIKQDLVDEMWKVAQRELATGFYYGTPSENEQLFGARRKIPEYKFVAEVVSYDDAAQTATIRQRNVINEGDQVEFYGPGFRHFETYIEDLHDAKGNKIDRAPNPMELLTIKVPQPVQSGDMVRALKEGLINLYKEDGTSVTVRA

SEQ ID NO: 3479 - protein, 240 aa, Streptococcus pneumoniae
LMKILVQNNQPTSGNIISSDNIGYLIEEPKLFLSKTGLENLKYLSNLYGVDYNQERFRSLIQELDLTQSINKKVKTYSLGTKQKLALLLTLVTKPDILILDEPTNGLDIESSQIVLAVLKKLALNENVGILISSHKLEDIEEICERVLFLESGLLTFQKVGKDSHNFLFEIAFSSATDRDIFITKQEFGDIVQEEGLRITMSGNIQSSELFKFFNENSIKVVDFETKKETLKDIYLNRSK

SEQ ID NO: 3480 - protein, 242 aa, Streptococcus pneumoniae
MKLNKLNFLKENIRNLYSSGVIYLSLLISFIPPILLTFFILKTQGTSLGIKHISNFYAMLGMLMAVIHANRVISRDFSHNTVSLFYNQQKNRMIYVLSNFLYAISVSIIYALNGIVLLVIVSKLGIPGDLGLDFIVAIVVNTILLVLFYFLLSYIFYLYKLKSGLVFGILVALLLFIPNILNTMMMNTSNDLFIKAIELLPFYSLPVFVASNTMSISQYLVLITTIILLYFFTLKKSKKYSF

SEQ ID NO: 3481 - protein, 79 aa, Streptococcus pneumoniae
MNIKIIRRTKVVKNLKLKLARVELDLTQGQLADAVGVTRQTIGLIEAGKYNPSLSLCQSICRCLGKTLDQLFWEEEDEK

SEQ ID NO: 3482 - protein, 162 aa, Streptococcus pneumoniae
MKNRFYYYQLLDEREEQLFNKAGSESFYICIALSLLSYIISVLAPSLFNSNMLLIVIIIGTFYFFNRARYLGVTYYSRFHFTILGCFFLTLAITALLMLQNYQFNIEIYQHNPLNFKYLSAWVITYVIYLPWVFIGNLGLKSYGEWAQKKFEQDMDELESGE

SEQ ID NO: 3483 - protein, 486 aa, Streptococcus pneumoniae
MYPDDSLTLHTDLYQINMMQVYFDQGIHNKKAVFEVYFRQQPFKNGYAVFAGLERIVNYLEDLRFSDSDIAYLESLGYHGAFLDYLRNFKLELTVRSAQEGDLVFANEPIVQVEGPLAQCQLVETALLNIVNYQTLVATKAARIRSVIEDEPLMEFGTRRAQEMDAAIWGTRAAVIGGANGTSNVRAGKLFDIPVLGTHAHALVQVYGNDYEAFKAYAATHKNCVFLVDTYDTLRIGVPAAIQVARELGDQINFMGVRIDSGDIAYISKKVRQQLDEAGFTEAKIYASNDLDENTILNLKMQKAKIDVWGVGTKLITAYDQPALGAVYKIVAIEDETGQMRNTIKLSNNAEKVSTPGKKQVWRITSREKGKSEGDYITYDGVDISDMTEIKMFHPTYTYIKKTVRNFDAVPLLVDIFKEGILVYNLPSLTDIQDYARKEFDKLWDEYKRVLNPQHYPVDLARDVWQDKMDLIDKMRKEALGEGEEE

SEQ ID NO: 3484 - protein, 274 aa, Streptococcus pneumoniae
MSLQETIIQELGVKPVIDAQEEIRRSIDFLKRYLKKHPFLKTFVLGISGGQDSTLAGRLAQLAMEELRAETGDDSYKFIAVRLPYGVQADEADAQKALAFIQPDVSLVVNIKESADAMTAAVEATGSPVSDFNKGNIKARCRMIAQYALAGSHSGAVIGTDHAAENITGFFTKFGDGGADILPLYRLNKRQGKQLLQKLGAEPALYEKIPTADLEEDKPGLADEVALGVTYAEIDDYLEGKTISPETQATIENWWHKGQHKRHLPITVFDDFWE

SEQ ID NO: 3485 - protein, 65 aa, Streptococcus pneumoniae
KAKQSAQKLKRPLKTGGTKANTNATYPSPYLMTFGSKKVRGTFLASCPEIKKQEKPPLEVFSLSS

SEQ ID NO: 3486 - protein, 183 aa, Streptococcus pneumoniae
MKSIGTQILQTERLILRRFVESDAEAMFQNWASSAENLTYVTWNPHPDVEITRNSIRNWVASYTNLNYYKWAICLKENPEQVIGDISIVKIDEADLSCEIGYVLGKAYWGHGMMTEALKAVLDFCFTQAGFQKVRARYASLNPASGRVMEKAGMSYLQTIVNGVERKGYLADLIYYGISREEC

SEQ ID NO: 3487 - protein, 249 aa, Streptococcus pneumoniae
TRKDFWFCGNRANFIFRRNLNTSFVHAADGIQYVRDDTRDKEEGIEYDDADNGDIIVKVATKPKVVTKKISSTRIRYEKDETKDRSENPVTIDGEDGYVTTTRTYDVNPETGHVTEQVTVDRKEATDTVIKVPAKSKVEEVFVPFATKYEADNDLSAGQEQEITLGKNGKTVTTITYDVDGKSGQVTESTLSQKEDSQTRVVKKGTKPQVLVQEIPIETEYLDGPTLDKSQEVEEVGEIGKLLLLQSIL

SEQ ID NO: 3488 - protein, 129 aa, Streptococcus pneumoniae
MVKRRIRRGTREPEKVVVPEQSSIPSYPVSVTSNQGTDVAVEPAKAVAPTTGWKQENGMWYFYNTDGSMATGWVQVNGSWYYLNSNGSMKVNQWFQVGGKWYYVNASGELAVNTSIDGYRVNDNGEWVR

SEQ ID NO: 3489 - protein, 346 aa, Streptococcus pneumoniae
MNKYMNTADFDFHLPEELIAQTPLEKRDASKLLIVNRETGEMQDKHFHSIIDMLEPGDALVMNDTRVLPARLYGQKVETGGHVELLLLKNTSGDEWEVLAKPAKRLKVGTRISFGDGRLSAVVTEELTHGGRIVRFEYQGIFLEVLESLGEMPLPPYIHEKLDDRERYQTVYAKESGSAAAPTAGLHFTKELLAEIQAKGVHLVYLTLHVGLGTFRPVSVDNLDEHEMHSEFYQLSEEAAATLRSVKENGGRVIAVGTTSIRTLETIGSKFDGQIQADSGWTNIFIKPGYEWKVVDAFSTNFHLPKSTLVMLVSAFAGRELVLDAYHHAIQEHYRFFSFGDAMFIY

SEQ ID NO: 3490 - protein, 235 aa, Streptococcus pneumoniae
MKVIKVENQVQGGKVAFEILKEKLANGAQTLGLATGSSPLEFYKEIVESDLDFSNLTSVNLDEYVGLDGDNPQSYRYFMQENLFNQKPFKESFLPRGVKDNAEAEVERYNQILADHPVDLQILGIGRNGHIGFNEPGTPFDSQTHLVELDQSTIEANARFFAKIEDVPTQAISMGIKNILDAKSIILFAYGESKAEAIAGTVSGPVTENLPASSLQNHPDVTIIADAEALSLLEK

SEQ ID NO: 3491 - protein, 66 aa, Streptococcus pneumoniae
LNLKGVKKMSKTVVRKNESLDDALRRFKRAVTKAGTLQETRKREFYEKPSVKRKRKSEVARKRKKF

SEQ ID NO: 3492 - protein, 312 aa, Streptococcus pneumoniae
MMSVLVKEVIEKLRLDIVYGEPELLEKEINTADITRPGLEMTGYFDYYTPERIQLLGMKEWSYLISMPSNSRYEVLKKMFLPETPAVIVARGLVVPEEMLKAARECKIAILTSRAATSRLSGELSSYLDSRLAERTSVHGVLMDIYGMGVLIQGDSGIGKSETGLELVKRGHRLVADDRVDIFAKDEITLWGEPAEILKHLIEIRGVGIIDVMSLYGASAVKDSSQVQLAVYLENYDTHKTFDRLGNNAEELEVSGVAIPRIRIPVKTGRNISVVIEAAAMNYRAKEMGFDATGWFDDRLPSLIARNEVQNA

SEQ ID NO: 3493 - protein, 191 aa, Streptococcus pneumoniae
YKSQNLERILPIWNGGLPIYGGLKTGALVLYIFAARKLINTWDFLDIAAPSVMIAQSLGRWGNFFNQEAYGATVDNLDYLPGFIRDQMYIEGSYHQPTFLYESLWNLLGFALILIFRRKWKSLRRGHITAFYLIWYGFGRMVIEGMRTDSLMFFGLRVSQWLSVVFIGLGIMIVIYQNRKKAPYYITEEEN

SEQ ID NO: 3494 - protein, 127 aa, Streptococcus pneumoniae
MLEVAYILVALAVIVFLVYLIITVQKLGRVIDETEKTIKTLTSDVDVTLHHTNELLAKVNVLADDINVKVATIDPLFSAVADLSLSVSDLNDHARVLSKKASSAGSKTLKTGASLSALRLASKFFKK

SEQ ID NO: 3495 - protein, 109 aa, Streptococcus pneumoniae
LPLSLVKNKARAAPETVPKRIEDNLPIRILLFYFLKNLLARRRADRLAPVLSVFEPADEAFLLKTRAWSLRSETDRDKSATALKSGSIVATLTLISSAKTLTLANNSLV

SEQ ID NO: 3496 - protein, 129 aa, Streptococcus pneumoniae
MGKLSSILLGTVSGAALALFLTSDKGKQVCSQAQDFLDDLREDPEYAKEQVCEKLTEVKEQATDFVLKTKEQVESGEITVDSILAQAKSYAFQATEASKNQLNNLKEQWQEKAEALDDSEEIVIDITEE

SEQ ID NO: 3497 - protein, 376 aa, Streptococcus pneumoniae
MQKKPTSAYVHIPFCTQICYYCDFSKVFIKNQPVDSYLEHLLEEFRSYDIEKLSTLYIGGGTPTALSAPQLEVLLNGLTKNLDLSVLEELTIEANPGDLDADKIAVLKNSAVNRVSLGVQTFDDKMLKKIGRSHLEKDIYENIDRLKLAGFDNISIDLIYALPGQTMEQVKENVAKAIGLDIPHMSLYSLILENHTVFMNRMRRGKLPLPKEELEAEMFEYIIAELERAGFEHYEISNFSKPGFESRHNLMYWDNAEYYGIGAGASGYVNGVRYKNHGPIRHYLSAVEEGNACITEDHLSQKEQMEEEMFLGLRKKSGVSMARFEEKFGQSFAGLYGEIVRDLVQQGLMQIEGDHVRMTKRGLFLGDTVAERFILE

SEQ ID NO: 3498 - protein, 165 aa, Streptococcus pneumoniae
MILLQNKSFCYSISQKETSLCHANVVTLNLHEALLNQISDNFSIKSSKRLSKFFLKSRHGNPGFLAESQEHFFFHLLLLTQVIFCNTSIAFLNRTEIMTNGTMIFIAYSIDITRCPCTNTIVFSIVPVHEIMTTFKAGFGEIRNLIMLKTRSLQLCNDVLKHLRF

SEQ ID NO: 3499 - protein, 245 aa, Streptococcus pneumoniae
MGLTYQMKMKIPFDMADMNGHIKLPDVILLSLQVSGMQSIELGVSDKAILEEYNLVWIIVEYDIEVFRLPRFAEEITIETEALSYNRLFCYRRFTIYNEAEQELIHMMATFVLMDRDSRKVHVVEPEIVAPYQSDFDKKLIRGPKYESLEEPISKDYHVRFYDLDMNGHVNNSKYLDWIFEVMGADFLTHYIPKKINLKYVKEVRPGGVITSAVERTGLESKHEITSDGVINAQAIITWQEIKKA

SEQ ID NO: 3500 - protein, 202 aa, Streptococcus pneumoniae
LAQNFNIDTPLSTVYTATLATIDYMNDLGLEKTVYVVGEAGLKEAIKAAGYVEDKEKPAYVVVGLDWQVDYEKFATATLAIQKGAHFIGTNPDLNIPTERGLLPGAGSLITLLEVATRVKPVYIGKPNAIIMDKAVEHLGLEREELIMVGDNYLTDIRAGIDNGIPTLLVTTGFTKAEEVAGLPIAPTHVVSSIAEWDFDEN

SEQ ID NO: 3501 - protein, 216 aa, Streptococcus pneumoniae
MWFLALRSGILMKTKLIFWGSMLFLLSLSILLTIYLAWIFYPMEIQWLNLTNRVYLKPETIQYNFHILMNYLTNPFSQVLQMPDFRSSAAGLHHFAVVKNLFHLVQLVALVTLPSFYVFVNRIVKKDFLSLYRKSLLALVVLPVMIGLGGVLIGFDQFFTLFHQILFVGDDTWLFDPAKDPVIMILPETFFLHAFLLFFALYENFFGYLCLKSRRK

SEQ ID NO: 3502 - protein, 107 aa, Streptococcus pneumoniae
LTQLDLVNSLLTMVLNDIYIYIYICKLKTSFLSLPTTFQTQIAKEVFIEGKKEEEGMKKEGLWQNHNNRILGWIKKPGIISHKENLMEKSKELVKTNQNSPKSNHYR

SEQ ID NO: 3503 - protein, 133 aa, Streptococcus pneumoniae
MITLFLSPSCTSCRKAKAWLEKHKVPFVEHNIMTSPLTRKELQHILSLTENGTDDIISTRSKIFQKLNIDVESISVSELLHLIEQYPSLLRRPIIIDAKRMQIGFNEDEIRAFLPRSYRKQELKEARMRAGIS

SEQ ID NO: 3504 - protein, 92 aa, Streptococcus pneumoniae
MNKQYSYPLDLSWSTEELVSVLSFFNDVEAAYEGKVEAKKLLDSYKGFKAVVPSKSEEKRLGREFETVSGYSLYRAVQAAKEKGEGKISLGK

SEQ ID NO: 3505 - protein, 282 aa, Streptococcus pneumoniae
LKRLVAIHFTEQFRLPKKKGKERFLLESKFEFAKELVKKAGQYILDHMQEDLRVETKSSPTDLVTRLDKEVQELLVGEILSRYPEDKICAEEGCLRASVQEGKVWVIDPIDGTNNFVAQQEDFAVMMAYFENGQGQFGLIYDVVKGDCYHGGGEFPVCLNDRSLAPFKTKPLGDFLIAGNSGMLETNEWGLADLSRSVLGVRVYGSAAISFAKILSGRLLTYLTYLQPWDYAAASILGESLGYRVVTLFGEAPDFQTRQPVMMVPLEMQEEIQSYIYERKRT

SEQ ID NO: 3506 - protein, 112 aa, Streptococcus pneumoniae
MQFPEGFVEKYKEILGDEARDFLASFEEEAVSAFRVNPLQEEQLSFSDAITQTPWGHYGKVSGTSPDHATGLVYPQETAAQMVAQVAQPSPGMKVLDWLLHRGANQLNWQPI

SEQ ID NO: 3507 - protein, 304 aa, Streptococcus pneumoniae
LVENMERFGATNVVVTNESADRLVKVFKGYFDLIVLDAPCSGEGMFRKQPDAMDYWSLDYPSQCASLQREILWEDAVTMLAEGGHLVYSTCTWAPEENEEIVNWLLEEYDFDLLPVEHINGMVAGIDLPETARMYPHQFKGEGQFVAHLQFKGNNPAPKFKASKSNLSREQVALWQEFAQNHLKVNLPGILQTFGDQLYLLPELLPDLGKLKIARNGLHLGTFKKKRFEPSFALGLALKPSQVEQSVEIGQEAFVKYAAGEIVQLAESLPNGWYQVLVKGNGLGFAKVTGNVLKNYFPKGLRFK

SEQ ID NO: 3508 - protein, 75 aa, Streptococcus pneumoniae
AILLFPNLLFSYVDKISCLSLPPLSPIIVISCLFFPFLMQGKLLSLDDNPKARKVSQTSLLSQTSLQLKGKDSIL

SEQ ID NO: 3509 - protein, 55 aa, Streptococcus pneumoniae
LRRNLVRIHASTHKELLKKFTVFIIIFEEKNSEKKKKACSVSYRFLADGLFSRLC

SEQ ID NO: 3510 - protein, 77 aa, Streptococcus pneumoniae
LTVFPTWIVPNSSAATSTKGCKAVEPTAVMDSPRSIQLAQPTKQAVSQKAIRDRASFFLFFTVFLLENNYEYCEFFK

SEQ ID NO: 3511 - protein, 292 aa, Streptococcus pneumoniae
VKKRKKLALSLIAFWLTACLVGCASWIDRGESITAVGSTALQPLVEVAADEFGTIHVGKTVNVQGGGSGTGLSQVQSGAVDIGNSDVFAEEKDGIDASALVDHKVAVRGLALIVNKEVDVDNLTTEQLRQIFIGEVTNWKEVGGKDLPISVINRAAGSGSRATFDTVIMEGQSAMQSQEQDSNGAVKSIVSKSPGAISYLSLTYIDDSVKSMKLNGYDLSPENISSNNWPLWSYEHMYTLGQPNELAAEFLNFVLSDETQEGIVKGLKYIPIKEMKVEKDAAGTVTVLEGRQ

SEQ ID NO: 3512 - protein, 305 aa, Streptococcus pneumoniae
MNQEELAKKMLLPSKNSRLEKLGKGLTFACLSLIVILVAMILVFVAQKGLSTFFVNGVNIFDFLLGGTWNPSSKEFGALPMILGSFIVTILSALIATPFAIGAAVFMTEVSPKGAKILQPAIELLVGIPSVVYGFIGLQVVVPFVRSVFGGTGFGILSGISVLFVMILPTVTFMTTDSLRAVPRYYREASFAMGATRWQTIWRVILKAARSGIFTAVVFGMARAFGEALAIQMVVGNSAVIPTSLTTPAATLTSILTMGIGNTVMGTVNNNVLWSLALVLLLMSLVFNSVIKLITKERGKKNYAR

SEQ ID NO: 3513 - protein, 294 aa, Streptococcus pneumoniae
MRAKKLDKLATAVLYTIASIIVTILASLILYILVRGLPHISWSFLTGRSSAFQAGGGIGIQLYNSFFLLVITLIISVPLSMGAGIYLAEYAKKGPVTNFVRTCIEILSSLPSVVVGLFGYLIFVVQFEYGFSIISGALALTVFNLPQMTRNVEDSLKHVHHTQREAGLALGISRWETVVHVVIPEALPGIVTGVVLASGRIFGEAAALIYTAGQSAPALDWSNWNILSVTSPISIFRQAETLAVHIWKVNSEGTIPDGTIVSAGSAAVLLIFILIFNFGARKFGSYLHKKLTAA

SEQ ID NO: 3514 - protein, 267 aa, Streptococcus pneumoniae
MSTYNWDEKHILTFPEEKVALSTKDVHVYYGKNESIKGIDMQFERNKITALIGPSGSGKSTYLRSLNRMNDTIDIAKVTGQILYRGIDVNRPEINVYEMRKHIGMVFQRPNPFAKSIYRNITFAHERAGVKDKQVLDEIVETSLRQAALWDQVKDDLHKSALTLSGGQQQRLCIARAISVKPDILLMDEPASALDPIATMQLEETMFELKKNFTIIIVTHNMQQAARASDYTGFFYLGDLIEYDKTATIFQNAKLQSTNDYVSGHFG

SEQ ID NO: 3515 - protein, 252 aa, Streptococcus pneumoniae
MTDAILQVSDLSVYYNKKKALNSVSLSFQPKEITALIGPSGSGKSTLLKSLNRMGDLNPEVTTTGSVVYNGHNIYSPRTDTVELRKEIGMVFQQPNPFPMTIYENVVYGLRINGIKDKQVLDEAVEKALQGASIWDEVKDRLYDSAIGLSGGQQQRVCVARVLATSPKIILLDEPTSALDPISAGKIEETLYGLKDKYTMLLVTRSMQQASRISDKTGFFLDGDLIEFNDTKQMFLDPQHKETEDYITGKFG

SEQ ID NO: 3516 - protein, 217 aa, Streptococcus pneumoniae
MLRSQFEEDLEKLHNQFYAMGQEVLSQINRTVRAFVTHDRDLAKEVIEDDAEVNEYEVKLEKKSFEMIALQQPVSQDLRTVLTVLKAVSDVERMGDHAVAIAQATIRMKGEERIPAVEEEIKKMGREVKSVVEAALDLYLNGSVDDAYRVASMDEQINHYFETIRDLATEEIKKNPEAIVTGRDYFQVISYLERIGDYAKNICEWVVYFETGKIVEL

SEQ ID NO: 3517 - protein, 271 aa, Streptococcus pneumoniae
MKSKKWIFVLCNFLASFFLVACQSGSNGSQSAVEAIKQKGKLVVATSPDYAPFEFQSLVDGKNQVVGADIDMAQAIADELGVKLEISSMSFDNVLTSLQTGKADLAVAGISATDERKEVFDFSIPYYENKISFLVRKADVEKYKDLTSLESANIAAQKGTVPESMVKEQLPKAQLTSLTNMGEAVNELQAGKVDAVHMDEPVALSYAAKNAGLAVATVSLKMKDGDANAVALRKNSDDLKEVVDKVIQKLKDEGIYQSYLEKAASLTEVEE

SEQ ID NO: 3518 - protein, 423 aa, Streptococcus pneumoniae
MKKQSKYKEVVSYLKNGIESGRFPTGSRLPSIRQLSLDFHCSKDTIQRALLELRHEQYLYAKPQSGYYVLEQGQHQDLEIEVTDEHASAYDDFRLCVNETLIGRENYLFNYYDNQEGLEDLRQSIHKLLFEQALYCKANQLVLTSGTQQALFILSQISFPRQAKEILVEQPTYHRMNRLLIAQGLDYQTIERGIDGIDLEELEGHFKTGKIKFFYTIPRFHYPLGHSYSEQDKRSILNLAAKYDVYIVEDDYLGDLDSKKGQTFHYLDTEEHVIYIKSFSTSLFPALRITALILPNAIKEAFVAYKNILDYDSNLIMQKALSLYIDSQLFEKNRLARLTNHESYQKQIEERITKTPCPLPHYPLHDGLLLDLRQYPKIASLKHSQLGLDFFEEAYLSTCPYQFAKVSLDNLENVLNYLKAELE

SEQ ID NO: 3519 - protein, 56 aa, Streptococcus pneumoniae
LPLDVNERNVLDIAKKEKKGYNVTKSREVWNEETKQVQRGRFLSEKWYRVWTISDG

SEQ ID NO: 3520 - protein, 170 aa, Streptococcus pneumoniae
MDKNVQEPVKLFQYNTLGALMAGLYGGTMTVGELLEHGDLGLGTLDSIDGELIVLDGKAYQAKGSGDQPEIVEVSPDALIPYAAVVPHQAEVIFRQRFEMTDKELKERIESYYDGENLFRSIKIRGEFLHMHVRMIPKSTPDTKFADVATHQPEYSRDNVAGTIVGFLDA

SEQ ID NO: 3521 - protein, 66 aa, Streptococcus pneumoniae
VAGYHLHFISNDFTFGGHVMILFIKEGIIELGAVDQWDQRFPVQDRQYLFVKFNVAEMKKDIEKAE

SEQ ID NO: 3522 - protein, 242 aa, Streptococcus pneumoniae
MLLLLAFLIGSIWFAKKKYQINLAVLGLGAVAFFVSSQILEKLVHILILHPQKDGSIALLQDHPLIYIIYGLAMAAFFEETARLVFFKWLEKKRSLEKADALAYGLGHGGLELIFLGLTSLLNLYIVLSTVQTQNPQVMQLLSENMLKTIQSLSVWQIYLLGFERILALGFQLLLTVWVYQAVRQKKWIYLLAAYGLHAFFDLAPSLSQVGWLTNPVLVEVILALELVLVAYGTKEIFCKKS

SEQ ID NO: 3523 - protein, 301 aa, Streptococcus pneumoniae
MSVREKMLEILEGIDIRFKEPLHSYSYTKVGGEADYLVFPRNRFELARLVKFANQENIPWMVLGNASNIIVRDGGIRGFVILCDKLNNVSVDGYTIEAEAGANLIETTRIALRHSLTGFEFACGIPGSVGGAVFMNAGAYGGEIAHILQSCKVLTKDGEIETLSAKDLAFGYRHSAIQESGAVVLSVKFALAPGTHQVIKQEMDRLTHLRELKQPLEYPSCGSVFKRPVGHFAGQLISEAGLKGYRIGGVEVSEKHAGFMINVADGTAKDYEDLIQSVIEKVKEHSGITLEREVRILGESK

SEQ ID NO: 3524 - protein, 378 aa, Streptococcus pneumoniae
LKKPIIEFKNVSKVFEDSNTKVLKDINFELEEGKFYTLLGASGSGKSTILNIIAGLLDATTGDIMLDGVRINDIPTNKRDVHTVFQSYALFPHMNVFENVAFPLRLRKIDKKEIEQRVAEVLKMVQLEGYEKRSIRKLSGGQRQRVAIARAIINQPRVVLLDEPLSALDLKLRTDMQYELRELQQRLGITFVFVTHDQEEALAMSDWIFVMNDGEIVQSGTPVDIYDEPINHFVATFIGESNILPGSMIEDYLVEFNGKRFEAVDGGMKPNEPVEVVIRPEDLRITLPEEGKLQVKVDTQLFRGVHYEIIAYDELGNEWMIHSTRKAIVGEEIGLDFEPEDIHIMRLNETEEEFDARIEEYVEIEEQEAGLINAHSRS

SEQ ID NO: 3525 - protein, 108 aa, Streptococcus pneumoniae
MKKTSSKLFVVPYMLWIALFVLAPLVLIFGQSFFNIEGQFSLENYKSYFASQHLTYLINEFQLSALCRDCDLCDLSYQLSNSPLFDPSQAPSTLAHADYPSYLDQFAP

SEQ ID NO: 3526 - protein, 210 aa, Streptococcus pneumoniae
MSFNSVLYAGIVTFVTCLISYPTALFLTRLKHRQLWLMLIILPTWINLLLKAYAFIGIFGQNGSINQFLEFIGIGSQQLLFTDFSFIFVASYIELPFMILPIFNVLDDMDNNLINASYDLGATKWETFRHVIFPLSMNGVRSGVQSVFIPSLSLFMLTRLIGGNRVITLGTAIEQNFLTNDNYGMGSTIGVILILTMFITMWVTKERRER

SEQ ID NO: 3527 - protein, 257 aa, Streptococcus pneumoniae
MKKFANLYLGLVFLVLYLPIFYLIGYAFNAGDDMNSFTGFSWTHFETMFGDGRLMLILAQTFFLAFLSALIATIIGTFGAIYIYQSRKKYQEAFLSLNNILMVAPDVMIGASFLILFTQLKFSLGFLTVLSSHVAFSIPIVVLMVLPRLKEMNGDMIHAAYDLGASQFQMFKEIMLPYLTPSIITGYFMAFTYSLDDFAVTFFVTGNGFSTLSVEIYSRARKGISLEINALSALVFLFSIILVVGYYFISREKEEQA

SEQ ID NO: 3528 - protein, 225 aa, Streptococcus pneumoniae
MKKIYSFLAGIAAIILVLWGIATHLDSKINSRDSQKLVIYNWGDYIDPELLTQFTEETGIQVQYETFDSNEAMYTKIKQGGTTYDIAIPSEYMINKMKDEDLLVPLDYSKIEGIENIGPEFLNQSFDPGNKFSIPYFWGTLGIVYNETMVDEAPEHWDDLWKPEYKNSIMLFDGAREVLGLGLNSLGYSSTSKDLQQLEETVDKLYTLTPNIKAIVADEMKGYMI

SEQ ID NO: 3529 - protein, 124 aa, Streptococcus pneumoniae
VTFSGEASQMLEKNENLRYVVPTEASNLWCDNMVIPKTVKNQNSAYAFINFMLKPENALQNAEYVGYSTPNLPAKELLPEETKEDKAFYPDVETMKHLEVYEKFDHKWTGKYSDLFLQFKMYRK

SEQ ID NO: 3530 - protein, 79 aa, Streptococcus pneumoniae
MKMSTFFKKSFWPTFMIVNQTVILFHLKDGLDRQYLTTESIYWVIGTFIFGNILVAVFSNMKIWDKKKNGSKKKYILKK

SEQ ID NO: 3531 - protein, 72 aa, Streptococcus pneumoniae
LPSLDGSQHRHFSGLRQVKINSQLSYYNVFLSLRQLEMISVELDQFPTSLITFSGYIFSYCRFSFYPKFSYY

SEQ ID NO: 3532 - protein, 162 aa, Streptococcus pneumoniae
LMKIFLVKQKFRLGGERFAIKDDRGEIAYQVEGSFFKIPKTFTIYDAAGEQVSQISKEILTLLPRFEIQLRDGSSFVIRKKLTFWRDKYEFDNLGLRIEGNIWDLNFKLLDDRDQLIAEIKKELFHLTSTYTVTVLEDAYADLVISLCVAIDYVEMLESQSH

SEQ ID NO: 3533 - protein, 88 aa, Streptococcus pneumoniae
MKQLSSAQVRQMWLDFWATKGHSVKPSVSLVPVNDPTLLWINSGVATLKKYFDGTIIPENPRITNAQKAIRTNDIENVGQDCASPYHV

SEQ ID NO: 3534 - protein, 786 aa, Streptococcus pneumoniae
MFEMLGNFSIGDYFRDEAITWAYELLTSPEWFDFPAEKLYMTYYPDDKDSYNRWIEVGVDPSHLIPIEDNFWEIGAGPSGPDTEIFFDRGEAFDPENIGLRLLAEDIENDRYIEIWNIVLSQFNADPAVPRSEYKELPHKNIDTGAGLERLVAVIQGAKTNFETDLFMPIIREVEKLSGKVYDQDGDNMSFKVIADHIRSLSFAIGDGALPGNEGRGYVLRRLLRRASMHGQKLGINEPFLYKLVPTVGKIMESYYPEVLEKRDFIEKIVKSEEESFARTLHSGQHFAQGIVADLKEKGQSVIAGQDVFKLYDTYGFPVELTEEIAEEAGMTVDREGFEAAMKEQQERARASAVKGGSMGMQNETLQNITVESVFNYNASQLSSKLVAIVADNAEVGAVSEGTASLIFAETSFYAEMGGQVADYGQILDESGKVVATVTNVQKAPNGQALHTVEVLAPLALNQEYTLAIDSNRRHRVMKNHTATHLLHAALHNILGNHATQAGSLNEVEFLRFDFTHFQAVTAEELRAIEQQVNEKIWEALEVKTVETDIDTAKEMGAMALFGEKYGKEVRVVTIGDYSIELCGGTHVGNTSEIGLFKIVKEEGIGSGTRRILAVTGKEAFEAYREQEDALKAVAATLKAPQVKEVPHKVEGLQEQLRQLQKENAELKEKAAAAAAGDIFKDVKEVNGHRYIASQVSVSDAGALRTFADNWKQKDYSDLLVLVAAIGDKVNVLVASKTKDLHAGNLVKELAPIIDGRGGGKPDMAMAGGSNQAKIQELLDAVAGKL

SEQ ID NO: 3535 - protein, 484 aa, Streptococcus pneumoniae
MQNQTLMQYFEWYLPHDGQHWTRLAENAPHLAHLGISHVWMPPAFKATNEKDVGYGVYDLFDLGEFNQKGTVRTKYGFKEDYLQAIQALKAQGIQPMADVVLNHKAAADHREAFQVIEVDPVDRTVELGEPFTINGWTSFTFDGRQDTYNDFHWHWYHFTGTDYDAKRRKSGIYLIQGDNKGWANEELVDNENGNYDYLMYADLDFKHPEVIQNIYDWADWFMETTGVAGFRLDAVKHIDSFFMRNFIRDMKEKYGDDFYVFGEFWNPDKEANLDYLEKTEEHFDLVDVRLHQNLFEASQAGANYDLRGIFTDSLVELKPDKAVTFVDNHDTQRGQALESTVEEWFKPAAYALILLRQDGLPCVFYGDYYGISGQYAQEDFKEILDRLLAIRKDLAYGEQNDYFDHANCIGWVRSGAENQSPIAVLISNDQENSKSMFVGQEWTNQTFVDLLGNHQGQVTIDEEGYGQFPVSARSVSVWAVNTI

SEQ ID NO: 3536 - protein, 63 aa, Streptococcus pneumoniae
MTNQAHNLSIFNLQIEITQGLFITIQLTNILKFNHGTTPIFICIIYRYTSTLIQKNQYFILSS

SEQ ID NO: 3537 - protein, 249 aa, Streptococcus pneumoniae
MIEFQNVSKLYGDKEALSNLNLQIENGEIMGLIGHNGAGKSTTIKSLVSIISPSSGRILVDGQELSENRLAIKRKIGYVADSPDLFLRLTANEFWELIASSYDLSRSDLEASLARLLNVFDFAENRYQVIETLSHGMRQKVFVIGALLSDPDIWVLDEPLTGLDPQAAFDLKQMMNEHALKGKTVLFSTHVLEVAEQVCDRIAILTKGDFIYCGTVKDLRKDYPDQSLESIYLSLAGRKEEVADASQGH

SEQ ID NO: 3538 - protein, 544 aa, Streptococcus pneumoniae
MRLKVINKLVDINILYSSQEANLANLRKKQAKNPGKKVNVSARVLSSYIFSSLLMLICFSNIAFRFPFEEMPSFFSTMVAILLVLAFSTSFTAFYNVFYESKDLASYRPYAFKESEIIMAKGLSVLLPALTGIVPILAYFLVLYIRLAPSLWLGLPLMLLSLTLLFVSVTLVTVVAVHFLAQTRVFRKYQSIFSNVMIGIGVLIPLIFIFFLQSTFGSIVDKVRDIPFLLYPLHIFYKIAVEPFSTEALVGLLAWIGLTLFLLYLTKKKVLPRFYDVILLNSEEKVKKERRSKERISTTKKGFFRMVLRYHLTLLGQGTGVITVLFTSAFLPYLMMISLISKIRDSQIVPDIHPPYWLPLFFVGVFIAVVNNNITSLHSIALSLERENVDFLKSLPFDFARYVKVKFWIIFAVQSFLPVLTLLGLSLYLGLPIISMIYLLVVWIIASVILSCHHYFKDVKNLSTNWSSITDLVNRSNGIVAIVLLFIYSAILMALVIGSIFLVQSLSTILAISLGVGALILLLALAIFGYHYYLSRILAEIEKR

SEQ ID NO: 3539 - protein, 387 aa, Streptococcus pneumoniae
MNRIRVSKRVEKKLAKGLVLLEASDLENVNLKDQEVEVQGQEGNFLGTAYLSQQNKGLGWFVSKDKVAFNQAFFETLFRKAKEKRNAYYQDDLTTAFRLFNQEGDGFGGLTVDLYGDYAVFSWYNSYVYQIRQTISEAFRQVFPEVLGAYEKIRFKGLDYESAHVYGQEAPDFFTVLENGVLYQVFMNDGLMTGIFLDQHEVRGSLVDGLAMGKSLLNMFSYTAAFSVAAAMGGASQTTSVDLAKRSRELSQAHFQANGLSTDEHHFIVMDVFEYFKYAKRKDLTYDVIVLDPPSFARNKKQTFSVAKDYHKLISQSLEILNPGGIIIASTNAANVSRQKFTEQIDKGFAGRSYQILNKYGLPADFAYNKKDESSNYLKVISMKVSK

SEQ ID NO: 3540 - protein, 225 aa, Streptococcus pneumoniae
MKLIVSVMPRSLEEAQALDATRYLDADIIEWRADYLPKEAILQVAPAIFEKFAGRELVFTLRTRSEGGEIDLSPEEYIHLIKEVAQFYQPDYIDFEYYSYKDVFEEMLDFPNLVLSYHNFQETPENMMEILSELTILNPKLVKVAVMAHTEQDVLDLMNYTRGFKTLNPEQEYVTISMGKVGKVSRITADVTGSSWSFASLDEVSAPGQISLASMKKIREILDEA

SEQ ID NO: 3541 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 3542 - protein, 355 aa, Streptococcus pneumoniae
MKIRIDIPHHPYDIQIEKGCMAQAGQWLRELWQPQKVVIVTDNHVASLYAEKVKLSLEDAGFQVAVFDFLEGEERKNLTTVQKVYEFLVKQGLTRSDGIVALGGGVVGDLAGFVASTYMRGIHFVQIPTSLTAQVDSSIGGKTGVNTPFAKNMVGTFAQPDGVLIDPLVLETLGKRELIEGMGEVIKYGLIEDPELWALLTGLNGSVESILEHAETLIEHSCQVKRKMVVEDELDNGIRLYLNFGHTIGHAIEATAGYGKVMHGEAVAMGMVQISKVAEEKGLMPAGITQSITEMCQKFGLPVDYENWEVDKLYQALTHDKKTRGNTLKLVLVSELGSAIIHPVSLEEMKDYLVK

SEQ ID NO: 3543 - protein, 388 aa, Streptococcus pneumoniae
MRYLTAGESHGPRLTAIIEGIPAGLPLTAEDINEDLRRRQGGYGRGGRMKIESDQVVFTSGVRHGKTTGAPITMDVINKDHQKWLDIMSAEDIEDRLKSKRKITHPRPGHADLVGGIKYRFDDLRNSLERSSARETTMRVAVGAVAKRLLAELDMEIANHVVVFGGKEIDVPENLTVAEIKQRAAQSEVSIVNQEREQEIKDYIDQIKRDGDTIGGVVETVVGGVPVGLGSYVQWDRKLDARLAQAVVSINAFKGVEFGLGFEAGYRKGSQVMDEILWSKEDGYTRRTNNLGGFEGGMTNGQPIVVRGVMKPIPTLYKPLMSVDIETHEPYKATVERSDPTALPAAGMVMEAVVATVLAQEILEKFSSDNLEELKEAVAKHRDYTKNY

SEQ ID NO: 3544 - protein, 367 aa, Streptococcus pneumoniae
MAKTIYIAGLGLIGASMALGIKRDHPDYEILGYNRSQASRDIALKEGMIDRATDDFASFAPLADVIILSLPIKQTIAFIKELANLDLREGVIISDAGSTKSTIVDAAEQYLAGKSVRFVGAHPMAGSHKTGAASADVNLFENAYYIFTPSSLTSQDTLKEMKDLLSGLHARFIEIDAKEHDRVTSQISHFPHILASSLMEQTAVYAQEHEMARRFAAGGFRDMTRIAESEPGMWTSILLSNSETILDRIEDFKERLEAIGQAISKGDEEQIWNFFNQAREQRQTMEIHKRGGVDSSYDLYVDVPDEEDVILRILELLRGTSLVNIHINEENREDIHGILQISFKNAQDLERAEHLITENTDYTVVIK

SEQ ID NO: 3545 - protein, 112 aa, Streptococcus pneumoniae
MSNIYDSANELSRGLRGLPEYKAVKAAKDAIAADAEASKIFTEYLAFQEEIQKLAQTGQMPDASFQAKMEGFGKQIQGNSLLSEFFTKQQQLAIYLSDIEKIVFEPVSELLK

SEQ ID NO: 3546 - protein, 427 aa, Streptococcus pneumoniae
MKLKTNIRHLHGSIRVPGDKSISHRSIIFGSLAEGETKVYDILRGEDVLSTMQVFRDLGVEIEDKDGVITIQGVGMAGLKAPQNALNMGNSGTSIRLISGVLAGADFEVEMFGDDSLSKRPMDRVTLPLKKMGVSISGQTERDLPPLRLKGTKNLRPIHYELPIASAQVKSALMFAALQAKGESVIIEKECTRNHTEDMLKQFGGHLSVDGKKIIVQGPQKLTGQKVVVPGDISSAAFWLVAGLIVPNSRLVLQNVGINETRTGIIDVIRAMGGKLEITEIDPVAKSATLIVESSDLKGTEICGALIPRLIDELPIIALLATQAQGVTVIKDAEELKVKETDRIQVVADALNSMGADITPTADGMIIKGKSALHGARVNTFGDHRIGMMTAIAALLVADGEVELDRAEAINTSYPSFFDDLESLIHG

SEQ ID NO: 3547 - protein, 158 aa, Streptococcus pneumoniae
MAKVLLGFMGAGKSTIARGLDTNYLDMDALIEKRLGMSIANFFAEKGEETFRQVESEVLADLLQTDQVVSTGGGVVISQRNRDLLKTNTDNIYLKADFETLYQRIAADKDNQRPLFLNNSKEELVAIFQERQAWYEEVASRVLDVTKLSPEEIIEELR

SEQ ID NO: 3548 - protein, 282 aa, Streptococcus pneumoniae
MKIAYLGPKGSFSHHVVQTAFPHEELQAFANITDVIKAYEQGLVDYSVVPVENSIEGSVHETLDYLFHQAHIQAVAEIVQPIHQQLMVVPGHTKIEKIFSHPQGLAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESRPLKTALGEYFFIIDVDYIDKDLVHFAQKELEAIGIQYKILGAYPIYPISDHGKERR

SEQ ID NO: 3549 - protein, 230 aa, Streptococcus pneumoniae
MSKENPLSHHEQLRYDYLLKNIHYLNEREKNEFAYLQEKLTLARGNSSSSLEQEREEQVDLPSYANRSRSQSKSQALSFPPKKKRRKLRLKRIFMVIFSLLVCVALAMVFMFLRGYQDASAKKTADARAAQVEVFNGQDTRDGVNILIMGTDGRIGQNSVETRTDSIMVLNVGGSDKKMKLVSFMRDNLVYIDGYSQVINGRKQTDNKLNVAYELGEQEGKKGQKCFAKS

SEQ ID NO: 3550 - protein, 199 aa, Streptococcus pneumoniae
MFRQVLKDNFDLDIKFYALVDFQAFATAIDTLFPDGVTIDAQFSTLNGRPLTEATVGDDLYATETESPTQTIKVGKQQMNGSTLLNYARFRDDDEADYGRTKRQQQVLTAILEQIKDPTKLFTGSEALGKVFAMTSTNVPYTFLLTNGLSVLDGAKNGIEKLTIPELGDWVDAYDVYGGLGLLVDQNKYQTKLAQMGLR

SEQ ID NO: 3551 - protein, 281 aa, Streptococcus pneumoniae
MNNMTDLKAIQARSLEMAEYFVAFCKEHDLLCYLCGGGAIGALRNKGFIPWDDDLDFFMPRKDYEKLAELWPRYADERYFLSKSYKDFVDRNLFITIRDKETTCIKPYQQDLDLPHGLALDVLPLDYYPKDPAERKKQVRWALIYSLFCAQTIPEKHGALMKWGSRILLGLTPKSLRYRIWKKAEKEMTKYDLADCDGITELCSGPGYMRNKYPITSFEDNLFLPFEGTKMPIPIGYDVYLRTAFGDYMTPPPADKQVPHHDVVIADMDKSYTEYKGEYGG

SEQ ID NO: 3552 - protein, 133 aa, Streptococcus pneumoniae
MRTCFGTDSYPLSKCSISRISISYFSGSRFETMVDRIFSAPPPREKDHIKNKIFFLATIFSLVFCIRLIHISDDNIMMRYLLVCWWRRHIIPKSSSEIDIIADWNRHLCSFKWQEKIVFKRCDWVLVSHVART

SEQ ID NO: 3553 - protein, 385 aa, Streptococcus pneumoniae
MMLSSLIWISLIQNTRENMVAKKKILFFMWSFSLGGGAEKILSTIVSNLDPEKYDIDILEMEHFDKGYESVPKHVRILKSLQDYRQTRWLRAFLWRMRIYFPRLARRLLVKDDYDVEVSFTIMNPPLLFSKRREVKKISWIHGSIEELLKDSSKRESHRSQLDAANTIVGISKKTSNSIKEVYPDYASKLQTIYNGYDFQTILEKSQEKIDIEIAPQSICTIGRIEENKGSDRVVEVIRLLHQEGKNYHLYFIGAGDMEEELKKRVKEYGIEDYVHFLGYQKNPYQYLSQTKVLLSMSKQEGFPGVYVEALSLGLPFISTDVGGAEELSQEGRFGQIIESNQEAAQAITNYMTSASNFDVDEASQFIQQFTITKQIEQVEKLLEE

SEQ ID NO: 3554 - protein, 328 aa, Streptococcus pneumoniae
METALISVIVPVYNVAQYLEKSIASIQKQTYQNLEIILVDDGATDESGRLCDSIAEQDDRVSVLHKKNEGLSQARNDGMKQAHGDYLIFIDSDDYIHPEMIQSLYEQLVQEDADVSSCGVMNVYANDESPQSANQDDYFVCDSQTFLKEYLIGEKIPGTICNKLIKRQIATDLSFPKGLIYEDAYYHFDLIKLAKKYVVNTKPYYYYFHRGDSITTKPYAEKDLAYIDIYQKFYNEVVKNYPDLKEVAFFRLAYAHFFILDKMLLDDQYKQFEAYSQIHRFLKGHAFAISRNPIFRKGRRISALALFINISLYRFLLLKNIEKSKKLH

SEQ ID NO: 3555 - protein, 477 aa, Streptococcus pneumoniae
VIDGKRLLFSLTIVSYALTLVSGVVYLFNNNNVSLLSTLLFLLVSSLIACWNDIKYYLIHFIFYLTIFVFLVSRPTIDYFRDGALDTYHPIAYRFAFIVVMVSILGLTTGGILARYFIARKKIKVANIGNSLKEVYIKRLRFVSLGVFLLTYPFYFIRLFERLLYRLQTSYYAYYANFESKLPYFTYILSTFTVYAMCMYLATKPKKLQATAVLVSFIAANTIHLAIGTRNPFILSILFAFVYYFMREQTEKGKWIGFKEKLAIFVGSPILMLAMGVLNYVRDNVQVSHTGFWDILLDFIYKQGTSFGVLARGFLFNSSLPYRDFRNFTFGPVLDYFARGSLGAIFGGKAFEHTTNSVELAIDSNSYAHNLSYLVLNKEYLKGHGIGSSYIMELYTDYGMIGVFLLSFLLGVLFIAMLQVAYRSRTILFALSLLILNNLFFMPRSSFSESFFNLFTMQFWGIVLVIIFVAKMLTKEN

SEQ ID NO: 3556 - protein, 150 aa, Streptococcus pneumoniae
MFEHYSVADLFANLYKKRKANILALIALFALIAVPFTIKAVRNKNTVKDTTSYSTYLIYKITPPKESAKTILNHQIGGYSDFYGKLIDGNLNGAYLFNDVEPSELKKIASELDTTETTLKNSTNDYWWKKLTVYYMIDDAWGWCENFDIK

SEQ ID NO: 3557 - protein, 201 aa, Streptococcus pneumoniae
VKILTSSKDANDLLEKKIDGLIEKFKHAYANVKIEKLETINSKELNANGETALGLNVKNLILRLVVIGVVCVILVVMGNVLVYLFNPTINRVGDFSQYQIDFVTEITTIANLADVLSYKNTGQELTIVSSNKAILDKLKQSQEALKGMHFVDLQDVSSLLERDTVLLVEEYGVTRYKKFEQSLQILRNLNRSILGVATFKL

SEQ ID NO: 3558 - protein, 98 aa, Streptococcus pneumoniae
GTRKSAISIPRSIKSSKDIVIFKVVSLICFIFIDSNLILSVLSIILDFYDFIKRKFLQTDRKSLQNRLLADFEDLIHQNTYNLKVATPRIERFKFLRI

SEQ ID NO: 3559 - protein, 184 aa, Streptococcus pneumoniae
MKMKQISDTTLKITISLEDLMDRGMEIADFLVPQEKTEEFFYAILDELEMPDSFLDTGMLSFRVTAKPDKVDVFVTNSKIDQNLDFEDLSDGPDMEELAQMSADEFIKTLEKSIADKTKDDIEAIQSLEQVEAKEEEQEQAEQEAESKKEPYIYYILSFAKLADLGAFCQDSDFLKWKLLNSTK

SEQ ID NO: 3560 - protein, 127 aa, Streptococcus pneumoniae
VQTRAYGPTAKLDMGLDDFQYPLKWSNNSARSFCRVQKFPFQKVTVLAKSSQVSQLSKRKDVVDVRFFLTLSFLFSLLLLFFLGFNLLKRLNGFDIILGFVCDAFFQGFDKFICRHLSQFFHIWPIR

SEQ ID NO: 3561 - protein, 70 aa, Streptococcus pneumoniae
METSELYKMNERYYLTILVDIENHPSPYPAWLLARMREFAQDSDISRSVLQEYGQVLMSRDAVLNLQKIG

SEQ ID NO: 3562 - protein, 428 aa, Streptococcus pneumoniae
MTVKIALLGFGTVASGVPFLLKENGGKINQSAHSDIKVAKVLVKDEDEKNRLLAAGNDFNFVTNVDDILSDQDITIVVELMGRIEPAKTFITRALEAGKHVVTANKDLLAVHGAELLEIAQANKVALYYEAAVAGGIPILRTLANSLASDKITRVLGVVNGTSNFMVTKMVEEGWSYDDALAEAQRLGFAESDPTNDVDGIDAAYKMVILSQFAFGMKIAFDDVAHKGIRNITPEDVAVAQELGYVVKLVGSIEETSSGIAAEVTPTFLPKAHPLASVNGVMNAVFVESIGIGESMYYGPGAGQKPTATSVVADIVRIVRRLNDGTIGKDFNEYSRDLVLANPEDVKANYYFSILAPDSKGQVLKLAEIFNAQDISFKQILQDGKEGDKARVVIITHKINKAQLENVSAELKKVSEFDLLNTFKVLGE

SEQ ID NO: 3563 - protein, 289 aa, Streptococcus pneumoniae
MKIIVPATSANIGPGFDSVGVAVTKYLQIEVCEERDEWLIEHQIGKWIPHDERNLLLKIALQIVPDLQPRRLKMTSDVPLARGLGSSSSVIVAGIELANQLGQLNLSDHEKLQLATKIEGHPDNVAPAIYGNLVIASSVEGQVSAIVADFPECDFLAYIPNYELRTRDSRSVLPKKLSYKEAVAASSIANVAVAALLAGDMVTAGQAIEGDLFHERYRQDLVREFAMIKQVTKENGAYATYLSGAGPTVMVLASHDKMPTIKAELEKQPFKGKLHDLRVDTQGVRVEAK

SEQ ID NO: 3564 - protein, 141 aa, Streptococcus pneumoniae
MKPSGQEFPHPIFYSLFCFYTDTLGINSQVMQFSFERLLFQFCLNCWHLVMRSQNHNCRPSTRKVGCIGPIFFGHLLNHRKFSYQVLTIALMEEVSLDCLPSGHHVSCQQGSNRYIGDRTCSNSFLIRQFFRQDTTAVAST

SEQ ID NO: 3565 - protein, 74 aa, Streptococcus pneumoniae
LILFENLFKPRQRHLTVYMLLTSSVLSATSKHCLELTSSVLSTTSKHCFEQPAASFLVCSLIFIEYKLLFTKRI

SEQ ID NO: 3566 - protein, 85 aa, Streptococcus pneumoniae
MAEIYLAGGCFWGLEEYFSRISGVLETSVGYANGQVETTNYQLIKETDHAETVQVIYDEKEVSLREILLYYFRVIDPLIYQSTRE

SEQ ID NO: 3567 - protein, 255 aa, Streptococcus pneumoniae
MRRKCHSERFYFIISELSILSSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 3568 - protein, 102 aa, Streptococcus pneumoniae
MKHLLSYFKPYIKESILAPLFKLLEAVFELLVPMVIAGIVDQSLPQGDQGHLWMQIGLLLIFAVIGVLVALIAQFYSAKAAVGFAIGIDKRSLSSYSFLAQA

SEQ ID NO: 3569 - protein, 487 aa, Streptococcus pneumoniae
LTNDLYRHILSLPKHSRDRLTTSSLVTRLTSDTYQIQTGINQFLRLFLRAPIIVFGAIFMAYRISAELTFWFLVMVAILTIVIVGLSRLVNPLYSSLRKKTDQLVQETRQQLQGMRVIRAFGQEKRELQIFQTLNQVYARLQEKTGFWSSLLTPLTYLIVNGTLLVIIWQGYISIQGGVLSQGALIALINYLLQILVELVKLAMLINSLNQSYISVKRIEEVFVEAPEDIHSELEQKQATRDKVLQVQELTFTYPDAAQPSLRYISFDMTQGQILGIIGGTGSGKSSLVQLLLGLYPVDKGNIDLYQNGRSPLNLEQWRSWIAYVPQKVELFKGTIRSNLTLGFNQEVSDQELWQALEIAQAKDFVSEKEGLLDALVEAGGRNFSGGQKQRLSIARAVLRQAPFLILDDATSALDTITESKLLKAIRENFPNTSLILISQRTSTLQMADQILLLEKGELLAVGKHDDLMKSSQVYCEINASQHGKED

SEQ ID NO: 3570 - protein, 61 aa, Streptococcus pneumoniae
AIVPRKARKRRKGWLAKSTAKRLSVWFTVCRFILVLLSMLGCIDFTIDLAGFHQVIVLANS

SEQ ID NO: 3571 - protein, 583 aa, Streptococcus pneumoniae
MKRQTVNQTLKRLAVDLASHPFLLFLAFLGTIAQVGLSIYLPILIGQVIDQVLVAGSSPVFWQIFLQMLLVVIGNTLVQWANPLLYNRLIFSYTRDLRERIIHKLHRLPIAFVDRQGSGEMVSRVTTDIEQLAAGLTMIFNQFFIGVLMILVSILAMLQIHLLMTLLVLLLTPLSMVISRFIAKKSYHLFQKQTETRGIQTQLIEESLSQQTIIQSFNAQTEFIQRLREAHDNYSGYSQSAIFYSSTVNPSTRFVNALIYALLAGVGAYRIMMGSALTVGRLVTFLNYVQQYTKPFNDISSVLAELQSALACVERIYGVLDSPEVAETGKEVLTTSDQVKGAISFKHVSFGYHPEKILIKDLSIDIPAGSKVAIVGPTGAGKSTLINLLMRFYPISSGDILLDGQSIYDYTRVSLRQQFGMVLQETWLTQGTIHDNIAFGNPEASREQVIAAAKAANADFFIQQLPQGYDTKLENAGESLSVGQAQLLTIARVFLAIPKILILDEATSSIDTRTEVLVQDAFAKLMKGRTSFIIAHRLSTIQDADLILVLVDGDIVEYGNHQELMDRKGKYYQMQKAAAFSSE

SEQ ID NO: 3572 - protein, 85 aa, Streptococcus pneumoniae
VWLLISSVLSATSKQCFELTSSVLSATSKQCFELTSSVLSATSKQCFELTSSVLSTTSKLCFEQPTASFLVCSLIFIEYYSEQFF

SEQ ID NO: 3573 - protein, 128 aa, Streptococcus pneumoniae
MKIKEQTRKLAVGCSKHSFEVVDKTDEVSSKHCFEVADRTDEVSSKHCFEVADRTDEVSSKHCFEVADRTDEISNHTYGKVNLKWFEESTTCLLKKEPIMKVFQLVNIVTCDQDFHVYLDGILAVKGF

SEQ ID NO: 3574 - protein, 63 aa, Streptococcus pneumoniae
NTKKIKKGGGGGALFGPVFEERVLPLAEPGYFQGPLWYMLGAAGLKNPYLFLPKKTILKTLDS

SEQ ID NO: 3575 - protein, 73 aa, Streptococcus pneumoniae
ITENQKRENQTDSLLMYIISSFKNTHSHISVMNREDRIRTCDTLVPNQVLYQAELLPELNRKMHPRGVEPLTA

SEQ ID NO: 3576 - protein, 68 aa, Streptococcus pneumoniae
MGEEEMRNKMIIAVSLVVAGVMTYLMFSGLDEDFYHFPWKVFAGFGIMSWLVREGLKLVRDVKKEFEE

SEQ ID NO: 3577 - protein, 64 aa, Streptococcus pneumoniae
MKRGIIYFFIGLSLLVWLVEMFTDWFDQALLCQFIRGALEFGFMIFVVFPMGMEWLKGESHDGG

SEQ ID NO: 3578 - protein, 98 aa, Streptococcus pneumoniae
VTSLSPSKQSKSVVFPAPFGPIKATHSPSLISKEMFRKISLSFIFLLNFSTLTTVMRLSFQPLHSHRENDENHKSKLQSTTNELAKQGLIKPISKHFH

SEQ ID NO: 3579 - protein, 294 aa, Streptococcus pneumoniae
MTVVKVEKLSKKIKDKEILRNISFEINDGECVALIGPNGAGKTTLLDCLLGDKLVTSGQVSIQGLPVTSSKLDYTRAYLPQENIIVQKLKVKELIAFFQRIYPNPLSNQEIDQLLQFVKQQKEQLAEKLSGGQKRLFSFILTLIGRPKIVFLDEPTASMDTSTRQRFWEIVQELKAQGVTILYSSHYIEEVEHTADRILLLNKGELIRDTTPLAMRSEEIEKHFILPIAYKEVVEQSNLVENWTLKQDSLQVVTREADAFWELLAQAGCRMQEIEVNNRSLLNTIFEETQKGDN

SEQ ID NO: 3580 - protein, 245 aa, Streptococcus pneumoniae
MKRWIALSKIEFLLTKRQLIYYLLSVGMPTAFYLFFSGIYQDTPGELANFMRDYLISMTAFSMMSTAIFSFPVVLHTDKINNWQKTLRHSPVNMVEYYLSKITSMLVDYLVSILVVFSVGHFVRGVDMSLGNWIGAALLLIVGSIAFVALGLTLTLLPTSQLMSVVGNLLYLGLAVLGGLWMPISLFPDWMQVVGKCLPTYQLMELLKTFLNEGGINLSATVYLLVFSVVLFGLTIYLQGHKENA

SEQ ID NO: 3581 - protein, 365 aa, Streptococcus pneumoniae
MLERLKSIHYMFWISLIFMVFPILTVVTGWLSAWHLLIDILFVVAYLGVLTTKSQRLSWLYWGILLTYVVGNTAFVAVNYIWFFFFLSNLLSYHFSVGGLKSLHVWTFLLAQVLVVGQLLIFQRIEVEFLFYLLVILAFVDLMTFGLVRIRIVEDLKEAQAKQNAQINLLLAENERNRIGQDLHDSLGHTFAMLSVKTDLALQLFQMEAYPQVEKELKEIHQISKDSMNEVRTIVENLKSRTLTSELETVKKMLEIAGIEVETDNQLDTASLTQELESMASMILLELVTNIIKHAKASKAYLKLERTEKELILTVSDDGCGFAFLKGDELHTVRDRVFPFSGEVSVISQKHPTEVQVRLPYKERN

SEQ ID NO: 3582 - protein, 199 aa, Streptococcus pneumoniae
MKVLVAEDQSMLRDAMCQLLTLQPDVESVLQAKNGQEAIQLLEKESVDIAILDVEMPVKTGLEVLEWIRSEKLETKVVVVTTFKRAGYFERAVKAGVDAYVLKERSIADLMQTLHTVLEGRKEYSPELMEMVMTRPNPLTEQEIAVLKGIARGLSNQEIADQLYLSNGTIRNYVTNILSKLDAGNRTEAANIAKESGWL

SEQ ID NO: 3583 - protein, 336 aa, Streptococcus pneumoniae
MNADDTVTIYDVAREAGVSMATVSRVVNGNKNVKENTRKKVLEVIDRLDYRPNAVARGLASKKTTTVGVVIPNITNGYFSSLAKGIDDIAEMYKYNIVLANSDEDNEKEVSVVNTLFSKQVDGIIYMGYHLTDKIRSEFSRSRTPIVLAGTVDVEHQLPSVNIDYKQATIDAVSYLAKENERIAFVSGPLVDDINGKVRLVGYKETLKKAGITYSEGLVFESKYSYDDGYALAERLISSNATAAVVTGDELAAGVLNGLADKGVSVPEDFEIITSDDSQISRFTRPNLTTIAQPLYDLGAISMRMLTKIMHKEELEEREVLLPHGLTERSSTRKRK

SEQ ID NO: 3584 - protein, 130 aa, Streptococcus pneumoniae
LILFENLCKPRHVALPYVWLLTSSVSSTTSKTCFELTSSVSSTTSKTCFELTSSVSSTTSKTCFELTSSVSSATSKQCFELTSSVLSTTSKQCFELTSSVLSATSKQCVAQPLTSRLVRSMVFIKSTSLV

SEQ ID NO: 3585 - protein, 112 aa, Streptococcus pneumoniae
MNTIERTRRLVKGCATHCFEVADRTDEVSSKHCFEVVDRTDEVSSKHCFEVADETDEVSSKHVFEVVDETDEVSSKHVFEVVDETDEVSSKHVFEVVDETDEVSNHTYGKAT

SEQ ID NO: 3586 - protein, 320 aa, Streptococcus pneumoniae
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVNTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 3587 - protein, 462 aa, Streptococcus pneumoniae
MEVKAVFFDIDGTLVNNRKSVLKSTKDAIKIVKEQGVLVGVATGRGPFFVKELMDDLDLDFAVTYNGQYIFSKDRVLFTSPISKLHLRHLISYAKKEGTEIALGTKDAMLGSKIMSFGLGSFSQRISRFVPSVLTRTVSQSFNRMVSKVVPQKEEDLLHLMNQPIYQVLMLMTPEESEKAAADFEDLKLTRSNPFASDVINQGNSKLEGIRRVGKEYGFDLNQVMAFGDSDNDLEMLAGVGMSVAMGNGSSSVKEAAKHITTSNQQDGIHKALEHFGVLSSEKVFVSRDYHFNKVKTFHHMMDERTQEEPRAWDLEGATHRAGFKIEELVEFVRAASPSEEDFGQAVWQFHQALDKAADKVAKKTPAQQDLIGQVDALIDTLYFTYGSFVLMGVDPERIFDIVHQANMGKIFPDGKAHFDPVTHKILKPDNWEEKYAPEPAIKKELQRQLKAYERHKERNKS

SEQ ID NO: 3588 - protein, 150 aa, Streptococcus pneumoniae
MAQRYQNIMVAIDGSKEADLAFVKGVHSALRNDAKLTIAHVIDTRALQSVSTFDAEVYEELQVDAESLMKEYEKRAKDAGVADVHIVIEMGNPKTLLARTIPDAEEVDLILVGATGLNAFERLLVGSSSEYILRHAKVDLLVVREQEKTL

SEQ ID NO: 3589 - protein, 96 aa, Streptococcus pneumoniae
MKNSFQKSNFLYYGIILVSVLVEVIMICQLESLVPLLYPSFIGFLVFHVLYHLILFLVAKRSGRWDYLMIWGLFLMFNLLYDSFLGLLFLGLSFGL

SEQ ID NO: 3590 - protein, 238 aa, Streptococcus pneumoniae
MKEYNKSSKVEHVAYDIRGPVLEEAMLMLANGEKILRLNTGNPAQFGFTAPDEVIHDLIMNARDTEGYSDSKGIFSSRKAIMQYRQLKIFPNVDIDDIYFGNGVSELIVMSMQGLLDNGDEVLVPMPDYPLWTAAVSLAGGNAVHYICDEAVEWYPDIDDIKSKITSNTKAIVLINPNNPTGALYPKKLLLEIIEIARQNDLIIFADEIYDRMVMDGHVHTPVASLAPDVFCVSMNGL

SEQ ID NO: 3591 - protein, 110 aa, Streptococcus pneumoniae
LDSILSPFDISLNMSLMARQDHPTHTETCYAVGFLQTIHADTEDIWCQARHRRMHMSVHYHAVIDFIRKDNQIVLTGNLNNLQQEFLRIKGSSWVIWIDKDDCLGIGSDF

SEQ ID NO: 3592 - protein, 124 aa, Streptococcus pneumoniae
LAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 3593 - protein, 44 aa, Streptococcus pneumoniae
VKRTYQPSKLRRARKHGFRNRMSTKNGRRVLAARRRKGRKVLAA

SEQ ID NO: 3594 - protein, 66 aa, Streptococcus pneumoniae
LHLLNFFTKIKISRLEFLLIFDRIRLDYAAKTLRPLRRRAANTRRPFLVDIRLRNPCLRARRSLLG

SEQ ID NO: 3595 - protein, 217 aa, Streptococcus pneumoniae
VTILGKDTVQQSAKGESVTQEATPEYKPETTPGGDKGGNTGNSDANANAGGGSQAGGSAHTGSQNSAQSQASKQLATEKESAKNAIEKAAKDKQDEIKGAPLSDKEKAELLARVEAEKQAALKEIENAKTMEDVKEAETIGVQAIAMVTVPKRPVAPKTTSAPQATAGTMQDVTYQSPAGKQLPNTGSASSAALASLGLVVATSGFALLGRKTRRRK

SEQ ID NO: 3596 - protein, 74 aa, Streptococcus pneumoniae
MIFDTHTHLNVEEFAGREAEEIALADEMGVTQMNIVGFDIPTIERALELVDEYEQLYATIGWHPTEAGIYTVGS

SEQ ID NO: 3597 - protein, 180 aa, Streptococcus pneumoniae
LLDKLKHPKVVALGEIGLDYHWMTAPKEVQEQVFRRQIQLSKDLDLPFVVHTRDALEDTYEIIKSEGVGPRGGIMHSFSGTLEWAEKFVDLGMTISFSGVVTFKKATDLQEAAKELPLDKMLVETDAPYLAPVPKRGRENKTAYTRYVVDFIADLRGMTTEELAVATTANAERIFGLDSK

SEQ ID NO: 3598 - protein, 186 aa, Streptococcus pneumoniae
MKEKISQVIVVEGRDDTVNLKRYFDVETYETRGSAINDQDIERIQRLHQRHGVIVFTDPDFNGERIRRMIMTAIPTVQHAFLKRDEAVPKSKTKGRSLGIEHASYEDLKTALAQVTEQFEHESQFDISRSDLIRLGFLAGADSRKRREYLGETLRIGYSNGKQLLKRLELFGVTLAEVEEAMKSYE

SEQ ID NO: 3599 - protein, 303 aa, Streptococcus pneumoniae
MLIGQKIKEIRIEKGISRPDFCGDEQELTVRQLSRIESGASQPSLPKLDYIARRLGVPVYSLMPDFSALPSAYLELKYQILREPIYDKEEEYDKKEACLEEIEDLFYEQLPNEEKVWFEATRATIDVIRSGQPEYGETVLDDYFKTIYDKELFLINELEVINLYFAIVLTKIKQGQNQIEEINRIHSFLVRLTNHVELIAPEYLFALSNTLFSGLACLDNLSSYDSLGAYIFSLNHIMEKTQDFQKKPIILMLEWKLSLIINNDYVSAEQFYQKSKLFADIIENSYLVTMLEKQWQEDLKKYL

SEQ ID NO: 3600 - protein, 98 aa, Streptococcus pneumoniae
MKQTVKKLALVASIAATLGGSVAVASAAVQYPEGGVWTYGSGNGGAYSNYYHPSKYHSSTVVSRKTGSSDKGYAGAGGTSRAWIRTSWGEKVAFYYNV

SEQ ID NO: 3601 - protein, 268 aa, Streptococcus pneumoniae
MMKRLFILISMVLVSLYMVITSVDHREEILFGNYPSVDVTGMMINQPVASREEVTEALSHLAVEHNSLIARRIVEPNEAGETRFTYATYGEGKLPEGLTISSKESAETSDLLGSYLIVSGSLDGVSLQTTLKELGYQGFVSNGEDPFSIVLLLTATPMVLLSLAIFLLTFMSLTLIYRIKSLRQAGIRLIAGESLFGVALRPVLEDVRQLICSVLVSSLLGLGILWYQGALFMATVQLVIIALLLYGLHLGRDFYLTKCRLSTWFTGK

SEQ ID NO: 3602 - protein, 449 aa, Streptococcus pneumoniae
VPCLWQRCNWSSLLFYFMDCTLAGISTLLSVVYLLGLQENSLVDLLKGKLPLKRMMTLMMVGQLLAVLVVGSSATRLLPHYREMQEMERASNKWSQSSDRYRLSFGWSSAFADEEGTRKDNREWQTFTEERLANTDSFYIMSNVDNFSDGAEVDLDGNRLSDYTPSGNVIYVSPRYLIEEKITVSSEFMDKMQNLSEGEFGLILPESLREQSIYYQGLFTDYLQNFSSESVEVTSQKHYLPQVRLAFTEIGQERFLYNDGYKTTRQYLKDPIIVVLTPQATGTRPVAGMLWGTTANSALKLDRYGDSITALKEQGLYHKVSYLVKSQLFFAKVLNDKRVEFYSLLIGTILTLSTAILLFDSMNLLYFEQFRRDLMIKRLAGMTIYELHGKYLLAQGGVLLLGLVLSSILTRDGLISALVVALFTLNALLILVRQDKKEEAGSMAVLKGK

SEQ ID NO: 3603 - protein, 213 aa, Streptococcus pneumoniae
MIDIQGLEKKFNDRAIFSGLNLKLEKGKVYALIGKSGSGKTTLLNILGKLEKIDGGRVLYQGKDLKTIPTREYFRDQMGYLFQNFGLLENQSIKENLDLGFVGQKISKVERLERQVGALEKVNLGYLDLEQKIYTLSGGEAQRVALAKTILKNPPLILADEPTAALDPENSEEVMNLLVDLKDENRIIIIATHNPLVWNKADEIIDMRKLAHV

SEQ ID NO: 3604 - protein, 102 aa, Streptococcus pneumoniae
MCEKIRIRRVSDYPSARGGLEDILIMENMTNHLLLVQIRVHGYLLDFASIEGQRQKHYRLKNLPQTVELTVDDVEEDVDLTLPENRSYQEADFFERMFRENC

SEQ ID NO: 3605 - protein, 168 aa, Streptococcus pneumoniae
VHENRRRDVVRQISHYLDWQVRIFKILDMLRQINLENIFVNYSHIIKITQGICQNWHQTVVNLKSHDLGCTLSQKFCQGTNTWPDFDDIDLIINFSRIHNFLKDIGIRQEILPKGLFKGKTVTLQHCLGHAIICNSHLFSFLLSVTTIVTHSPCILGMKIIPKNYLSS

SEQ ID NO: 3606 - protein, 290 aa, Streptococcus pneumoniae
MRIADYSVTKAVLERHGFTFKKSFGQNFLTDTNILQKIVDTAEIDDQVNVIEIGPGIGALTEFLAERAAQVMAFEIDHRLVPILADTLRDFDNVTVVNEDILKVDLAQHIQNFKNPNLPIKVVANLPYYITTPILMHLIESGIPFSEFVVMMQKEVADRISAQPNTKAYGSLSIAVQYYMTAKVAFIVPRTVFVPAPNVDSAILKMVRRPEPAVAVEDENFFFKVSKASFTHRRKTLWNNLTGYFGKTEEVKDKLTKALDQADLSPSVRGEALSLAEFAGLADALKGQGL

SEQ ID NO: 3607 - protein, 292 aa, Streptococcus pneumoniae
MQGQIIKALAGFYYVESDGQVYQTRARGNFRKKGHTPYVGDWVDFSAEENSEGYILKIHERKNSLVRPPIVNIDQAVVIMSVKEPDFNSNLLDRFLVLLEHKGIHPIVYISKMDLLEDRGELDFYQQTYGDIGYDFVTSKEELLSLLTGKVTVFMGQTGVGKSTLLNKIAPDLNLETGEISDSLGRGRHTTRAVSFYNLNGGKIADTPGFSSLDYEVSRAEDLNQAFPEIATVSRDCKFRTCTHTHEPSCAVKPAVEEGVIATFRFDNYLQFLSEIENRRETYKKVSKKIPK

SEQ ID NO: 3608 - protein, 300 aa, Streptococcus pneumoniae
MKYQGLKTSIRLSQRLLLLAEIVSSVLVPIPMSRLVPSNQLLKRVLLQPSVLTITCNSLVKLKIVEKPIKKSAKKFQNKEKPMSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTPVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 3609 - protein, 220 aa, Streptococcus pneumoniae
MSEYKLSENNWTRVAVFAGGNRGHYRTDFDAFVGVDRGSLWVLEEDLPLALAVGDFDSVTEEERQVIQKRAQYFVQARPEKDDTDLELALLTIFEKNPQAQVTIFGALGGRIDHMLANVFLPSNPKLAPYMHQIEIEDGQNLITYCPEGTSQLEPRSDYDYLAFMPVRDSQLTILGAKYELTEENFFFKKVYASNEYIDREVSVTCPDGYVVVLHSKDRR

SEQ ID NO: 3610 - protein, 404 aa, Streptococcus pneumoniae
MESLLILLLIANLAGLFLIWQRQDRQEKHLSKSLEDQADHLSDQLDYRFDQARQASQLDQKDLEVAVSDRLQEVRIELHQGLTQVRQEMTDNLLQTRDKTDQRLQALQESNEQRLEQMRQTVEEKLEKTLQTRLQASFETVSKQLESVNRGLGEMQTVARDVGALNKVLSGTKTRGILGELQLGQIIEDIMTPAQYEREYATVENSSERVEYAIKLPGQGDQEYVYLPIDSKFPLADYYRLEEAYETGDKDEIERCRKSLLASVKRFAKDIKSKYIAPPRTTNFGILFVPTEGLYSEIVRNPVFFDDLRREEQIIVAGPSTLSALLNSLSVGFKTLNIQKSADHISKTLASVKTEFGKFGGILVQAQKHLQHASGNIDELLNRRTIAIERTLRHIELSEGEACA

SEQ ID NO: 3611 - protein, 313 aa, Streptococcus pneumoniae
MKISHMKKDELFEGFNLIKSGDLRQTRVGKNYLAFTFQDDSGEIDGKLWDAQPHNIEAFTAGKVVHMKGRREVYNNTPQVNQITLRLPQAGEPNDPADFKVKSPVDVKEIRDYMSQMIFKIENPVWQRIVRNLYTKYDKEFYSYPAAKTNHHAFETGLAYHTATMVRLADAISEVYPQLNKSLLYAGIMLHDLAKVIELTGPDQTEYTVRGNLLGHIALIDSEITKTVMELGIDDTKEEVVLLRHVILSHHGLLEYGSPVRPRIMEAEIIHMIDNLDASMMMMSTALALVDKGEMSNKIFAMDNRSFYKPDLD

SEQ ID NO: 3612 - protein, 275 aa, Streptococcus pneumoniae
MKLRRSDRMVVISNYLINNPYKLTSLNTFAEKYESAKSSISEDIVIIKRAFEEIEIGHIQTVTGAGGGVIFTPSISSQDAKEMVEDLRTKLSESDRILPGGYIYLSDLLSTPAILKNIGRIIAKSFMDQKIDAVMTVATKGVPLANAVANVLNVSFVIVRRDLKITEGSTVSVNYVSGSSGDRIEKMFLSKRSLKAGSRVLIVDDFLKGGGTVNGMISLLREFDSELAGVAVFADNAQEEREKQFDYKSLLKVTNIDVKNQAIDVEVGNIFDEDK

SEQ ID NO: 3613 - protein, 69 aa, Streptococcus pneumoniae
EIELKVGTIVPAFLCKQNRRKLMKTPFINREELEAIVAEFPTPFHLYDEKGIREKARAVNQAFSWKQGL

SEQ ID NO: 3614 - protein, 127 aa, Streptococcus pneumoniae
LLPSSRLPFTCMMRRGFVRRQEPSTKLFRGNKGFKEYFAVKATPTPAILKILQEEGCGVDCSSYVELLMSHKLDFLGSEIMFSSNNTPDKEYAYARELGATINLDAFEDIEHSGESSRYSRNHLLSL

SEQ ID NO: 3615 - protein, 99 aa, Streptococcus pneumoniae
MISGIPAALSRMFNIFKGIQVNGRTQFTCIGVFLVWRVVGREHNLRTQKVQFMAHQKLYITRAVHTTTFFLENFQNSWSWSSLNCKIFLKALVSTKKLG

SEQ ID NO: 3616 - protein, 334 aa, Streptococcus pneumoniae
AINWTFWVLRLCSLPTTRQTRNTPMHVNWVRPLTWMPLKILNILERAAGIPEIISCRYNPGGVFELGTDIMDNPGEAKFGMTKDQLFEAFAILKEKGAKTFGIHSFLASNTVTHLYYPELARQLFELAVEIKEKLGIWLDFINLSGGIGVNYRPDQEPNDIALIGEGVRKVYEEVLTSAGLGQVKIFTELGRFMLAPHGALVTRVTHKKETYRTYLGVDASAVNLMRPAMYGAYHHISNVTHPDGPAEAVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 3617 - protein, 264 aa, Streptococcus pneumoniae
MSEETIDYGQVTGMVHSTESFGSVDGPGIRFIVFLQGCHMRCQYCHNPDTWAMESNKSRERTVDDVLTEALRYRGFWGNKGGITVSGGEALLQIDFLIALFTKAKEQGIHCTLDTCALPFRNKPRYLEKFDKLMAVTDLVLLDIKEINEEQHKIVTSQTNKNILACAQYLSDIGKPVWIRHVLVPGLTDRDDDLIELGKFVKTLKNVDKFEILPYHTMGEFKWRELGIPYSLEGVKPPTADRVKNAKKLMDTESYQDYMKRVHG

SEQ ID NO: 3618 - protein, 308 aa, Streptococcus pneumoniae
VKSIKRFALSAMGVAMLLVLTGCVNVDKTTGQPTGFIWNTIGAPMAEAIKYFATDKGLGFGVAIIIVTIIVRLIILPLGIYQSWKATLHSEKMNALKHVLEPHQTRLKEATTQEEKLEAQQALFAAQKEHGISMFGGVGCFPILLQMPFFSAIYFAAQHTEGVAQASYLGIPLGSPSMILVACAGVLYYLQSLLSLHGVEDEMQREQIKKMIYMSPLMIVVFSLFSPASVTLYWVVGGFMMILQQFIVNYIVRPKLRKKVREELAKNPPKASAFSKPSGRKDVTPEQPTAITSKKKHKNRNAGKQRSR

SEQ ID NO: 3619 - protein, 92 aa, Streptococcus pneumoniae
MQKVRMIAQGRVQGVGFRWGVYSLALEIGGITGRVWNNDDGTVEILAQADSSAIMAKFIQEIRKGPTPFSKVSYLDVKLSNFPPYPDFKIAN

SEQ ID NO: 3620 - protein, 252 aa, Streptococcus pneumoniae
LCYNISMTIITSKANSVVKNTKKLHQKKYRKSAYLIEGWHLFEEAVQAGVTIEKIFTLENYRDQLATFSQTVWVSEDILLDLADSQTPQGIVAVVQKEEVGQADLSQGKFLFLEDVQDPGNVGTIIRTADAAGFTGVIVSDKSADIYSLKTLRSMQGSHFHLPIYRMTSQALLDETKKVAIPVLATTLSKDSVDYRELPSIENFVLVMGNEGQGISPLMAESADQLVHISMKGQAESLNVAVAAGILIFHLS

SEQ ID NO: 3621 - protein, 227 aa, Streptococcus pneumoniae
MNHTIIHDRAGLNQFYAKVYAFVGLGIGLSALVSGLMLTVFQSQLVYFLMQGRLWLTIATFAELALVFVASSMASRNSPAALPVFLLYSVLNGFTLSFVVAFYTPGTVLSAFVSSALLFFVMAAVGIFTKKDLSGIGRAMMAALIGLLIAMVVNIFLASGFFDYMISVAMVLVFSGLIAWDNQKIRLAYEQSQGRVATGWVVSMALSIYLDFINLFLSILRIFGRND

SEQ ID NO: 3622 - protein, 71 aa, Streptococcus pneumoniae
LIFQILGKSVFDKGNFFLLMDKTFLHRQLLKNLINVLYTYFQEKKRENLKKISVTQNTDFIDLLVIATKDT

SEQ ID NO: 3623 - protein, 330 aa, Streptococcus pneumoniae
MKKSFIHQQEEISFVKNTFTQYLKDKLEVVEVQGPILSKVGDGMQDNLSGVENPVSVKVLQIPDATYEVVHSLAKWKRHTLARFGFGEGEGLFVHMKALRPDEDSLDATHSVYVDQWDWEKVIPNGKRNIVYLKETVEKIYKAIRLTELAVEARYDIESILPKQITFIHTEELVERYPDLTPKERENAICKEFGAVFLIGIGGELPDGKPHDGRAPDYDDWTSESENGYKGLNGDILVWNESLGGAFELSSMGIRVDEETLRRQVEITGDEDRLELEWHKSLLNGLFPLTIGGGIGQSRMAMFLLRKRHIGEVQTSVWPQEVRDTYENIL

SEQ ID NO: 3624 - protein, 179 aa, Streptococcus pneumoniae
MKIVSGIYGGRPLKTLEGKTTRPTSDKVRGAIFNMIGPYFEGGRVLDLYAGSGGLSIEAVSRGMSSAVLVERDRKAQTIVAENIQITKEIGKFQLLKMDAERALEQVSGEFDLVFLDPPYTKEQIVADIEKMAERELFSEDVMVVCETDKAVELPEEIACLGIWKEKIYGISKVTVYVR

SEQ ID NO: 3625 - protein, 122 aa, Streptococcus pneumoniae
YVGIFFNPHKQGFLPIENRKRGLEKALGHLENVEVVASHDELVVDVAKRLGATCLVRGLRNASDLQYEASFDYYNHQLSSDIETIYLHSRPEHLYISSSGVRELLKFGQDIACYVPESIWRK

SEQ ID NO: 3626 - protein, 238 aa, Streptococcus pneumoniae
MKKKIRWPLYVIAALIVTFLAFVVPLPYYIEVPGGSEDIRQVLKINDTEDKEAGAYQFVTVGVQHATLAHMIYAWLTPFTDIRSAQETTGGSSDVEFMRINQFYMQTSQNMAKYQGLKTAGKDIELKYFGVYVLNVTDNSTFKGILNISDTVTAVNDQTFDSSKDLIDYVSSQKLGDSVKVTYEEDGQTKSAEGKIITLENGKNGIGIGLIDRTEVISNVPISFSTSWYWRSKCWSHV

SEQ ID NO: 3627 - protein, 77 aa, Streptococcus pneumoniae
VGDIGGIDKKVVASARAGAAIFFAPDNPVSEEEQKAHPDAKNNYQTALEAAKTIKTDMKIVPVKTLQDAIDYLKNNP

SEQ ID NO: 3628 - protein, 94 aa, Streptococcus pneumoniae
LSEVSKLAHKHRRWYNSQMVQLLFTLSSHMLFIYVSFYLLKDLVRWEKVLKVTDENTRKVRLLVAFFSIVIGYILSSFFISLYHLWQEALRGLL

SEQ ID NO: 3629 - protein, 427 aa, Streptococcus pneumoniae
MDKIVVQGGDNRLVGSVTIEGAKNAVLPLLAATILASEGKTVLQNVPILSDVFIMNQVVGGLNAKVDFDEEAHLVKVDATGDITEEAPYKYVSKMRASIVVLGPILARVGHAKVSMPGGCTIGSRPIDLHLKGLEAMGVKISQTAGYIEAKAERLHGAHIYMDFPSVGATQNLMMAATLADGVTVIENAAREPEIVDLAILLNEMGAKVKGAGTETITITGVEKLHGTTHNVVQDRIEAGTFMVAAAMTGGDVLIRDAVWEHNRPLIAKLLEMCVEVIEEDEGIRVRSQLENLKAVHVKTLPHPGFPTDMQAQFTALMTVAKGESTMVETVFENRFQHLEEMRRMGLHSEIIRDTARIVGGQPLQGAEVLSTDLRASAALILTGLVAQGETVVGKLVHLDRGYYGFHEKLAQLGAKIQRIEASDEDE

SEQ ID NO: 3630 - protein, 74 aa, Streptococcus pneumoniae
VLRFSGLRQAMKMNKKSSYVINRLLLVIIVLILGTLALGIGLMVGYGILGKGQDPWAILSPAKWQELIHKFTGN

SEQ ID NO: 3631 - protein, 274 aa, Streptococcus pneumoniae
MNKKTRQTLIGLLVLLLLSTGSYYIKQMPSAPNSPKTNLSQKKQASEAPSQALAESVLTDAVKSQIKGSLEWNGSGAFIVNGNKTNLDAKVSSKPYADNKTKTVGKETVPTVANALLSKATRQYKNRKETGNGSTSWTPPGWHQVKNLKGSYTHAVDRGHLLGYALIGGLDGFDASTSNPKNIAVQTAWANQAQAEYSTGQNYYESKVRKALDQNKRVRYRVTLYYASNEDLVPSSSQIEAKYSDGELEFNVLVPNVQKGLQLDYRTGEVTVTQ

SEQ ID NO: 3632 - protein, 327 aa, Streptococcus pneumoniae
  UNSURE (298): Xaa at each above location is unknown.
SEFVATFNIVFILTGLMPFLPATKMAMVFFNRARVDQKGNYGDTRYFRLLKVLENLNRFLSTIQVGITLITILSGASLTNTLGRVIASWLGNGETAQAVATFLSLAFLTYISIVFGELYPKRIALNLKDALAIRTAPVIIGIGKLVSPFVWLLAASTNFLSHLTPMSFDDADEKMTRDEIAYMLTNSEETLDADEIEMLQGVFSLDELMAREVMVPRTDAFMVDIQDDSQAIIQSILKQNYSRIPVYDGDKDNVIGIIHTKSLLKAGFVDGFDNIVWKRILQDPLFVPETIFVDDLLXELRNTQRQMAILLDEYSGMAGLVTLGKLL

SEQ ID NO: 3633 - protein, 94 aa, Streptococcus pneumoniae
  UNSURE (52): Xaa at each above location is unknown.
LWENSYKEIVGEIDDETDKAAIDVHQIGEDTYIVQRTMTLNDFNNYFDVELXSDDVDTIAGYYLTGVGTIPTTEKLSYELVSQNKQFILTNDKV

SEQ ID NO: 3634 - protein, 1203 aa, Streptococcus pneumoniae
LAGHDVQYGKHRTRRSFSRIKEVLDLPNLIEIQTDSFKAFLDHGLKEVFEDVLPISNFTDTMELEFVGYEIKEPKYTLEEARIHDASYSAPIFVTFRLINKETSEIKTQEVFFGDFPIMTEMGTFIINGGERIIVSQLVRSPGVYFNDKVDKNGKVGYGSTVIPNRGAWLELESDSKDITYTRIDRTRKIPFTTLVRALGFSGDDEIFDIFGDSELVRNTVEKDIHKNPMDSRTDEALKEIYERLRPGEPKTAESSRSLLVARFFDPRRYDLAAVGRYKINKKLNVKTRLLNQTIAEPLVDPETGEILVEAGTIMTRSVIESIESHLDGDLNKIVYIPNDAAVVTEPVVLQKFKVIAPTDPDRVVTIIGNANPDDKVRTVTPADILAEMSYFLNLAEGLGRVDDIDHLGNRRIRAVGELLANQVRLGLSRMERNVRERMSVQDNEVLTPQQIINIRPVTAAVKEFFGSSQLSQFMDQHNPLSELSHKRRLSALGPGGLTRDRAGYEVRDVHYTHYGRMCPIETPEGPNIGLINNLSSYGHLNKYGFVQTPYRKVDRETGVVTNEIVWLTADEEDEYTVAQANSRLNEDGTFAEKIVMGRHQGVNQEYPANIVDYMDVSPKQVVAVATACIPFLENDDSNRALMGANMQRQAVPLINPQAPYVGTGMEYQAAHDSGAAVIAQYDGKVTYADADKVEVRREDGSLDVYHIQKFRRSNSGTAYNQRTLVKVGDVVEKGDFIADGPSMENGEMALGQNPIVAYMTWEGYNFEDAVIMSERLVKDDVYTSVHLEEYESETRDTKLGPEEITREIPNVGEDALKDLDEMGIIRIGAEVKEGDILVGKVTPKGEKDLSAEERLLHAIFGDKSREVRDTSLRVPHGADGVVRDVKIFTRVNGDELQSGVNMLVRVYIAQKRKIKVGDKMAGRHGNKGVVSRIVPVEDMPYLPDGTPVDIMLNPLGVPSRMNIGQVMELHLGMAARTLGIHIATPVFDGASSEDLWSTVKEAGMDSDAKTILYDGRTGEPFDNRVSVGVMYMIKLHHMVDDKLHARSVGPYSTVTQQPLGGKAQFGGQRFGEMEVWALEAYGASNVLQEILTYKSDDINGRLKAYEAITKGKPIPKPGVPESFRVLVKELQSLGLDMRVLDEDDQEVELRDLDEGMDEDVIHVDDLEKAREKAAQEAKAAFEAEEAEKATKAEATEEAAEQE

SEQ ID NO: 3635 - protein, 116 aa, Streptococcus pneumoniae
MLTPDCNSSPFTRVKILTSRTTPSAPCGTRREVSRTSRDLSPKIACKRRSSAERSFSPLGVTFPTRISPSLTSAPIRIIPISSRSLRASSPTFGISRVISSGPSFVSRVSDSYSSR

SEQ ID NO: 3636 - protein, 56 aa, Streptococcus pneumoniae
MTSSSIPSSKSRSSTSWSSSSRTRMSRPRDCNSLTRTRKDSGTPGFGIGLPFVIAS

SEQ ID NO: 3637 - protein, 1225 aa, Streptococcus pneumoniae
VVDVNRFKSMQITLASPSKVRSWSYGEVKKPETINYRTLKPEREGLFDEVIFGPTKDWECACGKYKRIRYRGIVCDRCGVEVTRTKVRRERMGHIELKAPVSHIWYFKGIPSRMGLTLDMSPRALEEVIYFAAYVVIDPKDTPLEHKSIMTEREYRERLREYGYGSFVAKMGAEAIQDLLKQVDLEKEIAELKEELKTATGQKRVKAIRRLDVLDAFYKSGNKPEWMILNILPVIPPDLRPMLQLDGGRFASSDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDIVQNVKAAKRLVERGDERIWDILEEVIKEHPVLLNRAPTLHRLGIQAFEPVLIDGKALRLHPLVCEAYNADFDGDQMAIHVPLSEEAQAEARILMLAAEHILNPKDGKPVVTPSQDMVLGNYYLTMEEAGREGEGMVFKDRDEAVMAYRNGYVHLHSRVGIATDSLNKPWTEEQRHKVLLTTVGKILFNDIMPEGLPYLQEPNNANLTEGVPAKYFLPLGGDIKEAISNLELNPPFKKKNLGNIIAEIFKRFRTTETSALLDRMKNLGYHHSTLAGLTVGIADIPVVDDKAEIIEESHKRVEQITKQFRRGMITDDERYNAVTAEWRAAREKLEKRLIANQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRSIAEGKEMIESLEERLNGRYTKKTVKHPETGAVIIGPNELITEDKAREIVNAGVEEVTIRSVFTCNTRHGVCRHCYGINLATGDAVEVGEAVGTIAAQSIGEPGTQLTMRTFHTGGVASNTDITQGLPRVQEIFEARNPKGEAVITEVKGQVTAIEEDASTRTKKVFVKGETGEGEYVVPFTARMRVEVGGQVARGAALTEGSIQPKRLLAVRDVLSVETYLLGEVQKVYRSQGVEIGDKHIEVMVRQMIRKVRVMDPGDTDLLMGTLMDINDFTDANKDVLIAGGVPATGRPVLMGITKASLETNSFLSAASFQETTRVLTDAAIRGKKDHLLGLKENVIIGKIIPAGTGMARYRNLEPHAVNEEEYLNPPVEEEGNEETTEVVVDTAVETVEETVE

SEQ ID NO: 3638 - protein, 130 aa, Streptococcus pneumoniae
MCVPYPSPLSASFFYFTTFRGKMEKVFRRENERTRGFSHSLLFYCFFHSFNGSIHNYFCCFFISFFLYWRIKVFFFVDSMWFKVTVTGHTSTSWDDLTDDNIFFKSKEMVFLTTDSCVSKDTSCFLEGSR

SEQ ID NO: 3639 - protein, 137 aa, Streptococcus pneumoniae
MEHTFFIIKPDGVKRGLVGEVLKRIEQRGFTIEKLEFRSQVSEELIDQHYQDLVGQSFYPPIREFMTSGPVLVGVISGPKVIETWRTMMGATRPEEALPGTIRGDFAKAAGENEIIQNVVHGSDSEESAKREIALWF

SEQ ID NO: 3640 - protein, 92 aa, Streptococcus pneumoniae
MKKFDNYIIEKPCDSNSDKLQKILIIENLVDDILQFSLRINNSVGEIFLLQPFQKKTIFIPCYFEEDIVKVKDDDKVEWNLLEFQKFRAFLA

SEQ ID NO: 3641 - protein, 210 aa, Streptococcus pneumoniae
MIELKQVSKSFGERELFSNLSMTFEAGKVYALIGSSGSGKTTLMNMIGKLEPYDGTIFYRGKDLANYKSSDFFRHELGYLFQNFGLIENQSIEENLKLGLTGQKLSRSEQRLRQKQALEQVGLAYLDLDKRIFELSGGESQRVALAKVILKNPPFILADEPTASIDPATSQLIMEILLSLRDDNRLIIIATHNPAIWEMADEVFTMDRLK

SEQ ID NO: 3642 - protein, 671 aa, Streptococcus pneumoniae
MKKLFILISNLLASLFFVWVFTIWTDTYVSYYYSNVVVHDSSPETTFQHVATRLEKLAEETDSFIAIQHQDPNSEGTTVFSYTTFGDGKLPDGLQEKKLEDAQSSSVETNYFVFDGHLDIHLLREELSQLGLTNMNLTIPSKLSTLMAIFSNGFQLISLLIFILTFVALTLISQISQLRSSGIRLISGEKRWSIFLRPVGEDLKGIAVGFSLAGVLAILMQKILSLPTQSLMTIGAGLLSYNLILLSISLFFAQLFAVGIKKIHLMQIIKGQVPVRGIISLILIGQLLAIIIVTLGIGSSLKYSQAWQQHRIGQEAWSQERQLITLSISREGTSPGFDEQAQRKLRTWYQLMDLAVSEQKAFLSRHQLIDRTLQNGMASSKNLITSTEWHDYNPNGNVLIVTPQYLERQNIPVDTTIEQKMNHLDVGEFVLLLPEHLRSEEEHYKSVFEDDLTSRMSSQDERQQMTATVGYLESGQDRFVYNTTPISYQQFLKDPIIIVITPQSTGPQSILFWIDAVQNYVLFNQLSDAQELIQRQGIENWVSEMQTGYHNYITLLDNIQRERWVMLAGAVLGIATSILLFNTMNRLYFEEFRRAIFIKRIAGLRFLEIHRTYLFAQLGVFLLGFVASVFLQVEIGVAFLVLLLFTGLSLLQLHVQMQKENKMSILVLKGG

SEQ ID NO: 3643 - protein, 64 aa, Streptococcus pneumoniae
MKKKRVSRMKKNRGIQKLAILVLLGVFMFSNTIPYQQFIQKNRQLEIRVQSQKKSNGLDVGKAD

SEQ ID NO: 3644 - protein, 287 aa, Streptococcus pneumoniae
MNTLAEKFRLKRKELRLSQQTLAEGICEQSQISKIERGHFIPSADLLFKLSQRLEVPLDYFFNEQIEIKSNLSNFKQLSARLLDDRNYDDLEYIYRIEIERSTFLTLEDRTYLEWIKAIIDFYQYDSKCEAISSLENILLKVSSNTLIYLKALNTLSNFYSLVGREQEYEANYSHLIELYQTKNLDHQEFLFGYIRVRYNYAHYLVSKEKYNEAIQEALETIELCKQRQTSYQLAPLLILVGNAGAKFLDREQVKNYYIEARELCKIYNNPLMLMKIENYLKELDTV

SEQ ID NO: 3645 - protein, 136 aa, Streptococcus pneumoniae
VKLFYSMLLLINVLGAVLVLSDNLFIKNTLQQELVDFLLPSFFFLFGLDLLIFLPLKKYVRDFLAMLDRKKTVLVTILATLLFLRNPMTIVSLLIYIGLGLFFAAYLVPNSVKKEVSFYGHIFRDLVLVIVTLIFF

SEQ ID NO: 3646 - protein, 158 aa, Streptococcus pneumoniae
TQKKSFWYNKSMYTKNEEELQALGERLGHLLAKNDVLILTGELGAGKTTFTKGLAKGLQISQMIKSPTYTIVREYEGRLPLYHLDVYRIEGDADSIDLDEFIFGGGVTVIEWGNLLGDALPDAYLELEILKEADGRRLNFQAKGLRAEKLLEELQYGV

SEQ ID NO: 3647 - protein, 172 aa, Streptococcus pneumoniae
MEYELLIREAEPKDAAELVAFLNRVSLETDFTSLDGDGILLTSEEMEIFLNKQASSDNQITLLAFLNGKIAGIVNITADQRKRVRHIGDLFIVIGKRYWNNGLGSLLLEEAIEWAQASGILRRLQLTVQTRNQAAVHLYQKHGFVIEGSQERGAYIEEGKFIDVYLMGKLIG

SEQ ID NO: 3648 - protein, 338 aa, Streptococcus pneumoniae
MVKKIIGMVLALLSVTVVGVGVFAYTIYQQGTETLAKTYKKIGEETKVIEATEPLTILLMGVDTGNVERTETWVGRSDSMILMTVNPKTKKTTMMSLERDILTRIESGNGQAHEAKLNSAYADGGAELAIETIQKMMNIHIDRYVMVNMRGLQKLVDAVGGITVNNILGFPISISDQEEFNTISIGVGEQHIGGEEALVYARMRYQDPEGDYGRQKRQREVIQKVMEKALSLNSVGHYQEILKALSDNMQTNIDLSAKSIPNLLGYKDSFKTIETQQLQGEGEILQGVSYQIVSRAHMLEMQNILRRSLGQEEVTQLETNAVLFEDLFGRAPVGDEDN

SEQ ID NO: 3649 - protein, 418 aa, Streptococcus pneumoniae
  UNSURE (90),(96): Xaa at each above location is unknown.
MKAEIIAVGTEILTGQIVNTNAQFLSEKLAEIGVDVYFQTAVGDNEVRLLSLLEIASQRNHLVILTGGLGPTGDEPTKQTLAKFLGKALXFDPQAXEKLDIFFALRPDYARTPNNERQAQIVEGAIPLPNETGLAVGGKLEVDGVTYVVLPGPPSELKPMVLNQLLPKLMTGSKLYSRVLRFFGIGESQLVTILADLIDNQIDPTLAPYAKTGEVTLRLSTKASSQEEANQALDILENQILDCQTFEGISLRDFCYGYGEETSLASIVVEELKRQGKTIAAAESLTAGLFQATVANFSGASSIFKGGFVTYSLEEKSRMLDIPAKNLEEHGVVSEFTAQKMAEQARSKTQSDFGISLTGVAGPDSLEGHPVGTVFIGLAQEQGTEVIKVNIGGRSRADVRHIAVMHAFNLVRKALLSD

SEQ ID NO: 3650 - protein, 388 aa, Streptococcus pneumoniae
MAKKPKKLEEISKKFGAEREKALNDALKLIEKDFGKGSIMRLGERAEQKVQVMSSGSLALDIALGSGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLGASINKTKTIAIFINQLREKVGVMFGNPETTPGGRALKFYASVRLDVRGNTQIKGTGDQKETNVGKETKIKVVKNKVAPPFKEAVVEIMYGEGISKTGELLKIASDLDIIKKAGAWYSYKDEKIGQGSENAKKYLAEHPEIFDEIDKQVRSKFGLIDGEEVSEQDTENKKDEPKKEEAVNEEVTLDLGDELEIEIEE

SEQ ID NO: 3651 - protein, 456 aa, Streptococcus pneumoniae
MNKKRTVDLIHGPILPSLLSFTFPILLSNIFQQLYNTADVLIVGRFLGQESLAAVGATTAIFDLIVGFTLGVGNGMGIVIARYYGARNFTKIKEAVAATWILGALLSILVMLLGFLGLYPLLQYLDTPAEILPQSYQYISMIVTCVGVSFAYNLFAGLLRSIGDSLAALGFLIFSALVNVVLDLYFITQLHLGVQSAGLATIISQGLSAVLCFYYIRKSVPELLPQFKHFKWDKSLYADLLEQGLAMGLMSSIVSIGSVILQSSVNTFGAVIISAQTAARRIMTFALLPMTAISASMTTFASQNLGAKQPDRIVQGLRIGSRLSISWAVFVCIFLFFASPALVSFLASSTDGYLIENGSLYLQISSTFYPILSLLLIYRNCLQGLGQKILPLVSSFIELIGKIVFVVLIIPWAGYKGVILCEPLIWVAMTVQLYFSLFRHPLIKEGKAILATKVQS

SEQ ID NO: 3652 - protein, 318 aa, Streptococcus pneumoniae
MEINVSKLRTDLPQVGVQPYRQVHAHSTGNPHSTVQNEADYHWRKDPELGFFSHIVGNGCIMQVGPVDNGAWDVGGGWNAETYAAVELIESHSTKEEFMTDYRLYIELLRNLADEAGLPKTLDTGSLAGIKTHEYCTNNQPNNHSDHVDPYPYLAKWGISREQFKYDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADKPEFTVEPDGLITVK

SEQ ID NO: 3653 - protein, 78 aa, Streptococcus pneumoniae
VRFEDILSSFILFPTSHTFITYIYHIHTPLIKRIAHSCHNFLNKKIMTKQGSNLLMLLKNLKLMSSYQKSYLQPQNST

SEQ ID NO: 3654 - protein, 80 aa, Streptococcus pneumoniae
LPKWKKVKGISRMDLSNKASNLRKKLGADGESPIDIFKLVQKIENLTLVFYGLGKNISGVCYKGTQFSLIAVNSDMPLGR

SEQ ID NO: 3655 - protein, 119 aa, Streptococcus pneumoniae
VKKSSVSLILIGEGDETERKADQFASYFLIFPSSLYRMVEEIRENANRTHLEVEDIIKLGQFYGISHKAMLYRLRNDGYLDAEEIKNMDISVIETASRLGYDTSLYRPLSESKKEMALG

SEQ ID NO: 3656 - protein, 141 aa, Streptococcus pneumoniae
LTSRVFIDADCISVFLWVGTEHLLEKLYLGKIVIPQEVYDEINIPTIPHLKSRIDQLVTKGSAEIVSIDIGTEEYALYRDLTRNHDSNKIIGKGEATSIFLAKKHNGILGSNNLRDVKPYVEEFSLEHMTTGDILIEAFKA

SEQ ID NO: 3657 - protein, 74 aa, Streptococcus pneumoniae
FRKTSRRTFLSSTMQDLLFHFYSYRLNLTLFFFELLICLLNSEFDLSKFIFVYFDEYFHEDSLKMNLHQFSFSF

SEQ ID NO: 3658 - protein, 331 aa, Streptococcus pneumoniae
MNVKKIMSIFQSFYVDVSIEELTLTLPISFVKRFEYTQMTFHKESFLLIKEKRRGSLSSFVTQARTMGEKANMDVVLVFSKLSDSEKKQLLQARVPFVDFKGNLFFPPLGLVLNANDTEIPKELTPSEQLTWIAFLLPKGQKVVNVDLLSQVTGLPNSTIYRCLRTFKALYWLNKQNKLYTYTVSKKELFLKSVSCLFNPIKKRILLPDGDIKQIKSVSNLLYGGAYALSHSTFLAETDENTSYVIWQRKFNQLSLPLSQHVLKGKMLEIWKYRPFVSEFWNDFKNNHDKQFVDPISLYLTLKDDDDPRIEEESEALENMILQYLGEDDAS

SEQ ID NO: 3659 - protein, 81 aa, Streptococcus pneumoniae
MMPANTKVIFQEMFADFQNYYVLIGGTATSIVLDSQGFKSRTTKDYDMVIIDEVKNKEFYTTWNHFLELGEYQGSQKDEKA

SEQ ID NO: 3660 - protein, 89 aa, Streptococcus pneumoniae
MIELFSILPEYPLKKDGREIPLHFDQDASLSALLLDEDYYNILVHEKETIQGYSVLSNCGLYSSKISSNHVSFHLQPQNSVLSSLQLAS

SEQ ID NO: 3661 - protein, 86 aa, Streptococcus pneumoniae
MRERSATGAQGLSKSIKKHLNDITRLTASLLGDEKLSAITSSSAVKADMHRFVIELELVKSTILQNDDISLDQNEIFEILKNFFDG

SEQ ID NO: 3662 - protein, 100 aa, Streptococcus pneumoniae
KQLIKKVGQAGKILADSGYQGLMKIYPQAQTPRKSSKLKPLTVEDKTYNHALSKERSKVENIFAKVETFKMFSTTCRNHRKRFGLRMNLSAGIINHELGF

SEQ ID NO: 3663 - protein, 43 aa, Streptococcus pneumoniae
MNYEASKQLTDARFKRLVGVQRTTFEEMLAVLKTAYQKSRTSW

SEQ ID NO: 3664 - protein, 152 aa, Streptococcus pneumoniae
MTPEEMYLTERLDVQIAHFLKKSVQHRRRYKVLKITEIVAGFLIAVFCAIPMPGDRYRLISVALSSLGLLCEGIINLYNAKENWISYQKTAQLLEKEKFLYQCQTEKYAGKTKAFALFVKTCEGLISEEINQWESIQSKEVAASADAPVKKE

SEQ ID NO: 3665 - protein, 202 aa, Streptococcus pneumoniae
MSQSSYLSPLLWLKKEADKEKMSATQCQIFFFYYQMFELLFARESDMKDLCLGTKGFYFSQLEKNLLSGVSRFLKNLEGKVTLKANQEVSARKALFLALTTSQSDWQELAPVFDFYQTIGRLENPSLLSSQDRQHLMWIYQSALEKDYIVKVIGDKHFVLKRQDATKLTARQTQTLEILSQSEDLVNPVYVTLGEKGVLLLD

SEQ ID NO: 3666 - protein, 136 aa, Streptococcus pneumoniae
LIKRGDVVALYLPFPTISSDLAVKNHMYICIDNSMTKNKELVKNQTFKPALLTRRLVKNFMIEEPDLARNPFTRPTLIDLDKVFMLDNTVIPTSYLARRRRNVSEELYEEILDYLVQPRLISLNKSEFMQLNPGTY

SEQ ID NO: 3667 - protein, 471 aa, Streptococcus pneumoniae
MANKAVNDFILAMNYDKKKLLTHQGESIENRFIKEGNQLPDEFVVIERKKRSLSTNTSDISVTATNDSRLYPGALLVVDETLLENNPTLLAVDRAPMTYSIDLPGLASSDSFLQVEDPSNSSVRGAVNDLLAKWHQDYGQVNNVPARMQYEKITAHSMEQLKVKFGSDFEKTGNSLDIDFNSVHSGEKQIQIVNFKQIYYTVSVDAVKNPGDVFQDTVTVEDLKQRGISAERPLVYISSVAYGRQVYLKLETTSKSDEVEAAFEALIKGVKVAPQTEWKQILDNTEVKAVILGGDPSSGARVVTGKVDMVEDLIQEGSRFTADHPGLPISYTTSFLRDNVVATFQNSTDYVETKVTAYRNGDLLLDHSGAYVAQYYITWNELSYDHQGKEVLTPKAWDRNGQDLTAHFTTSIPLKGNVRNLSVKIRECTGLAWEWWRTVYEKTDLPLVRKRTISIWGTTLYPQVEDKVEND

SEQ ID NO: 3668 - protein, 238 aa, Streptococcus pneumoniae
MGRKWANIVAKKTAKDGANSKVYAKFGVEIYVAAKKGDPDPESNSALKFVIDRAKQAQVPKHIIDKAIDKAKGNTDETFTEGRYEGFGPNGSMLIVDTLTSNVNRTAANVRAAFGKNGGNMGASGSVSYLFDNKGVIVFGGEDADAVFEQLLEADVDVDDVKAQEGTITVYTAPTDLHKAIVALRESGIEEFQVTELEMIPQSEVELSGEDLETFEKLYSVLEDDEDVQKIYTNVDGF

SEQ ID NO: 3669 - protein, 149 aa, Streptococcus pneumoniae
MGKPMLVFKRFGHQIHLMVQKEAKRCGIEFMGGPQGQVVHFLDNREKNQDLVLIKDIDQELNITKSVASNLVKRIVQNCLVELEASPVDKRAKFVRLTDKARSQMQQVKAFFERIDKQLMEDIDEDELLIFEKVLGQLQAKYQGNRRRE

SEQ ID NO: 3670 - protein, 290 aa, Streptococcus pneumoniae
EERIKKLAKRISRKEWGMILLAILFTCFSVYLELEVPTYISKITDLLGSQETNLDELWQPASMMMGMSFLAFLSVVAVGFFASRVAASYTSRLRSDIFNRVLDYSQTEIKKFSIPSLLTRTTNDITQVQMLITMGLQVVTRGSIMAIWAIGKILGHSEYWLWAVLVVVIVNVLMTTVLMTLAFPKQSLIQGLTDKLNSITRESLTGIRVVRAYNAEDYQNEKFAAVNDELTRLNLFVNRLMAILNPIMMGISSGLSVAIYWIGAYVINDAAPIARLPLFSDMIVFMSYAM

SEQ ID NO: 3671 - protein, 343 aa, Streptococcus pneumoniae
MDFLLMGALFIVLPRTMVSAKRINQVLDLHSSIQNPAQVQLTDENFKGQVEFKDVTFRYAANSEAVIEHVSFKAETGQTVAFIGSIGSGKSTLVNLIPRFYDVSAGEILVDGVNVQDYDFSATAHAGQRVAIVGPTGAGKTTIVNLLMKFYEIDKGSIRIDGVDTKAMTRSEVHDAFSMVLQDTWLFEGTIRDNLIYNQIGISDERMMEASKAVGIHHFIMTLPDGYDTILDDTVTLSVGQKQLLTIACALLKDASLLILDEATSSVDTRTEELIQKAMDRLMEGRTSFVIAHRLSIIRNADLILVMKDGNIIEQGNYEELMAQGGFYADLYNSQFTEDEAEE

SEQ ID NO: 3672 - protein, 120 aa, Streptococcus pneumoniae
MSQKLYNMKFAAVYLALIAKVERKGEKAESVHQVTSWLTGYEVSDVLACLDRDVTYGDFFLQAPYYVPERITITGKICGVRIEEIDDPLMQEIRRLDKLLDWLAKGKTSQQVLEKYEKHK

SEQ ID NO: 3673 - protein, 167 aa, Streptococcus pneumoniae
MKNYQEWYRNISSRLTSRPILLFLLRSFNRLMTVAMPLVYLILLVTTYLQLGLGQQVGVYVLIPASGFVALSLFRKKINHPRPYETWDICPLLDKDSAGRSMPSRHVFSATIISMACLHASLPIGLVCLIFSALLGLVRVLGGVHYPKDVLVGYACGLVWGFLFFLF

SEQ ID NO: 3674 - protein, 149 aa, Streptococcus pneumoniae
VMKLRIEIDGNLEETEIVIKTPTLTDEIADLQRLLQESKAPRLTFYKGTGEYYLDLSEILFFETEGSKIYAHNQKEAYEVRLKLYELESILPRYFNRVSKSTIANIRQIYSVDKSFSGTGTISFYQTHKEVHVSRHYQSLLKENLRNMR

SEQ ID NO: 3675 - protein, 224 aa, Streptococcus pneumoniae
MKKKAFGIVLLVLAALILVQGNFGIPSLGGHIWPLIGIAFFAYQSVGALLRRHLTSASFTALVALMIANHFYGILPIPNQTLIWAGVLIVLGVNMLTHSNRTWNGKKWWYDGEKNILIDKEVAFGTGTFYKQDQELVEDQVEVGFGNAKIYYDNAEMLGDFATLNIEVAFGNATVYVPQHWRVDLKVETSFGTAKADAPVAPTSKTLIIRGDVAFGKLELVYVK

SEQ ID NO: 3676 - protein, 73 aa, Streptococcus pneumoniae
VPGNKNNTLRKSLQTTSASSTTSKQCFEQPAASFLVWSLIFIEYKKSFSLKEEAFYLLFCCFLICPKAFFVLK

SEQ ID NO: 3677 - protein, 99 aa, Streptococcus pneumoniae
MNGMKAKKMWMAGLALLGIGSLALATKKVADDHKLMKTQEELTAIVRDHFSDMGEIATLYVQVYESSLESLLGGVIFEDGRHYTFVYENEDLVYEEEVL

SEQ ID NO: 3678 - protein, 105 aa, Streptococcus pneumoniae
MIQPASLEELASLVEKDGKKVFLFVADWCGDCRYIYPALPEIEESNPEFTFIRVDRDQYIDLAKLWDVYGIPSLVVLEKDKEIGRFVNRDRKSKQQINDFLAGLK

SEQ ID NO: 3679 - protein, 125 aa, Streptococcus pneumoniae
MFQATVSPFSLRKTRATLSLRSTFSLASPLFFTMTIRTSPTCSLLYVKIIVSFFSYFNPAKKSLICCLLLRSRLTKRPISLSFSRTTRLGIPYTSQSLAKSIYWSLSTRIKVNSGLLSSISGKAG

SEQ ID NO: 3680 - protein, 208 aa, Streptococcus pneumoniae
MIFTYNKEHVGDVLMVIVKNSGDAKLNVERKDKVARVFLKENGETVAWNIFEVSSLFEIAERGQVFLSDEQVARLNQELQAEGFTEEIVNDKEPKFVVGEIVEMVAHPDSDHLNICQVAVASDKIVQIVAGAPNARVGLKTIVALPGAMMPKGNFIFPGELRGEKSFGMMCSPRELHLPNAPQKRGVLELSEDQVVGTPFDPAKHWTA

SEQ ID NO: 3681 - protein, 253 aa, Streptococcus pneumoniae
MAKNVVITGATSGIGEAIARAYLEQGEDVVLTGRRIDRLEILKSEFAVSFPNQTVWTFPLDVTDMVMVKTVCSDILETIGRIDILVNNAGLALDLAPYQDYEELDMLTMLDTNVKGLMAVTRCFLPAMIKVNQGHVINMGSTAGIYAYAGAAVYSATKAAVKTFSDGLRIDTIATDIKVTTIQPGIVETDFSTVRFHGDKERAASVYQGIEALQAQDIADTVVYVTSQPRRVQITDMTIMANQQATGFMIHKK

SEQ ID NO: 3682 - protein, 131 aa, Streptococcus pneumoniae
MYNKVIMIGRLTSTPELHKTNNDKSVARATIAVNRRYKDQNGEREADFVNMVLWGRLAETLASYATKGSLISVDGELRTRRFEKNGQMNYVTEVLVTGFQLLESRAQRAMRENNAGQDLADLVLEEEELPF

SEQ ID NO: 3683 - protein, 94 aa, Streptococcus pneumoniae
MLKPLGDRVLLKIEEKEQTVGGFVLAGSAQEKTKTAQVVATGQGVRTLNGDLVAPSVKTGDRVLVEAHAGLDVKDGDEKYIIVGEANILAIIEE

SEQ ID NO: 3684 - protein, 202 aa, Streptococcus pneumoniae
LATGMALFFKASTAAATAVSIPRRIPIGFAPAVTFLIPSRTIAWVKTVAVVVPSPAISLVLEATSDTNLAPIFSKWSSNSISLAMVTPSLVIKGEPNDFSRTTLRPFGPKVTLTVSARISTPRTMAERASDENLISFDILTFSFYSSMIAKMLASPTMMYFSSPSLTSRPAWASTKTRSPVLTLGATKSPFKVRTPCPVATT

SEQ ID NO: 3685 - protein, 540 aa, Streptococcus pneumoniae
MSKEIKFSSDARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALANVIPAVATLELTGDEATGRNIVLRALEEPVRQIAHNAGFEGSIVIDRLKNAELGIGFNAATGEWVNMIDQGIIDPVKVSRSALQNAASVASLILTTEAVVANKPEPVAPAPAMDPSMMGGMM

SEQ ID NO: 3686 - protein, 69 aa, Streptococcus pneumoniae
VHVCCAPCSTYTLEYLTKYADVTIYFANSNIHPKAEYHKRVYVTKKFVSDFNERTGNTVQYLEAPYEPN

SEQ ID NO: 3687 - protein, 83 aa, Streptococcus pneumoniae
VAMDLGFDYFGSALTISPHKNSQTINSIGIDVQKIYTPHYFPNDFKKNQGYKRSVEMCEEYDIYRQCYCGCVYAAQAQNIDLV

SEQ ID NO: 3688 - protein, 63 aa, Streptococcus pneumoniae
LLYCSITLSIILNDLHSIIWHYITRIKIVLNKLYKCKKGIFRYSRVVTHFYKEIYSYDSVWHA

SEQ ID NO: 3689 - protein, 257 aa, Streptococcus pneumoniae
MIDKVIEQYKSHDNLDIRVELHKKYSKNKLGFNNWIFSNYQITDEVKVLELGCGTGELWKSNSDSIDKMKQLIVTDFSKDMVKSTKSVIGNRNNVNYEIMDIQKISFENETFDIVIANMLLHHVNDIPKALSEVNRVLKTGGIFYCATFGENGVVNYLASLFKDEVNQDLENRTFTLQNGKRYLSRYFNSVDTLLYDDELQVTSIDDLVKYIQSFKGISEIGSLEEEIIRKRLESEFNNGMLIIPKEYGMFIARKES

SEQ ID NO: 3690 - protein, 112 aa, Streptococcus pneumoniae
VKNYGEAFRYFRKLNGYSLEYAAADFISKSQLSRFERGENEISLSTFFELLSNINVSIENFCNHLEYYKRSERDDFLVNLSPNFYSLNIKGLEVIKNKQQKLFEKSGKKLIK

SEQ ID NO: 3691 - protein, 115 aa, Streptococcus pneumoniae
MVGKEILERTHYYEKIGKNRNLVVSACLNFWFCCLENSHLIYADYFEMKLQKLLKDDTKVFEKSTFKFVEGYKIYLTESKESGIKQMDNVIKYFEFIESKSIALYFQKRLNELID

SEQ ID NO: 3692 - protein, 177 aa, Streptococcus pneumoniae
MKLPKEGDFITIQSYKHDGSLHRTWRDTMVLKTTENAIIGVNDHTLVTESDGRRWVTREPAIVYFHKKYWFNIIAMIRDNGTSYYCNMASPYYLDEEALKYIDYDLDVKIFTDGEKRLLDVEEYERHKRKMNYSDDLDYILKEHVKILVDWINNGRGPFSEAYVNIWYKRYVELKNR

SEQ ID NO: 3693 - protein, 60 aa, Streptococcus pneumoniae
IVIKSPSFGSFITNQLSTIYKFIIYYCTIKLPKICEFHLEILKIFSKSACYIRKIVALSC

SEQ ID NO: 3694 - protein, 286 aa, Streptococcus pneumoniae
MRLIFNGIFCFTFRFIPLSYHILSYNRAMKITKLEKKKRLYLMELDNGDKCYITEDTIVRFMLSRDKVISEEELKEIQDFAQFSYGKNLALYHLSFKARTEKEVREYLKKYDIDKNIVSQVIANLKEDKWINDGQYAYAIINTNQLSGDKGPYVLTQKLAQKGISKSTIEENLKEFDFSEVAQRVANKLLKKYEGKLPARALQDKIIQNLTNKGFSYSDAKIAFDDLDSQVDQETTQELIFKELDKQYTKYARKYEGYELKQRLTQVLARKGYDFSDIASALREYL

SEQ ID NO: 3695 - protein, 451 aa, Streptococcus pneumoniae
MNLKVKQKIPLKIKRMGINGEGIGFYQKTLVFVPGALKGEDIYCQITSIRRNFVEAKLLKVNKKSKFRIVPSCTIYNECGGCQIMHLHYDKQLEFKTDLLHQALKKFAPAGYENYEIRPTIGMQEPKYYRAKLQFQTRKFKNQVKAGLYAQNSHYLVELKDCLVQDKETQVIANRLAELLTYHQIPITDERKVLGVRTIMVRRARKTGQVQIIIVTNRQLNLTQLVKELVKDFPEVVTVAVNTNTAKTSEIYGEKTEIIWGQESIQEGVLNYEFSLSPRAFYQLNPEQTEVLYSEAVKALDVDKEDHLIDAYCGVGTIGFAFAKKVKTLRGMDIIPEAIEDAKRNAKRMGFDNTHYEAGTAEEIIPRWYKEGYRADALIVDPPRTGLDDKLLDTILTYVPEKMVYISCNVSTLARDLVRLVEVYDLHYIQSVDMFPHTARTEAVVKLIKKV

SEQ ID NO: 3696 - protein, 81 aa, Streptococcus pneumoniae
YNAGPSGSDASAPFKQMSCNIHSYAVLAIVSNSYPPLPGRLPTRYSPVRNSSREASSSFSVLLACIRHAASVRPEPGSNSH

SEQ ID NO: 3697 - protein, 49 aa, Streptococcus pneumoniae
LLGQTSVHCRRFPTAASRRSLGRVSVPVWPITLSGRLCIVALVSPYPTN

SEQ ID NO: 3698 - protein, 61 aa, Streptococcus pneumoniae
DTAQTPTGGSSRESSAMDGSLTEQRRVSEEGFRIVKLCCKRRTSVRVESSHCDGILPERDG

SEQ ID NO: 3699 - protein, 86 aa, Streptococcus pneumoniae
AKAPQDLSRLNKTNAQFLILRKEVIQPHLPIRLPCYDFTPIIYPTLGGWLLTVTSPTSGVTNSRGVTGGVYKARERIHRGVLIRDY

SEQ ID NO: 3700 - protein, 75 aa, Streptococcus pneumoniae
MTFVNRRNSLYSSKISSNFVSVALPYVWLLTSSVSSTTSKTCFELTSSVLSTTSKQCFEQPAASFLVYSLIFIEY

SEQ ID NO: 3701 - protein, 78 aa, Streptococcus pneumoniae
TRKLAAGCSKHCFEVVDRTDEVSSKHVFEVVDETDEVSNHTYGKATLTKFEEIFEEYKEFRLLTKVILFSRIVDAMSR

SEQ ID NO: 3702 - protein, 93 aa, Streptococcus pneumoniae
MGYTVAVVGATGAVGAQMIKMLEESTLSIDKIRYLACARSAGKSVGFKDQDITIEETTEAAFEGVDIALFSAGSSTSAKYAPYASKSWRGSSR

SEQ ID NO: 3703 - protein, 91 aa, Streptococcus pneumoniae
QAGVVVVDNTSYFRQNPDVPLVVPEVNAHALDAHNGIIACPNCSTIQMMVALERFRQKWGLERIIVLTYQASIQELVWEQFLRHNVNFVKS

SEQ ID NO: 3704 - protein, 221 aa, Streptococcus pneumoniae
AVSPKMGLGAYHCFNLSSQYSGAGMGAILETQRELREVLNDGVKPCDLHAEILPSGGDKKHYPIAFNALPQIDVFTDNDYTYEEMKMTKETKKIMEDDSIAVSATCVRIPVLSAHSESVYIETKEVAPIEEVKAAIAAFPGAVLEDDVAHQIYPQAINAVGSRDTFVGRIRKDLDAEKGIHMWVVSDNLLKGAAWNSVQIAETLHERGLVRPTAELKFELK

SEQ ID NO: 3705 - protein, 311 aa, Streptococcus pneumoniae
MSYQDLKECKIITAFITPFHEDGSINFDAIPALIEHLLDHHTDGILLAGTTAESPTLTHDEELELFAAVQKIVNGRVPLIAGVGTNDTRDSIEFVKEVAEFGGFAAGLAIVPYYNKPSQEGMYQHFKAIADASDLPIIIYNIPGRVVVELTPETMLRLADHPNIIGVKECTSLANMAYLIEHKPEEFLVYTGEDGDAFHAMNLGADGVISVASHTNGDEMHEMFIAIAESDMKKAAAIQRKFIPKVNALFSYPSPAPVKAVLNYMGFEAGPTRLPLVPAPEEDAKRIIKVVVDGDYEATKATVTGVLRPDY

SEQ ID NO: 3706 - protein, 457 aa, Streptococcus pneumoniae
MITREFDTIAAISTPLGEGAIGIVRLSGTDSFAIVQKIFKGKDLNKVASHTLNYGHIIDPLTGKVMDEVMVGAMKSPKTFTREDIIEINTHGGIAVTNEILQLAIREGARLAEPGEFTKRAFLNGRVDLTQAEAVMDIIRAKTDRAMNIAVKQLDGSLSDLINNIRQEILNTLAQVEVNIDYPEYDDVEEATTAVVREKTMEFEQLLTNLLRTARRGKILREGISTAIIGRPNVGKSSLLNNLLREDKAIVTDIAGTTRDVIEEYVNINGVPLKLIDTAGIRETDDIVEQIGVERSKKALKEANLVLLVLNASEPLTAQDRQLLEISQDTNRIILLNKTDLPETIETSKLPEDVIRISVLKNQNIDKIEERINNLFFENAGLVEQDATYLSNARHISLIEKAVESLQAVNQGLELGMPVDLLQVDLTRTWEILGEITGDAAPDELITQLFSQFCLGK

SEQ ID NO: 3707 - protein, 74 aa, Streptococcus pneumoniae
VVKWKKSKLVEEAIMPFVRIDLFEGRTLEQKKALAKEVTEAVVRNTGAPQSAVHVIINDMPEGTYFPQGEMRTK

SEQ ID NO: 3708 - protein, 163 aa, Streptococcus pneumoniae
VIMTSALDTRDRVGYVSSRIGMKRPALAIEETTDIFGYIRDLPEKPYCVLVDEAQFLKRHHVYDLARVVDELDIPVMAFGLKNDFRNELFEGSKYLLLLADKIDEIKTICQYCKKKATMVLRTQDGLPVYDGEQIQIGGNETYISVCRKHYFAPEINKENEEK

SEQ ID NO: 3709 - protein, 280 aa, Streptococcus pneumoniae
MNIYDQLQAVEDRYEELGELLSDPDVVSDTKRFMELSKEEASNRDTVIAYREYKQVLQNIVDAEEMIKESGGDADLEEMAKQELKDAKAEKEEYEEKLKILLLPKDPNDDKNIILEIRGAAGGDEAALFAGDLLTMYQKYAEAQGWRFEVMEASMNGVGGFKEVVAMVSGQSVYSKLKYESGAHRVQRVPVTESQGRVHTSTATVLVMPEVEEVEYDIDPKDLRVDIYHASGAGGQNVNKVATAVRIVHLPTNIKVEMQEELYPAEEPREGYEDYPCTRR

SEQ ID NO: 3710 - protein, 142 aa, Streptococcus pneumoniae
LIQKTFVSTSITPLVLVDRTSIRLRLPFVSFTCQPISRLRCRKNCTQQKNREKAMKIIRARVADHFAQIAQDEQDAERKSTIGTGDRSERIRTYNFPQNRVTDHRIGLTLQKLDTILSGKLDEVVDALVLYDQTQKLEELNK

SEQ ID NO: 3711 - protein, 279 aa, Streptococcus pneumoniae
MKLAQLFSNFEEELIRQGEEAESLSFVYRSLKNLSFTDFIFALQQEVTTEEEKQFVEDIYQQLAAHKPAQYIIGQADFYGMHLKVDERVLIPRPETEELVELILTENLETNLSVLDIGTGSGAIALALAKNRPDWSVTAADVSQEALELASENASDQNLNIFFKKSDCFAEISEKYDIIVSNPPYISREDESEVGLNVLHSEPHLALFADEDGLAIYCRIAEDAKDYLKDGGKIYLEIGYKQGQSVPELFRKHLPEKKVRTLKDQFGQDRMVVVDDGQD

SEQ ID NO: 3712 - protein, 200 aa, Streptococcus pneumoniae
MMDRIRQELEKGGAVILPTETVYGLFAKALDEKAVDHVYQLKRRPRDKALNLNVASLEDILHFSKNQPAYLQKLVETFLPGPLTIILEANDRVPYWVNSDLATIGFRMPSHPITLDLIRETGPLIGPSANISGQASGVTFEQILKDFDQEVLGLEDDAFLTGQDSTIVDLSGDKVKILRQGAIKREDILARLPEISFEEA

SEQ ID NO: 3713 - protein, 143 aa, Streptococcus pneumoniae
MLRDLQETDVKAICDINQETLGYTFSPEETASQLARLSQDSHHFLLGYEDAANHVLLGYVHAEVYESLYSKAGFNILALAVSPQAQGQGIGKSLLQGLEQEAKRCGYGFIRLNSANHRLGAHAFYEKVGYTCDKMQKRFIRIF

SEQ ID NO: 3714 - protein, 418 aa, Streptococcus pneumoniae
MISDKDDFKAYDADLWNAIATEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLAAGGHLTHGAPVSFSGQTYNFLSYSVDPETELLDFDAILKQAQEVKPKLIVAGASAYSQIIDFSKFREIADAVGAKLMVDMAHIAGLVAAGLHPSPVPYAHITTTTTHKTLRGPRGGLILTNDEDLAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYETLSPFKTSGIRIGAAAITARGFGEEESRKVAELIIKTLKNSENEAVLEEVRSAVKELTDAFPLYEE

SEQ ID NO: 3715 - protein, 335 aa, Streptococcus pneumoniae
MPSHYTRNKTFMDIYIKKAIIHQFSPDDTELFLADKFLNITPKIEEYLRKKIEHVYSDEAKTGIFEEENPFFNHITDDLLETSVTLANLWKEEFSISENLKTNDLIFVQFSKEGVEHFAFLRIALRETLTHLGGEVDNPIKLTQNNLPGFGTGADEALVVNLQSRKYHLIEKRIKYNGTFLNYFSDNLLAVAPKISPKKSIKELEKTAQRIAESFNTDDFQFQSKVKSAIFNNLEESNELSPEKLANDLFDNNLTARLSFIDQVKEAVPEPVQFDEIDASRQLKKFENQKLSLSNGIELIVPNNVYQDAESVEFIQNENGTYSILIKNIEDIQSK

SEQ ID NO: 3716 - protein, 204 aa, Streptococcus pneumoniae
MFKRIRRVLVLAVFLFAGYKAYRVHQDVKQVMTYQPMVREILSEKDTPANEELVLAMIYTETKGKEGDVMQSSESASGSTNTINDNASSIRQGIQTLTGNLYLAQKKGVDIWTAVQAYNFGPAYIDFIAQNGKENTLALAKQYSRETVAPLLGNTTGKTYSYIHPISIFHGAELYVNGGNYYYSRQVRLNLYIIKCFTLFSTSG

SEQ ID NO: 3717 - protein, 324 aa, Streptococcus pneumoniae
MRKKLFLTSAAVLWAVTAMNSVHAATDVQKVIDETYVQPEYVLGSSLSEDQKNQTLKKLGYNASTDTKELKTMTPDVYSKIMNVANDSSLQLYSSAKIQKLGDKSPLEVKIETPENITKVTQDMYRNAAVTLGMEHAKITVAAPIPVTGESALAGIYYSLEANGAKVPQANKDLAQEELKALSDINAENKDKSGYDANKLNVALADIKSGLAKAKESKGNLTEEDIRKIVEDTLKNYKLDQVITGNQINIIINFALNLSKSDILSNADFTKTLNDLKQSIVSQAGDSFKNINLNFDADKALEDGGNFLSSLWQALVNFFKSFGS

SEQ ID NO: 3718 - protein, 547 aa, Streptococcus pneumoniae
KEKRMLKKNDIVEVEIVDLTHEGAGVAKVDGLVFFVENALPSEKILMRVLKVNKKIGFGKVEKYLVQSPHRNQDLDLAYLRSGIADLGHLSYPEQLKFKTKQVKDSLYKIAGIADVEVAETLGMEHPVKYRNKAQVPVRRVNGVLETGFFRKNSHDLMPLEDFFIQDPVIDQVVVALRDLLRRFDLKPYDEKEQSGLIRNLVVRRGHYSGQIMVVLVTTRPKVFRVDQLIEQVIKQFPEIVSVMQNINDQNTNAIFGKEWRTLYGQDYITDQMLGNDFQIAGPAFYQVNTEMAEKLYQTAIDFAELKKDDVIIDAYSGIGTIGLSVAKHVKEVYGVELIPEAVENSKKNAQLNNISNAHYVCDTAENAMKNWLKDGIQPTVILVDPPRKGLTESFIKASAQTGADRIAYISCNVATMARDIKLYQELGYELKKVQPVDLFPQTHHVETVALLSKLDVDKHISVEIELDEMNLTSAESKATYAQIKEYVWNKFELKVSTLYIAQIKKKCGIELREHYNKSKKDKQIIPQCTPEKEEAIMDALRHFKMI

SEQ ID NO: 3719 - protein, 97 aa, Streptococcus pneumoniae
LYAPFMKKDKEVYDKVCEYLSPHLNKDMEVLELACWFRVITVIEANSYVNIRSSRLLPKFKTQKINSWCAAYNIHFNNGYCKQHTNEFKDSLKSLIL

SEQ ID NO: 3720 - protein, 82 aa, Streptococcus pneumoniae
LSAIISLFFSSLNLFNYSINIDFIQSYIDLVICFREFVVLFRPYFAINCFKWDLLSLPFLPPNFEYKKDDRVFNFYRLRFTY

SEQ ID NO: 3721 - protein, 64 aa, Streptococcus pneumoniae
MDTVSKKRLKKTDVIAMAGLTTNVMAQMGKDKPITFKNLERICKALSCTPNDIISFEDNFSDEE

SEQ ID NO: 3722 - protein, 79 aa, Streptococcus pneumoniae
GLCKRSIGFNEVEENINQGTGQITTFNQLGFKGYSDKPDGWYLPKNMNDVAIILETKSEERDISKQIFIDELMKNIDII

SEQ ID NO: 3723 - protein, 344 aa, Streptococcus pneumoniae
GVFMKNKFFLIAILAMCIVFSACSSNSVKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLSKIAPVAAYKSKPWQTLWRDMIKIDSKALGMEKEGDELIKNTEARISKELEKHPEIKGKIKGKKVLFTMINAADTSKFWIYTSKDPRANYLTDLGLVFPESLKEFESEDSFAKEISAEEANKINDADVIITYGDDKTLEALQKDPLLGKINAIKNGAVAVIPDNTPLAASCTPTPLSINYTIEEYLNLLGNACKNAK

SEQ ID NO: 3724 - protein, 211 aa, Streptococcus pneumoniae
PKIIKGSSVDIEDNVAAPRLPICQNLNLSKTLLFGKIKKLTKLLKAILTQVPDKASFIGVRPAFPLTAIAYTKITLTKPPMIAKLIWLMLDEIPKKERPITTLRLAPVFIPSIPGSAIGFLVTDCINTPLMARLEPAKIAKIVLGILLYIIDLIKSSFVLPIPKAAKKSLILISFVPSFNDKNIVIRRPRQITKIMPRFICFLFRIFACIS

SEQ ID NO: 3725 - protein, 335 aa, Streptococcus pneumoniae
MRNKKQINLGIIFVICLGLLITIFLSLKLGTKEINIRDFLAAFGMGNTNDDFIKSIIYKRIPRTIFAILAGSSLAISGVLMQSVTRNPIADPGILGINTGASLSVVIGLSFLGISSSISHISFAIIGGLVSVIFVYAIAVSGKAGLTPIKLALSGTCVSMALSSFVSFLILPNNNVLDKFRFWQIGSLGAATLSSISTLLPFIILGHLIAIFISSDLNALAMGDEMAVGLGVNVNRIRSLAIIASVLLCSSITAIGGPIGFVGLIVPHFCGLFISKDIRTMTISSSFIGAELLLICDIIGRMLGKPGEIEVGIITAIIGGPVLIYVTMKNRGVNN

SEQ ID NO: 3726 - protein, 335 aa, Streptococcus pneumoniae
MQNLIIGIQKRKNRITLFSSLFLLIIISLSFFILLIGDESYSFSTLIKVLNSETVPGASFSIMEIRLPKLLAGIIAGWSFGLAGFIFQTMLRNPLASPDIIGVTSSSSIAAVFCILVLKTNSLTTGIISITCGLTSSLILFLLAKKDGFSAARLIILGIGFQAVTRAGTSFLLLKVARYELQEVMRWLSGSLSFTKLDDIPLVLIVSIIATILVLFFNKRLEIIELGEEIAIGLGANPELSRLVLIFCAVSLTAFSTSITGPIACISFLAGPIALNIGKKRSPILAGLVGILLVLLSDIFSQNILPARYPVGVVTGLLGSPYLIYLLIKMNRRNI

SEQ ID NO: 3727 - protein, 73 aa, Streptococcus pneumoniae
KPIPNIISLAAEKPSFLASKNNIKDDVSPQVIEIIPVVKLFVFNTNMQKTAAIDEELVTPIISGLARGFLNIV

SEQ ID NO: 3728 - protein, 137 aa, Streptococcus pneumoniae
MSDNKTSKIPTNPANIGLLFLPIFKAMGPAKKDIQAIGPVIEVEKAVKDTAQKIKTSLESSGFAPSPIAISSPSSIISSLLLKNKTNIVAIILTIRTRGMSSNFVKDKEPLSHLITSCNSYLATFNNKNEVPALVTA

SEQ ID NO: 3729 - protein, 264 aa, Streptococcus pneumoniae
MKGLWSNSLTCGYDEKIILENINIKIPEEKISVIIGSNGCGKSTLIKTLSRLIKPLEGEVLLDNKSINSYKEKDLAKHIAILPQSPIIPESITVADLVSRGRFPYRKPFKSLGKDDLEIINRSMVKANVEDLANNLVEELSGGQRQRVWIALALAQDTSILLLDEPTTYLDISYQIELLDLLTDLNQKYKTTICMILHDINLTARYADYLFAIKEGKLVAEGKPEDILNDKLVKDIFNLEAKIIRDPISNSPLMIPIGKHHVSS

SEQ ID NO: 3730 - protein, 86 aa, Streptococcus pneumoniae
RITAILKRSGLIINKKKVQRLVQKLKLQVKSYSRKSRKYSSYKGQVGKISDNKIKRNIYYRKKGEIESSTNRLIYSKKIFTRWKNS

SEQ ID NO: 3731 - protein, 151 aa, Streptococcus pneumoniae
KEIFITEKKGKSSQVPTGSSIPKRYLLDGKTPRISATNIDNGILGYYEDIDDKNYRVFENFISVSCLGAVFYHKYKASLDMKIHCLKLKNKELNKEVAFYLTSIIRQALKNTEYKDQISSTVLPDIKIKLPIDSRGTPDWNYMERYRERER

SEQ ID NO: 3732 - protein, 91 aa, Streptococcus pneumoniae
REGEIDKKSTPIFYGEFKNVRLSKEEYKNLKEKLNSHTDIMINKLSRYMESSGKTYQNHYVTILKWYEEDKDKLRQKGLNKKMNYDVGESL

SEQ ID NO: 3733 - protein, 82 aa, Streptococcus pneumoniae
VPFHLFLSIKILLHHNSFFYLNLSVLVCLYLLHTILRLSHSGFDRSYHCFPCIWIVYLSLYLCVSLIFLLDFYILLCLTLHF

SEQ ID NO: 3734 - protein, 69 aa, Streptococcus pneumoniae
RNARRLLDDSYQEGLIFTATYAVGIGPFYISKFYFKIGYQERLLFTVKYKRVIYRILLHQDKYFLMVKF

SEQ ID NO: 3735 - protein, 559 aa, Streptococcus pneumoniae
MSKEKIKVYLYTRVSTSIQIEGYSLEAQKSRMKAFAIYNDYEIVGEYEDAGKSGKSIEGRIQFNRMMEDIKSGKDGVSFVLVFKLSRFARNAADVLSTLQIMQDYGVNLICVEDGIDSSKDAGKLMISVLSAVAEIERENIRIQTMEGRIQKAREGKWNGGFAPYGYKLEDGKLFINEEEAVAIRTIFDQYVNTTIGANGISKYLENHGIRKIPRQNGKNPLFDAGLIRKILKNPVYNGKIAFGRRTLEKVHGTRNEYKQVEQDEYLISEGIHEAIVSDEVWQAAQVKLKSQAKKYEHVNKGKDTRTHLLSGIVKCPICGVGMFGNKCIKKKKDGTKYKDFYYYGCKHRQMIRGHKCTFSKQIREELLDDAVAEVIVKIVSNPKFASMMQEKINMKVDTSEIEKEIDNYQKELRKSHSTKFKLIEEIDNLDVEDKHYKRRKQDLDDRLYRMYDKIDELESSLIDAKAKKQTIEAEKLTGDNIYKVLIYFDKLYKVMNDVERRQLISALISEIQVYEEKQSNGQWLKSITFKLPIIEENLNIGLDNDEQVECVSLLEKRS

SEQ ID NO: 3736 - protein, 203 aa, Streptococcus pneumoniae
VLIYISLIMKMERLSMVILELYQNDYSKDLVAFDSIEDGKAFVAQIPGYTLETEDGFEVEYFNPKNIPDYMEIIFNGNIVPLSKFMFDPEENVNIIWKEISNLSLKNDRVIEGYSKIDAYVVNNHEVKAYVETRETNYRKAKDFLESRGYEIDRSFFGSEDGEAILYRKKGIEVWHFLCHLDPMFVEIEDVEGYVKEEVGEIQ

SEQ ID NO: 3737 - protein, 62 aa, Streptococcus pneumoniae
MATDKNRIMISLDDKNLEKLENLVEDARDRRGMRLTKSQVIELLLNTVDYFDDIMGAIYSKK

SEQ ID NO: 3738 - protein, 252 aa, Streptococcus pneumoniae
MVVYIRQSKLPSEVSINKYNAQVGAYLQGEEAVLYQSFSEIKELTSEDIVVDYIMETRALLKMMGLNVPVHDYPIELKEFYGRKIYAGILGEIVNIPDNWGKFIKPKAGSKVFTGRVVNGTHDLIGIGLPFDYPIWISEVVEFIAEWRCFVLDGRVLDVRPYTGDYHAQFDASVIDEAISCWKDAPIAYGLDIGVTRDGRTLVVEVNDGYALGNYGLSPLKSINFHRARWKEMVKPYFEKNEIFKIQQDVIF

SEQ ID NO: 3739 - protein, 284 aa, Streptococcus pneumoniae
MLGAIIGDIVGSVYEWNNIKTKDFPLFRKDCFFTDDTVMTCAVAEAIMNGGQKDDFIDAMKKYGRMYPNADYGARFNAWLNSDNREPYNSFGNGSAMRISPCAWIMDCGFYAKTGMWPSSRGLTSLSAEVTHNHPEGVKGAMATADAIFLCRFYFGGYCREYEQSINDNPTECKRRIKDYIEKEYDYNLSQTLDEIRPNYRFNETCQETVPQAIIAFLESRDFEDAIRNAISLGGDSDTLAAITCSIAEAAYGIPDWIKDKAYSYLDEPLKDVVRRWENRIKAY

SEQ ID NO: 3740 - protein, 294 aa, Streptococcus pneumoniae
MKKAMVIINPTSGGEKALDYKEKLENKAKEYFEYVETKITEKALDATHFAEEASREQYDAVVVFGGDGTVNEVISGIDERDYIPKLGIIPGGTGNLITKLLEINQDIDGAIDELDFDLTNKIDIGKANDNYFGYIFSIGSLPEAIHNVEIEDKTKFGILTYAVNTMKSVMTDQVFNIKVETENGNYVGEASHVLVLLTNYFADKKIFEENKDGYANILILKDASIFSKLSVIPDLLKGDVIANDNIEYIKARNIKISSDSELESDVDGDKSDNLPVEIKVLAQRVEVFSKPKED

SEQ ID NO: 3741 - protein, 92 aa, Streptococcus pneumoniae
MELSAIYHRTESEYAYLYKDKKLHIRIRTKKGDIESINLHYGDPFIFMEEFYQDTKEMVKITSGTLFDHWQVEVSVDFARIQYLFELRDTEG

SEQ ID NO: 3742 - protein, 484 aa, Streptococcus pneumoniae
LYGDKGCVENSLENLHAIGNGFKLSYLHEIDACKVPDWVSNTVWYQIFPERFANGNALLNPEGTLDWDSSVTPKSDDFFGGDLQGIIDHMDYLQDLGITGLYLCPIFESTSNHKYNTTDYFEIDRHFGDKETFRELVDQAHHRGMKVMLDAVFNHIGSQSLQWKNVVKNGEQSAYKDWFHIQQFPVTTEKLVNKRDLPYHVFGFEDYMPKLNTANPEVKNYLLKVATYWIEEFNIDAWRLDVANEIDHQFWKDFRKAVLAKNPDLYILGEVWHTSQPWLNGDEFHAVMNYPLSDSIKDYFLRGIKKTDQFIDEINGESMYYKQQISEVMFNLLDSHDTERILWTANEDVQLVKSALAFLFLQKGTPCIYYGTELALTGGPDPDCRRCMPWERVSSDNDMLNFMKRLIKIRKYASVIISHGKYSLQEIKSDLVALEWKYEGRILKAIFNQSTEDYLLEKEAVALASNCQELENQLVISPDGFVIF

SEQ ID NO: 3743 - protein, 100 aa, Streptococcus pneumoniae
MGAARDFLELINHKGLPLFNPLVGDSHVNNRQEYDNTGSGNLQPEKWNETAKQLYNAIMWLIILWNAKPDTPLFNFKDEVIKYKTYEPFESSIKLVSINE

SEQ ID NO: 3744 - protein, 142 aa, Streptococcus pneumoniae
MDGITKDFIKTAKLMKQLWPQLTDKEAIDEVKKYTNGKNTAIFTEVEGDTIVGLALCSLRFDYVEGCKYSPVGFLEGIIVDEEYRLKDIAKNLCTKCEEWAKNKGCKEFASDCTLTNTDSIRFHLNIGFQEANRIIHFKKKL

SEQ ID NO: 3745 - protein, 189 aa, Streptococcus pneumoniae
MKKYSIVDKIVLSTKIKRIIIFTVFRENWEPYMKKYTEVFQSQFPNLNIDYLLLDTEQIDLDSYLDADIIIIGGGNTEKYIATYVNQEFKSYIDHMLNKEAKIIGFSAGALLLGEKVYVSPNDNSDHQIKIKNGLGLFSQFLISVHYDSWNDKANKDRAEELVNVPIIPLNDHSCLVLDKLGNIIEKID

SEQ ID NO: 3746 - protein, 70 aa, Streptococcus pneumoniae
MYFVIAEFNANWFTHRNSKRSYFLHHIKFKFFYNLTSTYQKHARNIFTDFDLSHNIFYHLTSLYLWLSYY

SEQ ID NO: 3747 - protein, 93 aa, Streptococcus pneumoniae
MMEKVASLGVPMCKPISIELCDDEVHSLHEWIDGRDAIDSILTYSENQQYTYGVEAGKILRKIHTIPATEVCEDWEIFFNLKIDDKISNEMIW

SEQ ID NO: 3748 - protein, 64 aa, Streptococcus pneumoniae
MNDEASKQLRDSRFKSLAGVQRTTFEEMLAVLKTTYQRKHAKGGRKTKLSLDDLLMVTIQYMRE

SEQ ID NO: 3749 - protein, 409 aa, Streptococcus pneumoniae
MKISKRHLLNYSILIPYLLLSILGLIVVYSTTSAILIEEGKSALQLVRNQGIFWIVSLILIALIYKLRLDFLRNERLIILVILIEMLLLFLARFIGISVNGAYGWISVAGVTIQPAEYLKIIIIWYLAHRFSKQQEEIATYDFQVLTQNQWLPRAFNDWRFVLLVLIGSLGIFPDLGNATILVLVSLIMYTVSGIAYRWFSTILALVSATSVFVLTTISLIGVETFSKIPVFGYVAKRFSAFFNPFADRADAGHQLANSYFAMVNGGWFGLGLGNSIEKRGYLPEAHTDFVFSIVIEEFGFVGASLILALLFFMILRIILVGIRAENPFNAMVALGVGGMMLVQVFVNIGGISGLIPSTGVTFPFLSQGGNSLLVLSVAVAFVLNIDASEKRAKLYRELENQPMNLLLK

SEQ ID NO: 3750 - protein, 898 aa, Streptococcus pneumoniae
MSLQKLENYSNKSVVQEEVLILTELLEDITKNMLAPETFEKIIQLKELSTQEDYQGLNRLVTSLSNDEMVYISRYFSILPLLINISEDVDLAYEINHQNNIDQDYLGKLSTTIKLVAEKENAVEILEHLNVVPVLTAHPTQVQRKSMLDLTNHIHSLLRKYRDVKLGLINKDKWYNDLRRYIEIIMQTDMIREKKLKVTNEITNAMEYYNSSFLKAVPHLTTEYKRLAQAHGLNLKQAKPITMGMWIGGDRDGNPFVTAKTLKQSALTQCEVIMNYYDKKIYQLYREFSLSTSIVNVSKQVREMARQSKDNSIYREKELYRRALFDIQSKIQATKTYLIEDEEVGTRYETANDFYKDLIAIRDSLLENKGESLISGDFVELLQAVEIFGFYLASIDMRQDSSVYEACVAELLKSAGIHSRYSELSEEEKCDLLLKELEEDPRILSATHAEKSELLAKELAIFKTARVLKDKLGDDVIRQTIISHATSLSDMLELAILLKEVGLVDTERARVQIVPLFETIEDLDHSEETMRKYLSLSLAKKWIDSRNNYQEIMLGYSDSNKDGGYLSSCWTLYKAQQQLTAIGDEFGVKVTFFHGRGGTVGRGGGPTYEAITSQPLKSIKDRIRLTEQGEVIGNKYGNKDAAYYNLEMLVSAAINRMITQKKSDTNTPNRYEAIMDQVVDRSYDVYRDLVFGNEHFYDYFFESSPIKAISSFNIGSRPAARKTITEIGGLRAIPWVFSWSQSRVMFPGWYGVGSSFKEFINKNPENIAILRDMYQNWPFFQSLLSNVDMVLSKSNMNIAFEYAKLCEDEQVKAIYETILNEWQVTKNVILAIEGHDELLADNPYLKASLDYRMPYFNILNYIQLELIKRQRRGELSSDQERLIHITINGIATGLRNSG

SEQ ID NO: 3751 - protein, 101 aa, Streptococcus pneumoniae
MKNKRLIGIIAALAVLVAGSLIYSSMNKSEAQNNKDEKKITKIGVLQFVSHPSLDLIYKGIQDGLAEEGYKDDQVKIDFMNSEGDQSKVATMSKQLVANGE

SEQ ID NO: 3752 - protein, 209 aa, Streptococcus pneumoniae
MAAITDPIGANLVKDLKKPGGNVTGVSDHNPAQQQIELIKALTPNVKTIGALYSSSEDNSKTQVEEFKAYAEKAGLTVETFAVPSTNEIASTVTVMTSKVDAIWVPIDNTIASGFPTVVSSNQSSKKPIYPSATAMVEVGGLASVVIDQHDLGVATGKMIVQVLKGAKPADTPVNVFSTGKSVINKKIAQELGITIPESVLKEAGQVIE

SEQ ID NO: 3753 - protein, 222 aa, Streptococcus pneumoniae
LAGMAAGLLYTKGKIPTLLSGILVMTSRHSIMLLIMGRANLGLLGTKQIQDVLPFDSDLNQLLTGLIFVSIVIALMLFFLDTKLGQAYIATGDNPDMARSFGIHTGRMELMGLVLSNGVIALAGALIAQQEGYADVSRGIGVIVVGLASLIIGEVIFKSLSLAERLVTIVVGSIAYQFLVWAVIALGFNTSYLRLYSALILAVCLMIPTFKQTILKGAKLSK

SEQ ID NO: 3754 - protein, 252 aa, Streptococcus pneumoniae
MTAIVELKNATKIVKNGFDEEKIILNDVSLEIFERDFITILGGNGAGKSTLFNTIAGTLSLTSGTIRILGEELTKFSPEKRAKYLSRVFQDPKMGTAPRMTVAENLLIAKFRGEKRGLLPRRLTSYKDEFQATIEKVGNGLEKHLNTPIEFLSGGQRQALSLLMATLKRPELLLLDEHTAALDPKTSVALMGLTDEFVKKDQLTALMITHHMEDALKYGNRLIVMKEGRVIQDLKQEEKAKMKISDYYQLFE

SEQ ID NO: 3755 - protein, 63 aa, Streptococcus pneumoniae
VNPIKATLVFGSRAAVCSSNKSNSGRFKVAIKRLKACLCPPDKNSIGVFKCFSRPFPTFSMVA

SEQ ID NO: 3756 - protein, 591 aa, Streptococcus pneumoniae
MEVLCMVDKQVIEEIKNNANIVEVIGDVISLQKAGRNYLGLCPFHGEKTPSFNVVEDKQFYHCFGCGRSGDVFKFIEEYQGVTFMEAVQILGQRVGIEVEKPLYSEQKPASPHQALYDMHEDAAKFYHAILMTTTMGEEARNYLYQRGLTDEVLKHFWIGLAPPERNYLYQRLSDQYREEDLLDSGLFYLSDANQFVDTFHNRIMFPLTNDQGKVIAFSGRIWQKTDSQTSKYKNSRSTAIFNKSYELYHMDRAKKSSGKASEIYLMEGFMDVIAAYRVGIENAVASMGTALSREHVEHLKRLTKKLVLVYDGDKAGQAAILKALDEIGDMPVQIVSMPDNLDPDEYLQKNGPEDLAYLLTKTRISPIEFYIHQYKPENSENLQAQIEFIEKIAPLIVKEKSIAAQNSYIHILADSLASFDYAQIEQIVNESRQVQRQNRMERISRPTPITMPVTKQLSAIMRAEAHLLYRMMESPLVLNDYRLREDFAFATPEFQVLYDLLGQYGNLPPEVLAEQTEEVERAWYQVLAQDLPAEISPQELSEVEMTRNKALLNQDNMRIKKKVQEASHVGDTDTALEELERLISQKRRME

SEQ ID NO: 3757 - protein, 304 aa, Streptococcus pneumoniae
MATKQKEVTTFDVQVAEFIRNHKQKGTATDDEINASLVIPFTLDADGIEDLLQRIQDAGISITDNEGNPSARVLSNEEEPELSDEDLIGSTSAKVNDPVRMYLKEIGVVPLLTNEEEKELALAVEAGDIEAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDLIRLVSSCVSNWMKS

SEQ ID NO: 3758 - protein, 65 aa, Streptococcus pneumoniae
ILLQTVKENVLRLRFGLDDGKMRTLEDVGKVFNVTRERIRQIEAKALRKLRQPSRSKPLRDFIED

SEQ ID NO: 3759 - protein, 109 aa, Streptococcus pneumoniae
MAYTEEQIENIKTRILTALEEVIDPELGIDIVNLGLIYEIRFDGDTGQTEIDMTLTTMGCPLADLLTDQIYDAMIEVPEVTDTEVKLVWYPAWTVEKMSRYARIAIGIK

SEQ ID NO: 3760 - protein, 68 aa, Streptococcus pneumoniae
NHATRKDRLEEKRGNFLAFPTVSHMLLYVYLMPMAMRAYRLIFSTVHAGYQTNLTSVSVTSGTSIIAS

SEQ ID NO: 3761 - protein, 266 aa, Streptococcus pneumoniae
MLSSSEKVAGQGVSGAYRELVRLLHRAAKDQLIVTENLPIEADVTHFHTIDFPYYLSTFQKKRSGRKIGYVHFLPATLEGSLKIPFFLKGIVKRYVFSFYNRMEHLVVVNPMFIEDLVAAGIPREKVTYIPNFVNKEKWHPLPQEEVVRLRTDLGLSDNQFIVVGAGQVQKRKGIDDFIRLAEELPQITFIWAGGFSFGGMTDGYEHYKKIMENPPKNLIFPGIVSPERMRELYALADLFLLPSYNELFPMTILEAASCEARYYVA

SEQ ID NO: 3762 - protein, 65 aa, Streptococcus pneumoniae
FWEGNYRATAGREEMKEAILEYQANPAALKDLKEKAKNISREYSEEHLLQIWLDFYEKQAALGRK

SEQ ID NO: 3763 - protein, 441 aa, Streptococcus pneumoniae
MRIGLFTDTYFPQVSGVATSIRTLKTELEKQGHAVFIFTTTDKDVNRYEDWQIIRIPSVPFFAFKDRRFAYRGFSKALEIAKQYQLDIIHTQTEFSLGLLGIWIARELKIPVIHTYHTQYEDYVHYIAKGMLIRPSMVKYLVRGFLHDVDGVICPSEIVRDLLSDYKVKVEKRVIPTGIELAKFERPEIKQENLKELRSKLGIQDGEKTLLSLSRISYEKNIQAVLVAFADVLKEEDKVKLVVAGDGPYLNDLKEQAQNLEIQDSVIFTGMIAPSETALYYKAADFFISASTSETQGLTYLESLASGTPVIAHGNPYLNNLISDKMFGTLYYGEHDLAGAILEALIATPDMNEHTLSEKLYEISAENFGKRVHEFYLDAIISNNFQKDLAKDDTVSQRIFKTVLYLPQQVVAVPVKGSRRMLKASKTQLISMRDYWKDHEE

SEQ ID NO: 3764 - protein, 58 aa, Streptococcus pneumoniae
MRSGRDKKIAGVCAGVAHYLDMDPTIVQVIWGVLTCCYGSGIVAYIILWIIAPVATDY

SEQ ID NO: 3765 - protein, 391 aa, Streptococcus pneumoniae
VVFVVDEGLRTLMDFRYNRHFKADSGEKGMTKGMHGRGAEDLRVRVPQGTTVRDAETGKVLTDLIKHGQEFIVAHGGRGGRGNIRFATPKNPAPEISENGEPGQERELQLELKILADVGLVGFPSVGKSTLLSVITSAKPKIGAYHFTTIVPNLGMVRTQSGESFAVADLPGLIEGASQGVGLGTQFLRHIERTRVILHIIDMSASEGRDPYEDYLAINKELESYNLRLMERPQIIVANKMDMPESQENLEEFKKKLAENYDEFEELPAIFPISGLTKQGLATLLDATAELLDKTPEFLLYDESDMEEEAYYGFDEEEKAFEISRDDDATWVLSGEKLMKLFNMTNFDRDESVMKFARQLRGMGVDEALRARGAKDGDLVRIGKFEFEFVD

SEQ ID NO: 3766 - protein, 419 aa, Streptococcus pneumoniae
MRKIVINGGLPLQGEITISGAKNSVVALIPAIILADDVVTLDCVPDISDVASLVEIMELMGATVKRYDDVLEIDPRGVQNIPMPYGKINSLRASYYFYGSLLGRFGEATVGLPGGCDLGPRPIDLHLKAFEAMGATASYEGDNMKLSAKDTGLHGASIYMDTVSVGATINTMIAAVKANGRTIIENAAREPEIIDVATLLNNMGAHIRGAGTNIIIIDGVERLHGTRHQVIPDRIEAGTYISLAAAVGKGIRINNVLYEHLEGFIAKLEEMGVRMTVSEDSIFVEEQSNLKAINIKTAPYPGFATDLQQPLTPLLLRANGRGTIVDTIYEKRVNHVFELAKMDADISTTNGHILYTGGRDLRGASVKATDLRAGAALVIAGLMAEGKTEITNIEFILRGYSDIIEKLRNLGADIRLVED

SEQ ID NO: 3767 - protein, 175 aa, Streptococcus pneumoniae
MFSFFETDRLYLRPFFFSDSQDFREIASNPENLQFIFPTQASLEESQYALANYFMKSPLGVWAICDQKNQQMIGSIKFEKLDEIKKEAELGYFLRKDAWSQGFMTEVVRKICQLSFEEFGLKQLSIITHLENEASQRVALKSGFSLFRQFKGSDRYTRKMRDYLEFRYVKGEFNE

SEQ ID NO: 3768 - protein, 425 aa, Streptococcus pneumoniae
MSKHQEILSYLEELPVGKRVSVRSISNHLGVSDGTAYRAIKEAENRGIVETRPRSGTIRVKSQKVAIERLTFAEIAEVTSSEVLAGQEGLEREFSKFSIGAMTEQNILSYLHDGGLLIVGDRTRIQLLALENENAVLVTGGFQVHDDVLKLANQKGIPVLRSKHDTFTVATMINKALSNVQIKTDILTVEKLYRPSHEYGFLRETDTVKDYLDLVRKNRSSRFPVINQHQVVVGVVTMRDAGDKSPSTTIDKVMSRSLFLVGLSTNIANVSQRMIAEDFEMVPVVRSNQTLLGVVTRRDVMEKMSRSQVSALPTFSEQIGQKLSYHHDEVVITVEPFMLEKNGVLANGVLAEILTHMTQDLVVNSGRNLIIEQMLIYFLQAVQIDDILRIQARIIHHTRRSAIIDYDIYHGHQIVSKANVTVKIN

SEQ ID NO: 3769 - protein, 286 aa, Streptococcus pneumoniae
MITLKSAREIEAIDKAGDFLASIHIGLRDLIKPGVDMWEVEEYVRRRCKEENFLPLQIGVDGAMMDYPYATCCSLNDEVAHAFPRHYILKDGDLLKVDMVLGGPIAKSDLNVSKLNFNNVEQMKKYTQSYSGGLADSCWAYAVGTPSEEVKNLMDVTKEAMYKGIEQAVVGNRIGDIGAAIQEYAESRGYGVVRDLVGHGVGPTMHEEPMVPNYGIAGRGLRLREGMVLTIEPMINTGDWEIDTDMKTGWAHKTIDGGLSCQYEHQFVITKDGPVILTSQGEEGTY

SEQ ID NO: 3770 - protein, 180 aa, Streptococcus pneumoniae
MRFSAFKIFSNSVCKRIITKGLGFRALLLYTISKVKLREDILVSQSIVPVEIPQYCRFDSKKRNGILFNVRIANLKFTFFRLDFLRNKIWYSSSMNDEASKQLTDARFKRLVGVQRTTFEEMLAVLKTAYQLKHAKGGRKPKLSLEDLLMATLQYVREYRTYEEIAAVFGIHESNLIRRS

SEQ ID NO: 3771 - protein, 74 aa, Streptococcus pneumoniae
WVEVTLVQSGVTISRTPLSSEATVMIDATEVKINRPKKELANYSCKKMPRYEGSSDCHKSRENCFFGYHCELLS

SEQ ID NO: 3772 - protein, 129 aa, Streptococcus pneumoniae
MKAQAIVTSQGRIVSLDITVNYCHDMKLFKMSCRNIGQAGKILADSGYQGLMKIYPQAQTPRKSSKLKPLTVEDKACNHALSKERSKVENIFAKVKTFKIISTTYRNHRKRFGLRMNLSAGIINHELGF

SEQ ID NO: 3773 - protein, 763 aa, Streptococcus pneumoniae
MNALLNGMNDRQAEAVQTTEGPLLIMAGAGSGKTRVLTHRIAYLIDEKLVNPWNILAITFTNKAAREMKERAYSLNPATQDCLIATFHSMCVRILRRDADHIGYNRNFTIVDPGEQRTLMKRILKQLNLDPKKWNERTILGTISNAKNNLIDDVAYAAQAGDMYTQIVVQCYTAYQKELRQSESVDFDDLIMLTLRLFDQNPDVLTYYQQKFQYIHVDEYQDTNHAQYQLVKLLASRFKNICVVGDADQSIYGWRGADMQNILDFEKDYPKAKVVLLEENYRSTKTILQAANEVIKNNKNRRPKNLWTQNADGEQIVYYRADDELDEAVFVARTIDELSRSQNFLHKDFAVLYRTNAQSRTIEEALLKSNIPYTMVGGTKFYSRKEIRDIIAYLNLIANLSDNISFERIINEPKRGIGPGTVEKIRDFANLQNMSMLDASANIMLSGIKGKAAQSIWDFANMMLDLREQLDHLSITELVESVLEKTGYVDILNAQATLESKARVENIEEFLSVTKNFDDTTDVTEEETGLDKLSRFLNDLALIADTDSGSQETSEVTLMTLHAAKGLEFPVVFLIGMEENVFPLSRATEDPDELEEERRLAYVGITRAEKILYLTNANSRLLFGRTNYNRPTRFINEISSDLLEYQGLARPANTSFKASYSSGSISFGQGMSLAQALQDRKRGAAPKSIQSSGLPFGQFTAGAKPASSEANWSIGDIALHKKWGEGTVLEVSGSGARQELKINFPEVGLKKLLASVAPIEKKI

SEQ ID NO: 3774 - protein, 240 aa, Streptococcus pneumoniae
FSILLTNNKVRRIFMYSISFQEDSLLPRERLAKEGVEALSNQELLAILLRTGTRQVSVFEIAQKVLNNLSSLTDLKKMTLQELQSLSGIGRVKAIELQAMIELGHRIHKHETLEMESILSSQKLAKKMQQELGDKKQEHLVALYLNTQNQIIHQQTIFIGSVTRSIAEPREILHYAIKHMATSLILVHNHPSGAVAPSQNDDHVTKLVKEACELMGIVLLDHLIVSHSNYFSYREKTDLI

SEQ ID NO: 3775 - protein, 229 aa, Streptococcus pneumoniae
MKKPVIGITGNEKTHPDDDIMMSYAAKGFVEGVKDAGGIPIILPIGDQEMACHYISLIDKLILTGGQNVDPKFYGEPKTIDSDDYHLQRDIFELALIKEAIKQKKPIFSVCRGTQLFNVAMGGTLYQDIEDHWQDSSVEYTTQRLVTEPDTVLQEIYGEISHINSFHHQSIKDLAPNLKVVAHDPKDGIIEAVMSTDDVAFLGVQWHPELLFENRPKDKKLFDYVVNEL

SEQ ID NO: 3776 - protein, 213 aa, Streptococcus pneumoniae
VKDKQFAIPKATAKRLSLYYRIFKRFHAEKIERANSKQIAEAIGIDSATVRRDFSYFGELGRRGFGYDVKKLMTFFADLLNDNSITNVMLVGIGNMGHALLHYRFHERNKMKIIMAFDLDDHPEVGTQTPDGIPIYGISQIKDKIKDADVKTAILTVPSVKSQEVANLLVDAGVKGILSFSPVHLHLPKDVVVQYVDLTSELQTLLYFMRKED

SEQ ID NO: 3777 - protein, 83 aa, Streptococcus pneumoniae
VVSLQNRKDRAKMFELTYKDCYHVERTLKYEDHEALMLTLSGCVTLPDTLYVTSLTFRGQKVYQGLVGDLYRFLSHADFLHQN

SEQ ID NO: 3778 - protein, 115 aa, Streptococcus pneumoniae
MAFEKIIQLKNCRYDYTLSPSVKKFTLKDNTFFETKVGNYELTRLLEKVPNSGEGFQLKIIINKELTGAKINITDKFGLRLVDIFKSEDHHIHQEKFYFLMDSLVERGIFTKSER

SEQ ID NO: 3779 - protein, 264 aa, Streptococcus pneumoniae
LVQHFGFEATIIQPENQEITAQQIQKALRDDTILVSTMFANNETGNLLPIAEIGQILKQHPAAYHVDAVQAIGKIPIHSEELGIDFLTASAHKFHGPKGIGFLYASSMDFDSYLHGGDQEQKKRAGTENLPAIVGMVAALKEDLEKQEEHFQHVQNLETAFLAELEGIQYYLNRGKHHLPYVLNIGFPGQKNDLLLLRLDLAGISISTGSACTAGVVQSSHVLEAMYGANSERLKESLRISLSPQNTVEDLQTLAKTLKEIIGG

SEQ ID NO: 3780 - protein, 144 aa, Streptococcus pneumoniae
LLICMPFRFKVSLIFQWIIFSLFPYSQNITAIKDCLVQMLLSLALKNSGVKRARSLAEYLDAPIAIIDYPQDDATRNEGYIIGDVEGKTAILIDDILNTGRTFSEASKIVEREGATEIYAVSSHGLFVEGAAELLDNTNIKEIL

SEQ ID NO: 3781 - protein, 182 aa, Streptococcus pneumoniae
MSDRKNMKLFALNSNQEIAQKIAQAVGVPLGKLSSRQFSDGEIQVNIEESVRGYDVYIIQSTSFPVNNHLMELLIMVDACVRASAHSINVVLPYFGYARQDRIACPREPLTAKLVANMLVKAGVDRILTLDLHAVQVQGFFDIPVDNLFTVPLFAKHYCDKGLLGSDVVVVSPKKFRCQTCA

SEQ ID NO: 3782 - protein, 189 aa, Streptococcus pneumoniae
MKHLEIELKTLLKKDEYNRLKDQFTGVTPVLQTNYYIDTPDFELREKKVAMRIRTFEDWAELTLKVPQSVGNMEYNQKLQLKDAENYLSKEELPQGLVLDELAKHGIQSKNWQVLGCLTTLRYEMKTAIGLMALDQSRYFDMTDYELELEVENHEQGKQDFRQFLEKNQISYQKAPSKLVRFVKSMKNS

SEQ ID NO: 3783 - protein, 167 aa, Streptococcus pneumoniae
MTLEWEEFLDPYIQAVGELKIKLRGIRKQYRKQNKHSPIEFVTGRVKPIESIKEKMARRGITYATLEHDLQDIAGLRVMVQFVDDVKEVVDILHKRQDMRIIQERDYITHRKASGYRSYHVVVEYTVDTINGAKTILAEIQIRTLAMNFWATIEHSLNYKYQGDFPV

SEQ ID NO: 3784 - protein, 70 aa, Streptococcus pneumoniae
NILSTTSTKGISQYEIKKRLEITARIAHQLDEEMGEIRDDIQEAQALFDPLSRKLNDGVGSSHGTDEEYR

SEQ ID NO: 3785 - protein, 262 aa, Streptococcus pneumoniae
PTRNTARGQRVLYELRDRLKRNQFILNDTNPDIVISIGGDGMLLSAFHKYENQLDKVRFIGLHTGHLGFYTDYRDFELDKLVTNLQLDTGARVSYPVLNVKVFLENGEVKIFRALNEASIRRSDRTMVADIVINGVPFERFRGDGLTVSTPTGSTAYNKSLGGAVLHPTIEALQLTEIASLNNRVYRTLGSSIIVPKKDKIELIPTRNDYHTISVDNSVYSFRNIERIEYQIDHHKIHFVATPSHTSFWNRVKDAFIGEVDE

SEQ ID NO: 3786 - protein, 298 aa, Streptococcus pneumoniae
MRFEFIADEHVKVKTFLKKHEVSKGLLAKIKFRGGAILVNNQPQNATYLLDVGDYVTIDIPAEKGFETLEAIELPLDILYEDDHFLVLNKPYGVASIPSVNHSNTIANFIKGYYVKQNYENQQVHIVTRLDRDTSGLMLFAKHGYAHARLDKQLQKKSIEKRYFALVKGDGHLEPEGEIIAPIARDEDSIITRRVAKGGKYAHTSYKIVASYGNIHLVYIHLHTGRTHQIRVHFSHIGFPLLGDDLYGGSLEDGIQRQALHCHYLSFYHPFLEQDLQLESPLPDDFSNLITQLSTNTL

SEQ ID NO: 3787 - protein, 324 aa, Streptococcus pneumoniae
MEVFESLKANLVGKNARIVLPEGEEPRILQATKRLVKETEVIPVLLGNPEKIKIYLEIEGIMDGYEVIDPQHYPQFEEMVSALVERRKGKMTEEDVRKVLVEDVNYFGVMLVYLGLVDGMVSGAIHSTASTVRPALQIIKTRPNVTRTSGAFLMVRGTERYLFGDCAININPDAEALAEIAINSAITAKMFGIEPKIAMLSYSTKGSGFGESVDKVVEATKIAHDLRPDLEIDGELQFDAAFVPETAALKAPGSTVAGQANVFIFPGIEAGNIGYKMAERMGGFAAVGPVLQGLNKPVNDLSRGCNADDVYKLTLITAAQAVHQ

SEQ ID NO: 3788 - protein, 78 aa, Streptococcus pneumoniae
KLQKTDFYRSEHQKRKDEICPFSSLADFNPLQLTKSQKILFSYSFKIKKGIYRFTDMYITDFYRSCIDRISSLGSFPF

SEQ ID NO: 3789 - protein, 198 aa, Streptococcus pneumoniae
AQAETVSQTVSLPNAKIVLDRFHIVQHLSRAMSRVHVQIMNQFHRKSHEYKAIKRYWKLIQQDSRKLSDKRFYRPTFRMHLTNKEILNKLLSYSEDLKHHYQLYNKEPEKFFGLIEDNLKQVHPIFQTVFKTFLKDKEKIVNALQLPYSNAKLEATNNLIKLIKRNAFGFRNFENFKKRIFIALNIKKERTKFVLSQA

SEQ ID NO: 3790 - protein, 108 aa, Streptococcus pneumoniae
NSPGSDCFNREMEMSFIAQDFDKLNIITVLEGRTQAIIRNHFLRYDRAVRCRVKIITMDMFSPYYGLAKQLRFQISRLRLKQSPRLFHSRMLKSFLIAFTLYNILAVL

SEQ ID NO: 3791 - protein, 172 aa, Streptococcus pneumoniae
MEQLHFITKLLDIKDPNIQILDIINKDTHKEIIAKLDYDAPSCPECGNQLKKYDFQKPSKIPYLETTGMPTRILLRKRRFKCYHCSKMMVAETSIVKKNHQIPRIINQKIAQKLIEKISMTDIAHQLFISTSTVIRKLNDFHFKHDFSCLPEIMSWDVETVRVVTVSIGRWR

SEQ ID NO: 3792 - protein, 107 aa, Streptococcus pneumoniae
DERNFRNLMMNMQNMMRQAQKLQKQMEQSQAELAAMQFVGKSAQDLVQATLTGDKKVVSIDFNPAVVDPEDLETLSDMTVQAINSALEQIDETTKKKLGAFAGKLPF

SEQ ID NO: 3793 - protein, 230 aa, Streptococcus pneumoniae
MRLLPIRKISRQSKRLALFLTFCAGYVDAYTFIVRGNTLVAGQTGNVVFLSVELIKNNVSDVRDKVLTLLAFMMGVFLLTIYKEKLRIVKKPILSLIPLAILSIIIAFVPQTVDNIYLVPPLAFCMGLVTTAFGEVSGIAYNNAFMTGNIKRTMLAFGDYFRTKHTPFLREGFIFVSLLSSFVLGVVFSAYLTIFYHEKTILGVPIMMSVFYLSMLFASWQKKVKEKASF

SEQ ID NO: 3794 - protein, 104 aa, Streptococcus pneumoniae
MSTYAIIKTGGKQVKVEVGQAVYVEKLNVEAGQEVTFNEVVLVGGENTVVGTPLVAGATVVGTVEKQGKQKKVVTYKYKPKKGSHRKQGHRQPYTKVVINAINA

SEQ ID NO: 3795 - protein, 146 aa, Streptococcus pneumoniae
VSSNFRTPQLAIFGSLKDCLYHVFSLKLSVDCVDDNFCIWLTVTLFTVATFFRFVLVSNHFLLFSLFFNSSNYSSSSNKWSSDNSVFTTNKNNFVKSNFLTSFNVQFFNVNCLTNFNFNLFSASFDNCVCAHYAPPMIFMGFPDFL

SEQ ID NO: 3796 - protein, 114 aa, Streptococcus pneumoniae
MIQAVFERAEDGELRSAEITGHAESGEYGLDVVCASVSTLAINFINSIEKFAGYEPILELNEDEGGYLMVEIPKDLPSHQREMTQLFFESFFLGMANLSENSSEFVQTRVITEN

SEQ ID NO: 3797 - protein, 97 aa, Streptococcus pneumoniae
MLKMTLNNLQLFAHKKGGGSTSNGRDSQAKRLGAKAADGQTVTGGSILYRQRGTHIYPGVNVGRGGDDTLFAKVEGVVRFERKGRDKKQVSVYPIAK

SEQ ID NO: 3798 - protein, 54 aa, Streptococcus pneumoniae
LIPILFNMYSGLILFENQIQTTSISPCRTQVQPAANFLVCTLIFIEYESGIEHC

SEQ ID NO: 3799 - protein, 305 aa, Streptococcus pneumoniae
MIITIPIKNQKDIGTPSDSVVVLGYFDGIHKGHQELFRVANKAARKDLLPIVVMTFNESPKIALEPYHPDLFLHILNPAERERKLKREGVEELYLLDFSSQFASLTAQEFFATYIKAMNAKIIVAGFDYTFGSDKKTAEDLKDYFDGEVIIVPPVEDEKGKISSTRIRQAILDGNVKEAGKLLGAPLPSRGMVVHGNARGRTIGYPTANLVLLDRTYMPADGVYVVDVEIQRQKYRAMASVGKNVTFDGEEARFEVNIFDFNQDIYGETVMVYWLDRIRDMTKFDSVDQLVDQLKADEEVTRNWS

SEQ ID NO: 3800 - protein, 282 aa, Streptococcus pneumoniae
MIKKIYPIFTILLGAAIYAFGLTYFVVPHHLFEGGATGITLITFYLFKIPVSLMNLLINIPLFILAWKIFGAKSLYSSLLGTLALSGWLAFFEHIPLHIDLQGDLLITALIAGILLGIGLGIIFNAGGTTGGTDILARILNKYTHISIGKLLFILDFCILMLILLIFKDLRLVSYTLLFDFIVSRVIDLIGEGGYAGKGFMIITKRPDQLAKAINDDLGRGVTFISGQGYYSKENLKIIYCIVGRNEIVKTKEMIHRIDPQAFITITEAHEILGEGFTFEKE

SEQ ID NO: 3801 - protein, 279 aa, Streptococcus pneumoniae
MTKIKIVTDSSVTIEPELVKQLDITIVPLSVMIDNVVYSDADLKEEGKFLQLMQESKNLPKTSQPPVGVFAEIFEDLCKDGGQILAIHMSHALSGTVEAARQGASLSTADVTVVDSSFTDQALKFQVVEAAKLAQEGKDMEAILSHVEEVKNHTELYIGVSTLENLVKGGRISRVTGLLSSLLNIRVVMQMKDHELQPMVKGRGTKTFKKWLDELITSLSERAVAEIGISYSGSDDWAKEMKESLQAYVEKPISVLETGSIIQTHTGENAWAILIRYHS

SEQ ID NO: 3802 - protein, 91 aa, Streptococcus pneumoniae
MANKQDLIAKVAEATELTKKDSAAAVEAVFAAVADYLAAGEKVQLIGFGNFEVRERAERKGRNPQTGKEMTIAASKVPAFKAGKALKDAVK

SEQ ID NO: 3803 - protein, 633 aa, Streptococcus pneumoniae
MIILQANKIERSFAGEVLFDNINLQVDERDRIALVGKNGAGKSTLLKILVGEEEPTSGEINKKKDISLSYLAQDSRFESENTIYDEMLHVFDDLRRTDKQLRQMELEMGEKSGEDLDKLMSDYDRLSENFRQAGGFTYEADIRAILNGFKFDESMWQMKIAELSGGQNTRLALAKMLLEKPNLLVLDEPTNHLDIETISWLENYLVNYSGALIIVSHDRYFLDKVATITLDLTKHSLDRYVGNYSRFVELKEQKLATEAKNYEKQQKEIAALEDFVNRNLVRASTTKRAQSRRKQLEKMERLDKPEAGKKAANMTFQSEKTSGNVVLTVENAAVGYDGEVLSQPINLDLRKMNAVAIVGPNGIGKSTFIKSIVDQIPFIKGEKRFGANVEVGYYDQTQSKLTPSNTVLDELWNDFKLTPEVEIRNRLGAFLFSGDDVKKSVGMLSGGEKARLLLAKLSMENNNFLILDEPTNHLDIDSKEVLENALIDFDGTLLFVSHDRYFINRVATHVLELSENGSTLYLGDYDYYVEKKATAEMSQTEEASTSNQAKEASPVNDYQAQKESQKEVRKLMRQIESLEAEIEELESQSQAISEQMLETNDADKLMELQAELDKISHRQEEAMLEWEELSDQV

SEQ ID NO: 3804 - protein, 297 aa, Streptococcus pneumoniae
VGRIIRSGVKMEHLGKVFREFRTSGNYSLKEAAGESCSTSQLSRFELGESDLAVSRFFEILDNIHVTIENFMDKARNFHNHEHVSMMAQIIPLYYSNDIAGFQKLQREQLEKSKSSTTPLYFELNWILLQGLICQRDASYDMKQDDLDKVADYLFKTEEWTMYELILFGNLYSFYDVDYVTRIGREVMEREEFYQEISRHKRLVLILALNCYQHCLEHSSFYNANYFEAYTEKIIDKGIKLYERNVFHYLKGFALYQKGQCKEGCKQMQEAIHIFDVLGLPEQVAYYQEHYEKFVKS

SEQ ID NO: 3805 - protein, 392 aa, Streptococcus pneumoniae
MNRYAVQLISRGAINKMGNMLYDYGNSVWLASMGTIGQTVLGMYQISELVTSILVNPFGGVISDRFSRRKILMTADLVCGILCLAISFIRNDSWMIGALIVANIVQAIAFAFSRTANKAIITEVVEKDEIVIYNSRLELVLQVVGVSSPVLSFLVLQFASLHMTLLLDSLTFFIAFVLVAFLPKEEAEVQEKKAFTGRDIFVDIKDGLHYIWHQQEIFFLLLVASSVNFFFAAFEFLLPFSNQLYGSEGAYASILTMGAIGSIIGALLASKIKANIYNLLILLALTGVGVFMMGLPLPTFLSFSGNLVCELFMTIFNIHFFTQVQTKVESEFLGRVLSTIFTLAILFMPIAKGFMTVLPSVHLSSFLIIGSGVIILSCISFIYVRTHFEKLI

SEQ ID NO: 3806 - protein, 655 aa, Streptococcus pneumoniae
NGLMNKRMNELVALLNRYATEYYTSDNPSVSDSEYDRLYRELVELETAYPEQVLADSPTHRVGGKVLDGFEKYSHQYPLYSLQDAFSREELDAFDARVRKEVAHPTYICELKIDGLSISLTYEKGILVAGVTRGDGSIGENITENLKRVKDIPLTLPEELDITVRGECYMPRASFDQVNQVRQENGEPEFANPRNAAAGTLRQLDTAVVAKRNLATFLYQEASPSTRDSQEKGLKYLEQLGFVVNPKRILAENIDEIWNFIQEVGQERENLPYDIDGVVIKVNDLASQEELGFTVKAPKWAVAYKFPAEEKEAQLLSVDWTVGRTGVVTPTANLTPVQLAGTTVSRATLHNVDYIAEKDIRKDDTVIVYKAGDIIPAVLRVVESKRVSEEKLDIPTNCPSCNSDLLHFEDEVALRCINPRCPAQIMEGLIHFASRDAMNITGLGPSIVEKLFAANLVKDVADIYRLQEEDFLLLEGVKEKSAAKLYQAIQASKENSAEKLLFGLGIRHVGSKASQLLLQYFHSIENLYQADSEEVASIESLGGVIAKSLQTYFATEGSEILLRELKETGVNLDYKGQTVVADAALSGLTVVLTGKLERLKRSEAKSKLESLGAKVTGSVSKKTDLVVVGADAGSKLQKAQELGIQVRDEAWLESL

SEQ ID NO: 3807 - protein, 759 aa, Streptococcus pneumoniae
MYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATKVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGCLIYEVHGKEHLLVVVNAKSEPYQFENAGNLAMLVTNSRSKEDNVLNDISLAVLSVL

SEQ ID NO: 3808 - protein, 474 aa, Streptococcus pneumoniae
LTRYQNLVNGKWKSSEQEITIYSPINQEELGTVPAMTQTEADEAMQAARAALPAWRALSAIERAAYLHKTAAILERDKEKIGTILAKEVAKGIKAAIGEVVRTADLIRYAAEEGLRITGQAMEGGGFEAASKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 3809 - protein, 642 aa, Streptococcus pneumoniae
MDNREALKTFMTGENFYLQHYLGAHREELNGEYGYTFRVWAPNAQAVHLVGDFTNWIENQIPMVRNDFGVWEVFTNMAQEGHIYKYHVTRQNGHQLMKIDPFAVRYEARPGTGAIVTELPDKKWRDGLWLARRKRWGFAERPVNIYEVHAGSWKRNPDGSPYSFAQLKDELIPYLVEMNYTHIEFMPLMSHPLGLSWGYQLMGYFALEHAYGRPEEFQDFVEECHTHNIGVIVDWVPGHFTINDDALAYYDGTPTFEYQDHNKAHNHGWGALNFDLGKNEVQSFLISCIKHWIDIYHLDGIRVDAVSNMLYLDYDDAPWTPNKDGGNLNYEGYYFLQRLNEVIKLEYPDVMMIAEESSSATKITGMKEIGGLGFDYKWNMGWMNDILRFYEEDPIYRKYDFNLVTFSFMYVFKENYLLPFSHDEVVHGKKSMMHKMWGDRYNQFAGLRNLYTYQICHPGKKLLFMGSEYGQFLEWKSEEQLEWSNLEDPMNAKMKYFTSQLNQFYKDHRCLWEIDTSYDGIEIIDADNRDQSVLSFIRKGKKGEMLVCIFNMVPVERKDFTIGLPVAGIYEEVWNTELEEWGGVWKEHNQTVQTQEGLWKDYEQTLTFTLPAMGASVWKIKRRLKSTKTVTNKNQKGVENEK

SEQ ID NO: 3810 - protein, 380 aa, Streptococcus pneumoniae
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 3811 - protein, 379 aa, Streptococcus pneumoniae
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEPGVVIRGTAEHPVVVKKGAKVTEDIHS

SEQ ID NO: 3812 - protein, 477 aa, Streptococcus pneumoniae
MKILFVAAEGAPFSKTGGLGDVIGALPKSLVKAGHEVAVILPYYDMVEAKFGNQIEDVLHFEVSVGWRRQYCGIKKTVLNGVTFYFIDNQYYFFRGHVYGDFDDGERFAFFQLAAIEAMERIAFIPDLLHVHDYHTAMIPFLLKEKYRWIQAYEDIETVLTIHNLEFQGQFSEGMLGDLFGVGFERYADGTLRWNNCLNWMKAGILYANRVSTVSPSYAHEIMTSQFGCNLDQILKMESGKVSGIVNGIDADLYNPQTDALLDYHFNQEDLSGKAKNKAKLQERVGLPVRADVPLVGIVSRLTRQKGFDVVVESLHHILQEDVQIVLLGTGDPAFEGAFSWFAQIYPDKLSANITFDVKLAQEIYAACDLFLMPSRFEPCGLSQMMAMRYGTLPLVHEVGGLRDTVCAFNPIEGSGTGFSFDNLSPYWLNWTFQTALDLYRNHPDIWRNLQKQAMESDFSWDTACKSYLDLYHSLVN

SEQ ID NO: 3813 - protein, 123 aa, Streptococcus pneumoniae
MSQVKGLCVLDVDGTLILEEVIDFLGREAGHEAEISQITSRAMRGELVFESSLRKRVSLLEGLPILVFDNVFNSIHLSLNVPEFISILQKNGILVDLVSGGFTPIVGEISKIPWYCLFHCQPA

SEQ ID NO: 3814 - protein, 109 aa, Streptococcus pneumoniae
LERLAKSLGIAYFTANQLEVKEGLLTGKLVGQIISPQVKKETLEKWRKKLKLSKERTVAIGDGVNNLLMLKSAELGIAFCAKEVLKKEIPHHVDKRDFLEVLPLIDCLE

SEQ ID NO: 3815 - protein, 371 aa, Streptococcus pneumoniae
MKIVIAPDSFKESLTAQQVAEAIKRGFQQSIADVECLLCPVGDGGEGTVDAIRHSLDLKEKWIQVTDPSGQKEAMRYFQKGELALFEVADLVGLGKIPLEKRNPLQIQTCGIGELILHLISKGIKDIYIGVGGTASNDGGLGIAAGLGYQFYDRDGNVLPASGQSLLNLASVSTENRYKIPEGVQIHILADVVSPLCGHQGATYTFGNQKGLHPTMFAVVDQAIQDFYEKFSPATLEIKGAGAGGGLAGGLCAFAQASIVSGIDTCLDLINFDKKVSDADLVVVGEGRLDSQSFAGKAPIGVAKRTPVGVPVIAICGSLAEDLPPLPFENIQAVFSILEKSEPLEDSLKNASLYLERTAANIGHLLNMCKI

SEQ ID NO: 3816 - protein, 148 aa, Streptococcus pneumoniae
MTDLSKQLLEKAHGGLKINPDEQRRYLGTFEERVLGYVDIDTANSPQLEKGFLFILENLQEKAEPLFVKISPTIEFDKQVFYLKEAKETDSQATIVSEEHITSPFGLVIHSNAPVQVEEKDLRLAFPKLWEVKKEEPAKTSLWKKWFS

SEQ ID NO: 3817 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 3818 - protein, 155 aa, Streptococcus pneumoniae
FKDFLKGVEDFSTVTKGFFKCWRTNWQDHELLESDWSVRVRTTVDDVHHWSWKNFSVESTKVAVKWDFKVVSSSTSYSDRHTEDCIRTQFTFVRSTVKCDHSTVNSLLITYIVANDSFSNDVVYVVNSFLCTKTTVTRFVTVAKFNCFVFTSRSS

SEQ ID NO: 3819 - protein, 43 aa, Streptococcus pneumoniae
LYLAMRSVRESEPVLICPALVATAISAIVESSVSPERCDTTAV

SEQ ID NO: 3820 - protein, 168 aa, Streptococcus pneumoniae
VKSLGINFYLFLPTHLSTILLRKHGLISKSTSKGYYQVAIPFMRLFCLVLVSIDYINCLSETTDKNWHKSDRVFVTNTGKTVHSSILSKSLQRANERLKKPIPKHLSPHIFRHTTISILSENKIPLKTITDRVGHSDSEVTTSIYTHVTKNMKDEAINVLDKVMKKIF

SEQ ID NO: 3821 - protein, 112 aa, Streptococcus pneumoniae
LVAGLTNGELIAPMTYEETMTSDFFEAWFQKFLLPTLNTPSVIIMDNARFHRMGKLELLCEEFGYKLLPLPPYSPEYNPIEKTWAHIKKHLKRVLPSCNTFYEALLSCSCFN

SEQ ID NO: 3822 - protein, 115 aa, Streptococcus pneumoniae
MWYNLLMAYSIDFRKKVLSYCERTGSITEASHVFQISRNTIYGWLKLKKKTGELNHQVKGTKPRKVDRDRLKNYLTDNPDAYLTEIASEFGCHPTTIHYALKAMGYTRKKEPHLL

SEQ ID NO: 3823 - protein, 1091 aa, Streptococcus pneumoniae
MKLLYTDIRTSLTEILTREAEELVAAGKRVFYIAPNSLSFEKERAVLEYLSQQASFSITVTRFAQMARYLVLNDLPAKTTLDDIGLGLAFYKCLAELDPKDLRVYGAIKQDPQLIQQLIELYHEMTKSQMSFLDLENLTDEDKRADLLLIFEKVTAYLNQGQLAQGSQLSHLIEAIENDKVSSDFNQIALVIDGFTRFSAEEERVVDLLHGKGVEIVIGAYASKKAYTSPFSEGNLYQASVKFLHHLASKYQTPAQDCSQTHEKMDSFDKASRLLESSYDFSELALDVDEKDRENLQIWSCLTQKEELELVARSIRQKLHENSDLSYKHFRILLGDVASYQLSLKTIFDQYQIPFYLGRSEAMAHHPLTQFVESILALKRYRFRQEDLINLLRTDLYTDLSQSDIDAFEQYIRYLGINGLPAFQQTFTKSHHGKFNLERLNVLRLRILAPLETLFASRKQKAENLLQKWSVFLKEGAVTKQLQDLTTTLEAVEQERQTEVWKAFCHVLEQFATVFAGSQVSLEDFLALLHSGMSLSQYRTIPATVDTVLVQSYDLIAPLTADFVYAIGLTQDNLPKISQNTSLLTDEERQNLNQTTEEGVQLLIASSENLKKNRYTMLSLVNSARKQLFLSAPSLFNESESKESAYLQELIHFGFRRREKRMNHKGLSKEDMGSYHSLLSSLVAYHQQGEMSDTEQDLTFVKVLSRVIGKKLDLQGLENPAIPTSPSSKTLTKDTLQALYPAKQEFYLSTSGLTEFYLNEYSYFLRYVLGLQEELRLRPDARSHGNFLHRIFERALQLPNEDSFDQRLEQAIQETSQEREFEAIYQESLEAQFTKEVLLDVARTTGHILRHNPAIETIKEEANFGGKDQAFIQLDNGRSVFVRGKVDRIDRLKANGAIGVVDYKSSLTQFQFPHFFNGLNSQLPTYLAALKREGEQNFFGAMYLEMAEPIQSLMAVKSLAGAVVEASKSMKYQGLFLEKESSYLGEFYNKNKANQLTDEEFQLLLDYNAYLYKKAAEKILAGRFAINPYTENGRSIAPYVQQHQAITGFEANYHLGQARFLEKLDLADGKRLVGEKLKQAWFEKIREELNR

SEQ ID NO: 3824 - protein, 1216 aa, Streptococcus pneumoniae
MKLIPFLSEEEIQKLQEAEANSSKEQKKTAEQIEAIYTSGQNILVSASAGSGKTFVMVERILDQLARGVEISQLFISTFTVKAATELKERLEKKISKKIQETDDVDLKQHLGRQLADLPNAAIGTMDSFTQKFLGKHGYLLDIAPNFRILQNQSEQLLLENEVFHEVFEAHYQGKQKETFSHLLKNFAGRGKDERGLRQQVYKIYDFLQSTSNPQKWLSESFLKGFEKADFTSEKEKLTEQIKQALWDLESFFRYHLDNDAKEFAKAAYLENVQLILDEIGSLNQEFDSQAYQAVLARVVAISKEKNGRALTNASRKADLKPLADAYNEERKTQFTKLGQLSDQIAILDYQERYHGDTWKLAKTFQSFMSDFVEAYRQRKRQENAFEFADISHYTIEILENFPQVRESYQERFHEVMVDEYQDTNHIQERMLELLSNGHNRFMVGDIKQSIYRFRQADPQIFNEKFQRYAQNPQEGKLILLKENFRSSSEVLSATNDVFERLMDQEVGEINYDNKHQLVFANTKLTPNPDNKAEFLLYDKDDTGEEEESQTETKLTGEMRLVIKEILKLHQEKGVAFKEIALLTSSRSRNDQILLALSEYGIPVKTDGEQNNYLQSLEVQVMLDTLRVIHNPLQDYALVALMKSPMFGFDEDELARLSLQKAEDKVHENLYEKLVNAQKMASSQKGLIHTALAEKLKQFMDILASWRLYAKTHSLYDLIWKIYNDRFYYDYVGALPNGPARQANLYALALRADQFEKSNFKGLSRFIRMIDQVLEAQHDLASVAVAPPKDAVELMTIHKSKGLEFPYVFILNMDQDFNKQDSMSEVILSRQNGLGVKYIAKMETGAVEDHYPKTIKLSIPSLTYRQNEEELQLASYSEQMRLLYVAMTRAEKKLYLVGKGSREKLESKEYPAAKNGKLNSNTRLQARNFQDWLWAISKVFTKDKLNFSYRFIGEDQLTREAIGELETKSPLQDSSQADNRQSDTIKEALEMLKEVEVYNTLHRAAIELPSVQTPSQIKKFYEPVMDMEGVEIAGQGQSVGKKISFDLPDFSTKEKVTGAEIGSATHELMQRIDLSQQLTLASLTETLKQVQTSQAVRDKINLDKILAFFDTVLGQEILANTDHLYREQPFSMLKRDQKSQEDFVVRGILDGYLLYENKIVLFDYKTDRYDEPSQLVDRYRGQLALYEEALSRAYSIENIEKYLILLGKDEVQVVKV

SEQ ID NO: 3825 - protein, 78 aa, Streptococcus pneumoniae
YSIKIKEQTRKLAAVSSKHCFEVVDRTDEVSSKHCFEVVDRTDEVSNHIYSKAKLTWFEEIFKEYKLYFYNLNLVFTE

SEQ ID NO: 3826 - protein, 63 aa, Streptococcus pneumoniae
LKISSNHVSFALLYIWLLTSSVLSTTSKQCFELTSSVLSTTSKQCFELTAASFLVCSLIFIEY

SEQ ID NO: 3827 - protein, 392 aa, Streptococcus pneumoniae
MTLPVRKSLHDAVLQASKADTWEQATKEWNEVSFIFNGIGRSNCVCGNAIKYAYELFNGVTGQRLFPIGSDCVRHFHRLPLDQQLEEEEKLLRKVENLTRKAQKKEKIKVNKSDFDERLLKWLWEKGVFKPNRGNQFAPERDYQLFLEVFQGGSWTKAEPKKKARMEEVLEKCIKPFLLGKSDDQLYLVKLGKEKIDYEQELRIQAEKERKKRDKIAKQYADNLVLAMGPAERAYQDYFGFTETLTQEERKWEKILFGKNRAERAIKAKQYQKELEKDQRIASQDPIERKQKQTWLLNSYFRELPEEKARFSRLLLEYRKNGEVPFSTEYLSDHLIDFFYKMKAFEFEIAPEQVRDFLKKSLQEDYRSSAQGSWIEGILLNCLKPFLERLVI

SEQ ID NO: 3828 - protein, 110 aa, Streptococcus pneumoniae
MKNALVFHQNTFPLFLLEIKFIYVTKTFIILVYYLLSIEKAVYLNYTLNLQKSLKIEMRFHTLFYIIWGYNNTYHEIYTVGVTHITNRSKNGLRQLRRIPSIQLPCADER

SEQ ID NO: 3829 - protein, 1965 aa, Streptococcus pneumoniae
MEKYFGEKQERFSFRKLSVGLVSATISSLFFMSVLASSSVDAQETAGVHYKYVADSELSSEEKKQLVYDIPTYVENDDETYYLVYKLNSQNQLAELPNTGSKNERQALVAGASLAALGILIFAVSKKKVKNKTVLHLVLVAGIGNGVLVSVHALENHLLLNYNTDYELTSGEKLPLPKEISGYTYIGYIKEGKTTSDFEVSNQEKSAATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETIEIKIDFQEEIQENPDLVEGIVRVKQEGKLGKKVEIVRIFSVNKEEVSREIVSTSTTAPIPRIVEKGTKKTQVIKEQPETGVEHKDVQSGAIVEPAIQPELPEAVVSDKGVPEVQPALSKAVITDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSENTGEESSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELSTDDKSYIKGTFTGQLIGEKDGKHYAIYNLKKPLFENLSGATVEKLSLKNVAISGKNDIGSLANEATNGTKIKQVHVDGVLAGERGVGGLLAKADQSSIAESSFKGRIVNTYETTDSYNIGGLVGHLTGKNASIAKSKATVTISSNTNRSDQTVGGLAGLVDRDAQIQDSYAEGDINNVKHFGRVAGVAGNLWDRTSGDVRHAGSLTNVLSDVNVTNGNAITGYHYTGMKVANTFSSKANRVFNVTLEKDEVVSKESFEERGTMLDASQIVSKKAEISPLTLPTVEPLSTSGKKDSDFSKIAHYQANRALVYKNIEKLLPFYNKSTIVKYGNLVKENSLLYQKELLSAVMMKDDQVITDIVSNKQTANKLLLHYNDHSSEKFDLKYQTDFANLAEYNLGNTGLLYTPNQFLYDRDSIVKEVLPELQKLDYQSDAIRKTLGISPAVKLTELYLEEQFSKTKQNLGGSLKKLLSADAGLASDNSVTRGYLVDKIKNNKEALLLGLTYLERWYNFNYGQVNVKDLVMYHPDFFGKGNTSPLDTLIELGKSGFNNLLAKNNVDTYGISLASHHGTTDLFSALETYRKVFLPNTSNNDWFKKQTKAFIVEEKSTIAEVKAKQKQAGTKYSIGVYDRITSNTWKYRNMVLPLLTLPERSVFVISTLSSLGFGAYDRYRNSEHKAGKDLNNFVEENASETAKRQRDHYDYWYRILDNEGREKLYRTILLYDAYKFGDDTTSGKATVEAKFDSSNPAMKNFFGPVGNKVVHNHHGAYATGDGVYYMSYRMLDKDGAITYTHEMTHDSDQDIYLGGYGRRSGLGPEFFAKGLLQAPDHPYDATITITINSILKHSKSDSLEGSRLQVLDPTERFQNSADLQNYVHNMFDLIYMLEYLEGQSIVKKLNVSQKMEALRKIENQYLTDPADGNEVYATNVVKELTEEEARNLNSFDSLIDNNILSAREYKAGTYERNGYFTIKLFAPIFSALSSEKGTPGDLMGRRIAYELLAAKGFKDGMVPYISNQYEGIAKQNGQTINLYGKKQGLVTDKLVLEKIFSGKYPSWTAFKKAMYQERIAQFDHLTKVIFKDPTKPWPSYGTKTINNVDELQALMDQAVLKDAEGPRWSNYNPEIDSAVHKLKRAIFKAYLDQTNDFRSSIFENKK

SEQ ID NO: 3830 - protein, 75 aa, Streptococcus pneumoniae
KGDEEQTKIQAGIPTDNEVSYALIYQQETLPATGSSTSALTALGLLAVGSLVLLVRNSFLLPLKSHHLMAFFYIG

SEQ ID NO: 3831 - protein, 283 aa, Streptococcus pneumoniae
MATIQWFPGHMSKARRQVQENLKFVDFVTILVDARLPLSSQNPMLTKIVGDKPKLLILNKADLADPAMTKEWRQYFESQGIQTLAINSKEQVTVKVVTDAAKKLMADKIARQKERGIQIETLRTMIIGIPNAGKSTLMNRLAGKKIAVVGNKPGVTKGQQWLKTNKDLEILDTPGILWPKFEDETVALKLALTGAIKDQLLPMDEVTIFGINYFKEHYPEKLAERFKQMKIEEEPSVIIMDMTRALGFRDDYDRFYSLFVKEVRDGKLGNYTLDTLEDLDGND

SEQ ID NO: 3832 - protein, 259 aa, Streptococcus pneumoniae
MATIKEIKELLVTVKELESPIFLDLEKDNRSGVQKEISKRKRAIQAELDENLRLESMLSYEKELYKQGLTLIAGIDEVGRGPLAGPVVAAAVILPKNCKIKGLNDSKKIPKKKHLEIFQAVQDQALSIGIGIIDNQVIDQVNIYEATKLAMQEAISQLSPQPEHLLIDAMKLDLPISQTSIIKGDANSLSIAAASIVAKVTRDELMKEYDQQFPGYDFATNAGYGTAKHLEGLTKLGVTPIHRTSFEPVKSLVLGKKES

SEQ ID NO: 3833 - protein, 516 aa, Streptococcus pneumoniae
MEEQSEIVRSKKEFAFASSTILSQVGRGIIVGLIVGIIVGSFRFLIEKGFHLIQGVYQDQGYLVRNLFVLVLFYILICWLSAKLTRSEKDIKGSGIPQVEAELKGLMSLNWWGILWKKYVLGILAIASGLMLGREGPSIQLGAVGGKGIAKWLKSSPVEERSLIASGAAAGLAAAFNAPIAALLFVVEEVYHHFSRFFWVSTLAASIVANFVSLLMFGLTPVLDMPDNIPPMTLDQYWIYLVMGIFLGFSGFLYEKAVLNVGRVYDLIGQKIHLDRAYYPILAFILIIPVGIFLPQILGGGNQLVLSLTEQNFSFQVLLAYFLIRFIWSMISYGSGLPGGIFLPILALGSLLGALVGVICVNLGLVSQEQFPIFVILGMSGYFGSISKAPLTAMILVTEMVGDIRNLMPLGLVTLVSYIIMDLLKGTPVYEAMLEKMLPEEVSSEGEVTLIEIPVSDKIAGKQVHELNLPHNVLITTQVHNGKSQTVNGSTRMYLGDMIHLVIPKSEIGKVKDLLL

SEQ ID NO: 3834 - protein, 356 aa, Streptococcus pneumoniae
MKREILLERIDKLKQLMPWYVLEYYQSKLAVPYSFTTLYEYLKEYDRFFSWVLESGISNADKISDIPLSVLENMSKKDMESFILYLRERPLLNANTTKQGVSQTTINRTLSALSSLYKYLTEEVENDQGEPYFYRNVMKKVSTKKKKETLAARAENIKQKLFLGDETEGFLTYIDQEHPQQLSNRALSSFNKNKERDLAIIALLLASGVRLSEAVNLDLRDLNLKMMVINVTRKGGKRDSVNVAAFAKPYLENYLAIRNQRYKTEKTDTALFLTLYRGVPNRIDASSVEKMVAKYSEDFKVRVTPHKLRHTLATRLYDATKSQVLVSHQLGHASTQVTDLYTHIVNDEQKNALDSL

SEQ ID NO: 3835 - protein, 329 aa, Streptococcus pneumoniae
MKYIINHSNDTAFNIALEEYAFKHLLDEDQIFLLWINKPSIIVGRHQNTIEEINRDYVRENGIEVVRRISGGGAVYHDLNNLNYTIISKEDENKAFDFKSFSTPVINTLAQLGVKAEFTGRNDLEIDGKKFCGNAQAYINGRIMHHGCLLFDVDLSVLANALKVSKDKFESKGVKSVRARVTNIINELPKKITVEKFRDLLLEYMKKEYPEMTEYVFSEEELAEINHIKDTKFGTWDWNYGKSPEFNVRRGTKFTSGKVEVFANVTESKIQDIKIYGDFFGIEDVAAVEDVLRGVKYEREDVLKALKTIDITRYFAGISREEIAEAVVG

SEQ ID NO: 3836 - protein, 567 aa, Streptococcus pneumoniae
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGNSDDAFDIVVIGGGPAGYVAAIKAAQLGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDAEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVAAENALKGNHAVAKLNLTPAAIYTLPEVAAVGLTEEQAREKYDVAIGKFNFAANGRAIASDAAQGFVKVIADKKCGEILGVHIIGPAAAELINEASSIIEMEITVEEMLKTIHGHPTYSEVMYEAFADVLGMAIHSPKKK

SEQ ID NO: 3837 - protein, 375 aa, Streptococcus pneumoniae
LASSKPSSISYFSVAFDALCIINRIGEVMADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGEIERIPMTPMRKVIAQRMVESYLTAPTFTLNYEVDMTEMLALRKRVLEPIMEATGKKTTVTDLLSLAVVKSLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 3838 - protein, 330 aa, Streptococcus pneumoniae
METKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVVLVNDAHKTSGYIGEISAIISESEAFDYLDAPIRRCAGEDVPMPYAQNLENAMIPTVESIKDAIRKTYNKE

SEQ ID NO: 3839 - protein, 145 aa, Streptococcus pneumoniae
VLGGRANSVTSCTTNSHWNLTFTTKHVTCFSSLVDDIVHGNNREVHEGHIDDWTKSCHGCSCCCSRDGSFRNRTVTDTFWTKFFKHSNRSTEVSSEDTDVFSHQEHIFIATHFLRHSKDNGVTEGHCFCFHFISFSLVCVNIFKG

SEQ ID NO: 3840 - protein, 103 aa, Streptococcus pneumoniae
LTILSMAITEKSMKVISTIGRSPVMAAPAAAPEMAASEIGQSRTRSGPNSSSIPTEVPKSPPKTPTSSPIKNTFSSRRISSDIARIMVSRKDIVFVSILSLSP

SEQ ID NO: 3841 - protein, 322 aa, Streptococcus pneumoniae
MSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEEIQAQVKEAVEASVKFAEESPFPSLESAFEDIYAD

SEQ ID NO: 3842 - protein, 453 aa, Streptococcus pneumoniae
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPTILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRIPLNMDKIKEGVRLGLPIGGTVFAEVAVFSVVGLIMAKFSSLIIASHQSAMNFSSLMYAFPMSISSAMAIVVSYEVGAKRFDDAKTYIGLGRWTALIFAAFTLTFLYIFRGNVASLYGNDPKFIDLTARFLTYSLFFQLADTFAAPLQGILRGYKDTVIPFYLGLLGYWGVAIPVATLFDSLTDFGAYSYWIGLIISLIVSGALYRWRLTVIMKRFESLAKSKR

SEQ ID NO: 3843 - protein, 86 aa, Streptococcus pneumoniae
MNYFRKRRERQAKSNSGIYCPAANRSKIQYETKEKADHAVQYDNGGLVRSYYCRTCACWHTTSKSNKPPLSLKNYGLKLFGLDKSE

SEQ ID NO: 3844 - protein, 422 aa, Streptococcus pneumoniae
MLLIKNGRVMDPKSGLDQVCDVLVQDGKIIKIAPEITEEGAETIDATGLVVAPGLVDIHVHFREPGQTHKEDIHTGALAAAAGGFTTVVMMANTSPTISDVETLQAVLQSAAKEKINVKTVATITKNFNGKNLTDFKALLEAGAVGFSDDGIPLESSKIVKEAMEEAKKLNTFISLHEEDPGLNGVLGFNENIAREHFHICGATGVAEYAMMARDVMIAYATKAHVHIQHLSKEESVKVVEFAQGLGAEVTAEVAPQHFSKTEALLLTQGSNAKMNPPLRLESDRRAVIEGLKSGVITVIATDHAPHHVDEKNVEDITKAPSGMTGLETSLSLGLTYLVEAGELSLMELLEKMTYNPAKLYNFEAGYLAENGPADITIFDAKADRLVDSHFASKAANSPFIGETLKGQVKYTICKGQIVYQA

SEQ ID NO: 3845 - protein, 154 aa, Streptococcus pneumoniae
MPQLATICYIDNGKELLMLHRNKKPNDVHEGKWIGVGGKLERGETPQECAAREILEETGLKAKPVLKGVITFPEFTPDLDWYTYVFKVTEFEGDLIDCNEGMLEWVPYDEVLSKPTWEGDHTFVEWLLEDKPFFSAKFVYDGDKLLDTQVDFYE

SEQ ID NO: 3846 - protein, 221 aa, Streptococcus pneumoniae
MKESAMEHSSWHALIKAQLPEGYFGKINQFMEQVYSQGIIYPPKEKVFQALLTTLLEEVKVVILGQDPYHGPGQAQGLSFSVPDSIPAPPSLQNILKELSDDIGVKKSHDLTAWAEQGVLLLNACLTVPAGQANGHAGQIWEPFTDAVIQVVNHLDRPVVFVLWGAYARKKKALVTNPHHLIIESAHPSPLSVYRGFWGSKPFSKANAFLKETGQEPIALA

SEQ ID NO: 3847 - protein, 200 aa, Streptococcus pneumoniae
MSEVDFNEAVNYEFTSDTCQLANSIYQSLFKFFDKKNFSGDLIFTWKSPSLVKEGDYIGKRDSQVDNLRVIGNIFPNYLTNRKYSLNMNRNGCMGDFPHDFFDIYLDHVAKYAYEQKVNNIKEYYPLKRAILHQENALYFRFFSNFDDFLEKNYLKTIWQVSKETPFSEMDFNMFKNISEKIIFERGSKMLNDLKSNYKK

SEQ ID NO: 3848 - protein, 237 aa, Streptococcus pneumoniae
LFYKFLLFDLDHTLLDFDAAENVALTQLLKEEGVADIQAYKDYYVPMNKALWKDLELKKISKQELVNTRFSRLFAHFGQEKDGSFLAQRYQFYLAQQGQTLSGAHDLLDSLIERDYNLYAATNGITAIQTGRLAQSGLAPYFNQVFISEQLQTQKPDALFYEKIGQQIAGFSKEKTLMIGDSLTADIQGGNNAGIDTIWYNPHHLENHTQAQPTYEVYSYQDLLDCLDKNILEKITF

SEQ ID NO: 3849 - protein, 75 aa, Streptococcus pneumoniae
LMESIGLVIVSHSKHIAEGVVELISKVAKDVPITYVGGTEGGGIGTSFDQVDRVVSENPADTLLAFFDLGSAIKC

SEQ ID NO: 3850 - protein, 851 aa, Streptococcus pneumoniae
VHQISLRKKERMKINKKYLAGSVATLVLSVCAYELGLHQAQTVKENNRVSYIDGKQATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 3851 - protein, 829 aa, Streptococcus pneumoniae
LQLEISNRKRVSMKINKKYLVGSAAALILSVCSYELGLYQARTVKENNRVSYIDGKQATQKTENLTPDEVSKREGINAEQIVIKITDQGYVTSHGDHYHYYNGKVPYDAIFSEELLMKDPNYKLKDEDIVNEVKGGYVIKVDGKYYVYLKDAAHADNVRTKEEINRQKQEHSQHREGGTPRNDGAVAFARSQGRYTTDDGYIFNASDIIEDTGDAYIVPHGDHYHYIPKNELSASELAAAEAFLSGRGNLSNSRTYRRQNSDNTSRTNWVPSVSNPGTTNTNTSNNSNTNSQASQSNEDVDSLLKQLYALPLSKRHVESDGLVFDPAQITSRTARGVAVPHGDHYHFIPYSQMSELEERIARIIPLRYRSNHWVPDSRLEQPSLQPTPEPSPGPQPAPNLKIDSNSSLVSQLVRKVGEGYVFEEKGISRYVFAKDLPSETVKNLESKLSKQESVSHTLTAKKENVAPRDQEFYDKAYNLLTEAHKALFENKGRNSDFQALDKLLERLNDESTNKEKLVDDLLAFLAPITHPERLGKPNSQIEYTEDEVRIAQLADKYTTSDGYIFDEHDIISDEGDAYVTPHMGHSHWIGKDSLSDKEKVAAQAYTKEKGILPPSPDADVKANPTGDSAAAIYNRVKGEKRIPLVRLPYMVEHTVEVKNGNLIIPHKDHYHNIKFAWFDDHTYKAPNGYTLEDLFATIKYYVEHPDERPHSNDGWGNASEHVLGKKDHSEDPNKNFRADEEPVEETPAEPEVPQVETEKVEAQLKEAEVLLAKVTDSSLKANATETLAGLRNNLTLQIMDNNSIMAEAEKLLALLKGSNPSLLCKVKLI

SEQ ID NO: 3852 - protein, 410 aa, Streptococcus pneumoniae
MTEMLKGIAASDGVAVAKAYLLVQPDLSFETITVEDTNAEEARLDAALQASQDELSVIREKAVGTLGEEAAQVFDAHLMVLADPEMISQIKETIRAKKVNAEAGLKEVTDMFITIFEGMEDNPYMQERAADIRDVTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKEHPYFDMPHEMNPFLGFRALRISISETGDAMFRTQIRAPSSCVCSRSIAYHVPNGCALERIPCSESSL

SEQ ID NO: 3853 - protein, 45 aa, Streptococcus pneumoniae
SAPWPTPRLITPIIDLRLTDLPLYSRVISEANLLAVCTNNVAGRA

SEQ ID NO: 3854 - protein, 87 aa, Streptococcus pneumoniae
MASKDFHVVAETGIHARPATLLVQTASKFASDITLEYKGKSVNLKSIMGVMSLGVGQGADVTISAEGADADDAIAAISETMEKEGLA

SEQ ID NO: 3855 - protein, 72 aa, Streptococcus pneumoniae
MVTVYSKNNCVQCKMTKRFLDSNNVSYREINLDEQPEYVDQVKELGFSAAPVIQTPTEVFSGFQPGKLKQLA

SEQ ID NO: 3856 - protein, 719 aa, Streptococcus pneumoniae
MGLKHLEDVTYFRLNNEINRPVNGQIMLHKDKEALDAFFKENVVPNTMVFDSIKDKINYLIEHNYIETAFIKKYRPEFLEELAQFIKDQNFQFKSFMAAYKFYNQYALKTNDGEYYLENMEDRVFFNALYFADGNEAVAIDIANEIIHQRYQPATPSFLNAGRARRGELVSCFLIQVTDDMNSIGRSINSALQLSRIGGGVGITLSNLREAGAPIKGYEGAASGVVPVMKLFEDSFSYSNQLGQRQGAGVVYLNVFHPDIIAFLSTKKENADEKVRVKTLSLGVVVPDKFYELARKNEEMYLFSPYSVEKEYGVPFNYIDITEKYDELVANPNIRKTKIKARDLETEISKLQQESGYPYVVNIDTANRANPVDGKIIMSNLCSEILQVQEPSLINDAQEFLQMGTDVSCNLGSTNVVNMMTSPDFGRSIRAMVRALTFVTDSSHIVAVPTIDHGNSQAHTFGLGAMGLHSYLAQQLIEYGSPESVEFTSIYFMLMNYWTLVESNNIARERGITFHNFEKSDYANGSYFDKYVTGEFVPTSDRVKELFKNVFIPGVADWAELRDKVQEDGLYHQNRLAVAPNGSISYINDVSASIHPITQRIEERQEKKIGKIYYPAAGLSTETIPYYTSAYDMDMRKVIDVYAAATEHVDQGLSLTLFMRSDIPKGLYEWKRENKQTTRDLSILRNYAFNKGIKSIYYVRTFTDDGGEVGANQCESCVI

SEQ ID NO: 3857 - protein, 62 aa, Streptococcus pneumoniae
FVDDIFDGIPVNGFVVSFHLKSLSVFSIANSQLFLLYHNSIGVSHKKSEARLLKCYINYVMT

SEQ ID NO: 3858 - protein, 320 aa, Streptococcus pneumoniae
METYYKAINWNAIEDVIDKSTWEKLTEQFWLDTRIPLSNDLDDWRKLSNKEKDLVGKVFGGLTLLDTMQSETGVQALRADIRTPHEEAVFNNIQFMESVHAKSYSSIFSTLNTKAEIEEIFEWTNTNPYLQKKAEIVNEIYLNGSPLEKKVASVFLETFLFYSGFFTPLYYLGNNKLANVAEIIKLIIRDESVHGTYIGYKFQLGFNELPEEEQEKLKEWMYDLLYTLYENEEGYTESLYDGVGWTEEVKTFLRYNANKALMNMGQDPLFPDSAEDVNPIVMNGISTGTSNHDFFSQVGNGYLLGEVEAMQDDDYNYGLD

SEQ ID NO: 3859 - protein, 253 aa, Streptococcus pneumoniae
MLKQEKLTKILEIVNSKGTITVKQIMDEIAVSDMTARRYLQELADKDLLIRVHGGAEKLRTNSLLTNERSNIEKQALQTAEKQEIAHFAGSLVEERETIFIGPGTTLEFFARELPIDNIRVVTNSLPVFLILSERKLTDLILIGGNYRDITGAFVGTLTLQNLSNLQFSKAFVSCNGIQNGALATFSEEEGEAQRIALNNSNKKYLLADHSKFNKFDFYTFYNISNLDTIVSDSKLSDSILFKLSKHIKVIKP

SEQ ID NO: 3860 - protein, 83 aa, Streptococcus pneumoniae
MFKDFIQSIYEKVYIINFEKCSQIPCLTSEELKSLGKWYVSTGKEWICHSDADLEEFKNLFLNFINPEEWDTISFDSDFMPFQ

SEQ ID NO: 3861 - protein, 471 aa, Streptococcus pneumoniae
VKKMTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKEKGYKGEIGVVHALPTKYPLDPENPADVRAAELEDIIHNKFILDATYLGRYSAETMEGVNHILLVNGGSLDLREEDFTALEAAKDLNDFLGINYYMSDWMEAFDGETEIIHNGKGEKGSSKYQIKGVGRRVAPDYVPRTDWDWIIYPQGLYDQIMRVKKDYPNYKKIYITENGLGYKDEFVDNTVYDDGRIDYVKQHLEILSDAIADGANVKGYFIWSLMDVFSWSNGYEKRYGLFYVDFETQERYPKKSAHWYKKVAETQIID

SEQ ID NO: 3862 - protein, 564 aa, Streptococcus pneumoniae
MDKLIIFIEKGKPFFEKLSRNIYLRAIKDGFISSMPAVLFSSIFILIAAVPNIFGFKWSDEQLAFILKPYNYSMGILALLVAGTTAKSLTDSVNTRSMEKTNQINYMSTFLAAVVGLLILAADPIEGGFANGLLGTRGLLTAFLAAFITVNIYKVCIKNNVTIRLPEEVPPNIAQVFKDVIPFALSVLSIYGLDLIVRNIFGTNVAESVGKILAPLFSATDGYIGLAIVFGAYAFFWFVGIHGPSVVEPLIVAISYANIEANVQLVQAGMHADKILNPVTQTFVVTMGGTGATLVVPFMFMWLCKSKRNRIVGRASVVPTFFGVNEPILFGAPIVLNPIFFIPFVTAPIINVWIMKFFVDVLQMNSFSIILPWTTPAPIGIVMGTALAPLSFVLAITLIIIDTLIYYPFVKVYDHQILEEERKGNSSSELKEKVAANFNTVKADAILEKAGVDAAQNTITEETNVLVLCAGGGTSGLLANALNKAAAEYNVPVKATAGGYGAHREMLPEFDLVILAPQVASNFEDMKAETDKLGIKLAKTEGAQYIKLTRDGKGALAFVQEQFD

SEQ ID NO: 3863 - protein, 105 aa, Streptococcus pneumoniae
MNREEVTLLGFEIVAYAGDARSKLLEALKAAEAGDFEKADALVEEAGSCIAEAHHAQTSLLTKEASGEDLAYSVTMMHGQDHLMTTILLKDLMHHLIELYKRGVK

SEQ ID NO: 3864 - protein, 278 aa, Streptococcus pneumoniae
MYRILNPMNHNVSLVRNDKGEEVIVIGKGIAFGKKKGDLIAENQVEKIFRMKTEESRENFMALLKDVPLDFITVTYEIIDKLSKKYHYPIQEYLYVTLTDHIYCSYQALTQGRYKDSNLPDISAKYPVAFQIANEAFEIYRQKLADHFPEDEIIRIAYHFINAEGENEVELVESIDKRKEILRNVEEVLTDYAIQRTKKNNHFYDRFMIHLNYFLDYLDRSRDDNQSLLDMEDHIKQSYPKAFEIGSKIYDVITQHTGLDLYKSERVYLVLHIQRLLS

SEQ ID NO: 3865 - protein, 269 aa, Streptococcus pneumoniae
MELTKYPSSMLLDPEYGLPATKALDEKAGLLLAYEKTGYDTTSTKRLPDCLDVWSAKRIKEEGADAVKFLLYYDVDSSDELNQEKQAYIERIGSECVAEDIPFFLEILAYDEKIADAGSVEYAKVKPHKVIGAMKVFSDPRFNIDVLKVEVPVNIKYVEGFAEGEVVYTREEAAAFFKAQDEATNLPYIYLSAGVSAKLFQDTLVFAHESGANFNGVLCGRATWAGSVEAYIKDGEAAAREWLRTTGFENIDELNKVLQTTATSWKERV

SEQ ID NO: 3866 - protein, 272 aa, Streptococcus pneumoniae
GTFNVTRVLSEFGDSVLATGLVGGKLGEFLVEHIDDQVKKDFFSIQGETRNCIAILHGDNQTEVLEKGPEVLEQEGQDFLEHFKKLLESVEVVAISGSLPAGLPVDYYASLVELANQAGKLVVLDCSGAALQAVLESPHKPTVIKPNNEELSQLLGREVSEDLEELKEVLQESLFTGIEWIIVSLGANGTFAKHGDTFYKVDIPRIQVVNPVGSGDSTVAGISSGLLHKESDAGLLIKANVLGMLNAQEKMTGHVNMANYQALYDQLIVKEV

SEQ ID NO: 3867 - protein, 162 aa, Streptococcus pneumoniae
MDGFIVTVKIIGHLLVVVFSAIPFFKEFCKEVCVCLLSIVTFKVFNFRNQFLVFFRWFVFSMNESFDDITHKQFTSNLTTKADNVSVQLLFSIKGCCHITNQGRTNTWNFIYSVVDTNTSTTDTYPKISLAASYSFPYFFTKDWVVSPCMVICTKVNDFISF

SEQ ID NO: 3868 - protein, 171 aa, Streptococcus pneumoniae
MRIAIGCDHIVTDEKMAVSEFLKSKGYEVIDFGTYDHTRTHYPIFGKKVGEAVTSGQADLGVCICGTGVGINNAVNKVPGVRSALVRDMTTALYAKEQLNANVIGFGGKITGELLMCDIIEAFIHAEYKPSEENKKLIAKIEHLESHNAQQTDANFFTEFLEKWDRGEYHD

SEQ ID NO: 3869 - protein, 141 aa, Streptococcus pneumoniae
MSIVIGADAAGLRLKEVVKDFLEKENFHLVDVTAEGQDFVDVTLAVAAEVNKEEQNLGIVIDAYGAGPFMVATKIKGMVAAEVSDERSAYMTRGHNNSRMITMGAQLVGDELAKNIAKGFVNGKYDGGRHQIRVDMLNKMG

SEQ ID NO: 3870 - protein, 96 aa, Streptococcus pneumoniae
TYCILLFIFSMLDSSSVLAVFKKQSISPHKHNILLLFEEVNSLCLFLLFIFYFFIKLLSQTLILQPDWLLRDKHSSYLLNDLLLQGMLTSQTMVQR

SEQ ID NO: 3871 - protein, 158 aa, Streptococcus pneumoniae
MPYFIGGHPGFNCPLLDDGVYEDYYLESEKEETCSVPRPFPETGMLDFQDRSPWLEGQKEIDLSYDLFSTDAVTLDELQSRTIALRSLKHDKGLKVHFAEFPNLIIWSTLNKGPFITFEPWSGLSTFLEEGDHLEDKKNVCLLEANQVEELGFEIEVL

SEQ ID NO: 3872 - protein, 206 aa, Streptococcus pneumoniae
VREYRTYEQIAADFGIHESNFIRRSQWVEVTLVQSGVTCQALLSALRTRYDMMRRKYKSIAIKKELANDSGKKKCHAMKAQAIVTSQGRIVSLDITVNYCHDMKLFKMSCRNIGQAGKILADSGYQGLMKIYPQVQTPRKSSKLKSLIAEDKAYNHALSKERSKVENIFAKVKTFKMFSTTYRNHRKRFGLRMNLSAGIINHELGF

SEQ ID NO: 3873 - protein, 106 aa, Streptococcus pneumoniae
LTILYFLRNKIWYSSSMNDEASKQLTDARFKRLVGVQRTTFEEMLAVLKTAYQLKHAKGGRKPKLSLEDLLMATLHMCENIELMNKLRLILVFTKATLSVGANGLK

SEQ ID NO: 3874 - protein, 100 aa, Streptococcus pneumoniae
MIKILAACGAGVNSSHQIKSALEEELSNRGYDVHCDAVMVKDVNEDLMKGYDIFTPIAATDLGFEPGIPVIEAGPILFCIPAMSVPVFDNIILPAKQNMV

SEQ ID NO: 3875 - protein, 147 aa, Streptococcus pneumoniae
VFCLEADNQEQLFDQVASLLEEREIVTPTYREALITREKSFPTGLDMEFLGKDLPNVAIPHTDIVHNLAEKVVVVRLEKPVTFHNMIAPGKEVEVSLLFFIINNSSSSQTNILAQLMDFFTGNGHLEDLSKISEPEKLYAYIAEATA

SEQ ID NO: 3876 - protein, 430 aa, Streptococcus pneumoniae
MKSDKTIIRKIHMEQLHFITKLLDIKDPNIKILDIINMDTHKEIIAKLDYEAPSCPDCGSLMKKYDFQKPSKIPYLETTGMPSRILLRKRRFKCYHCSKMMVAETPLVKKNHQIPRIINQKIAQKLIEKISMTDIAHQLAISTSTVIRKLNDFHFEHDFSRLPKIMSWDEYAFTKGKMSFIAQDFDNLNIITVLEGRTQAVIRNHFLRYDRAVRCQVKIITMDMFSPYYDLAKQLFPCAKIVLDRFHIIQHLSRAMSRFRVQIMNQFERKSHEYKAIKRYWKLIQQDSRKLSDKRFYRPTFRMHLTNKEILDKILSYSEDLKHHYQIYQLLLFHFQNKDPEKFFGLIEDTLKQVHPIFQTVFKTFLKNKEKIVNALQLPYSNAKLEATNNLIKLIKRNAFGFRNFENFKKRIFIALNIKKERTNFVLSRA

SEQ ID NO: 3877 - protein, 62 aa, Streptococcus pneumoniae
LAQISILHFDFLSIDKHSHTVFNTLRKSLQTTLALSATSKQCFEQLAASFLVCSLIFIEYKV

SEQ ID NO: 3878 - protein, 416 aa, Streptococcus pneumoniae
MLSSKDIIKAHKVLNGVVVNTPLDYDHYLSEKYGAKIYLKKENAQRVRSFKIRGAYYAISQLSKEERERGVVCASAGNHAQGVAYTCNEMKIPATIFMPITTPQQKIGQVRFFGGDFVTIKLVGDTFDASAKAAQEFTVSENRTFIDPFDDAHVQAGQGTVAYEILEEARKESIDFDAVLVPVGGGGLIAGVSTYIKETSPEIEVIGVEANGARSMKAAFEAGGPVKLKEIDKFADGIAVQKVGQLTYEATRQHIKTLVGVDEGLISETLIDLYSKQGIVAEPAGAASIASLEVLAEYIKGKTICCIISGGNNDINRMPEMEERALIYDGIKHYFVVNFPQRPGALREFVNDILGPNDDITRFEYIKRASKGTGPVLIGIALADKHDYAGLIRRMEGFDPAYINLNGNETLYNMLV

SEQ ID NO: 3879 - protein, 118 aa, Streptococcus pneumoniae
MNITNLFSIKTGCDETDRQLQKLFFQLDLQLGELTDQLRKLDSNFVPRSQFVDTLDLNDVEYKEILNYFIFHRNDSEESLVEWLYDWISTNRYELPKEFSIRMAHKYHESVTEVFGDE

SEQ ID NO: 3880 - protein, 77 aa, Streptococcus pneumoniae
KTLTNIVGKSLGPKSAVRFGEALSYIEGPLRRINETIDGGLYQIEQMIASGLKESGLNDWTAKTLASAIRGILDVLI

SEQ ID NO: 3881 - protein, 88 aa, Streptococcus pneumoniae
LYNVITPSVIVLADQNKADWSYDENTVINIYDDANFEDGRLHMTFEQFFKLAQIAREEGLEIHSPFERAGATKSARYIAKWILRNKKH

SEQ ID NO: 3882 - protein, 340 aa, Streptococcus pneumoniae
MTVQMEYEKDVKVAALDGKKIAVIGYGSQGHAHAQNLRDSGRDVIIGVRPGKSFDKAKEDGFDTYTVAEATKLADVIMILAPDEIQQELYEAEIAPNLEAGNAVGFAHGFNIHFEFIKVPADVDVFMCAPKGPGHLVRRTYEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 3883 - protein, 166 aa, Streptococcus pneumoniae
MRCWGCSSMRRMLTAKLQNRSGVLNRFTGVLSRRQVNIESISVGATEDPNVSRITIIIDVASHDEVEQIIKQLNRQIDVIRIRDITDKPHLEREVILVKMSAPAEKRAEILAIIQPFRATVVDVAPSSITIQMTGNAEKSEALLRVIRPYGIRNIARTGATGFTRD

SEQ ID NO: 3884 - protein, 566 aa, Streptococcus pneumoniae
MEKISLESPKTGSDLVLETLRDLGVDTIFGYPGGAVLPFYDAIYNFKGIRHILGRHEQGCLHEAEGYAKSTGKLGVAVVTSGPGATNAITGIADAMSDSVPLLVFTGQVARAGIGKDAFQEADIVGITMPITKYNYQVRETADIPRIITEAVHIATTGRPGPVVIDLPKDISALETDFIYSPEVNLPSYQPTLEPNDMQIKKILKQLSKAKKPVLLAGGGISYAEAATELNEFAERYQIPVVTSLLGQGTIATSHPLFLGMGGMHGSFAANIAMTEADFMISIGSRFDDRLTGNPKTFAKNAKVAHIDIDPAEIGKIISADIPVVGDAKKALQMLLAEPTVHNNTEKWIEKVTKDKNRVRSYDKKERVVQPQAVIERIGELTNGDAIVVTDVGQHQMWTAQYYPYQNERQLVTSGGLGTMGFGIPAAIGAKIANPDKEVVLFVGDGGFQMTNQELAILNIYKVPIKVVMLNNHSLGMVRQWQESFYEGRTSESVFDTLPDFQLMAQAYGIKNYKFDNPETLAQDLEVITEDVPMLIEVDISRKEQVLPMVPAGKSNHEMLGVQFHA

SEQ ID NO: 3885 - protein, 678 aa, Streptococcus pneumoniae
MTVKINTKDGQIELTDEVIATVVGGAATEIFGVVGMASKNALKDNFQALLGKENYSKGVVVKAAEDGSIAVDVYTVLSYGTKISEVSKNIQERVAFSCGKPAWNYCSDCKCLHSKYQSCRRITVSKITTSLFQEMVQAASTRLNKQAEYVNSLNVFPVPDGDTGTNMGMTIENGAKEVADKPASTVGEVASILAKGLLMGARGNSGVITSQLFRGFSQAIKDKDELTGQDLALAFQSGVEVAYKAVMKPVEGTILTVSRGAAIGAKKKAEQTDDAVEVMRAALEGAKTALAKTPDMLPVLKEVGVVDSGGQGLVFIYEGFLSALTGEYIASEDFVATPANMSEMINVEHHKSVAGHVATEDITFGYCTEIMVALKQGPTYAKDFDYDEFRNYLDELGDSLLVVNDDEIVKVHVHTEDPGLVMQEGLKYGSLVKVKVDNMRNQHEAQVEKEATQVIKSAEEKEYALIAVVAGKGLADIFCSQGVDYVIEGGQTMNPSTEDFIKAVEQVNARNIIFLPNNKNIFMAAQSAAEVLEQPAVVVEARTLPQGMTSLLAFDPSKSIEENQERMTAALSDVVSGSVTTAVRDTTIDGLEIHENDNLGMVDGKILVSNPDMHQTLTETLKHMLDEDSEIVTFYVGEDGSEELANEIAQEIVEEFEDVEVEIHQGQQPVYPYLFSVE

SEQ ID NO: 3886 - protein, 62 aa, Streptococcus pneumoniae
MAKVCYFTGRKTVSGNNRSHAMNQTKRAVKPNLQKVTVLIDGKPKKVWASARALKSGKVERV

SEQ ID NO: 3887 - protein, 81 aa, Streptococcus pneumoniae
GTIICGFFRYFIPKYVSESRVLYLDSDIVVRKSIDELWDLDLTAIPLAAVRDDFYTHNFNSGVLLINDGMWRAENVTQDLI

SEQ ID NO: 3888 - protein, 65 aa, Streptococcus pneumoniae
VKEEKKAIVLGADNAYMDKVETTIKSLCVHHYNLKFYVFNDDLPREWFQLMEKRLETLNSEIVNV

SEQ ID NO: 3889 - protein, 514 aa, Streptococcus pneumoniae
MNIQEEIKKRRTFAIISHPDAGKTTITEQLLYFGGEIREAGTVKGKKTGTFAKSDWMDIEKQRGISVTSSVMQFDYDGKRVNILDTPGHEDFSEDTYRTLMAVDAAVMVVDSAKGIEAQTKKLFEVVKHRGIPVFTFMNKLDRDGREPLELLQELEEILGIASYPMNWPIGMGKAFEGLYDLYNQRLELYKGDERFASLEDGDKLFGSNPFYEQVKDDIELLNEAGNEFSEEAILAGELTPVFFGSALTNFGVQTFLEIFLKFAPEPHGHKKTDGDIVDPYDKDFSGFVFKIQANMDPRHRDRIAFVRIVSGEFERGMSVNLPRTGKGAKLSNVTQFMAESRENVTNAVAGDIIGVYDTGTYQVGDTLTVGKNKFEFEPLPTFTPEIFMKVSAKNVMKQKSFHKGIEQLVQEGAVQLYKNYQTGEYMLGAVGQLQFEVFKHRMEGEYNAEVVMSPMGKKTVRWIKPEDLDERMSSSRNILAKDRFDQPVFLFENDFALRWFADKYPDVELEEKM

SEQ ID NO: 3890 - protein, 100 aa, Streptococcus pneumoniae
MKITQEEVTHVANLSKLRFSEEETAAFATTLSKIVDMVELLGEVDTTGVAPTTTMADRKTVLRPDVAEEGTNRDRLFKNVPEKDNYYIRVPAILDDGGDA

SEQ ID NO: 3891 - protein, 488 aa, Streptococcus pneumoniae
MTFNNKTIEELHNLLVSKEISATELTQATLENIKSREEALNSFVTIAEEQALVQAKAIDEAGIDADNVLSGIPLAVKDNISTDGILTTAASKMLYNYEPIFDATAVANAKTKGMIVVGKTNMDEFAMGGSGETSYYGATKNAWDHSKVPGGSSSGSAAAVASGQVRLSLGSDTGGSIRQPAAFNGIVGLKPTYGTVSRFGLIAFGSSLDQIGSFAPTVKENALLLNAIASEDAKDSTSAPVRIADFTSKIGQDIKGMKIALPKEYLGEGINPEVKETILNAAKHFEKLGAIVEEVSLPHSKYGVAVYYIIASSEASSNLQRFDGIRYGYRAEDATNLDEIYVNSRSQGFGEEVKRRIMLGTFSLSSGYYDAYYKKAGQVRTLIIQDFEKVFADYDLILGPTAPSVAYDLDSLNHDPVAMYLADLLTIPVNLAGLPGISIPAGFSQGLPVGLQLIGPKYSEETIYQAAAAFEATTDYHKQQPVIFGGDN

SEQ ID NO: 3892 - protein, 212 aa, Streptococcus pneumoniae
MNFETVIGLEVHVELNTNSKIFSPTSAHFGNDQNANTNVIDWSFPGVLPVLNKGVVDAGIKAALALNMDIHKKMHFDRKNYFYPDNPKAYQISQFDEPIGYNGWIEVELEDGTTKKIGIERAHLEEDAGKNTHGTDGYSYVDLNRQGVPLIEIVSEADMRSPEEAYAYLTALKEVIQYAGISDVKMEEGSMRVDANISLVLMVKRNSVPRLN

SEQ ID NO: 3893 - protein, 268 aa, Streptococcus pneumoniae
LKNLNSFSNVRKGLEYEVQRQAEILRSGGQIRQETRRYDEANKTTILMRVKEGAADYRYFPEPDLPLFEISDEWIEEMRTELPEFPKERRARYVSDLGLSDYDASQLTANKVTSDFFEKAVALGGDAKQVSNWLQGEVAQFLNAEGKTLEQIELTPENLVEMITIIEDGTISSKIAKKVFVHLAKNGGGAREYVEKAGMVQISDPAILIPIIHQVFADNEAAVADFKSGKRNADKAFTGFLMKATKGQANPQVALKLLAQELAKLKEN

SEQ ID NO: 3894 - protein, 347 aa, Streptococcus pneumoniae
MATMKAARWHAAKDVRIQEIEVPEVLPHQVKVAVKFTGICGTDLHEFLDGPIFIPTDEHVYSGQKAPVTLGHEFSGEIIEVGSDVTRVKVGDRVAVEPILAKNNLVGDYNLDPNLNFVGLAADGGFAKYCVLDGDLVHVIPDSLSYEQAALTEPAAVAVYAVRQSSLKAGDTAVVFGLGPIGLLIVEALRAAGASKIYAVELSPERQAKAEELGAIVVRPEEGETAVEAIHRLTNGGVDVSYEVTGVPVVLGQALAAVHKAGECMVVSIWEREANINPNEFAIQEKTLKGIIAYRHIFPKVLELMEQGYFSAEKLVTKKIKLENIVEEGFIELTQDKSQIKILVEPE

SEQ ID NO: 3895 - protein, 66 aa, Streptococcus pneumoniae
YSSKISSNHVSVTLPYIWLLTSSVLSTTSKQCFEQPAASFLVCSLISIEYEKKYSGYSLTLTTPPD

SEQ ID NO: 3896 - protein, 186 aa, Streptococcus pneumoniae
MIEASKLKAGMTFETADGKLIRVLEASHHKPGKGNTIMRMKLRDVRTGSTFDTSYRPEEKFEQAIIETVPAQYLYKMDDTAYFMNTETYDQYEIPVVNVENELLYILENSDVKIQFYGTEVIGVTVPTTVELTVAETQPSIKGATVTGSGKPATMETGLVVNVPDFIEAGQKLVINTAEGTYVSRA

SEQ ID NO: 3897 - protein, 129 aa, Streptococcus pneumoniae
MGIEEQLGEIVIAPRVLEKIIAIATAKVEGVHSFSNRSVSDTLSKLSLGRGIYLKNVDEELTADIYLYLEYGVKVPKVAVAIQKAVKDAVRNMADVELAAINIHVAGIVPDKTPKPELKDLFDEDFLND

SEQ ID NO: 3898 - protein, 140 aa, Streptococcus pneumoniae
MTSPLLESRRQLRKCAFQALMSLEFGTDVETACRFAYTHDREYTDVQLPAFLIDLVSGVQAKKEELDKQITQHLKAGWTIERLTLVERNLLRLGVFEITSFDTPQLVAVNEAIELAKDFSDQKSARFINGLLSQFVTEEQ

SEQ ID NO: 3899 - protein, 189 aa, Streptococcus pneumoniae; identical to SEQ ID NO: 2665

SEQ ID NO: 3900 - protein, 260 aa, Streptococcus pneumoniae
MEQLHFITKLLDIKDPNIQILDIINKDTHKEIIAKLDYEAPSCPECGSQMKKYYFQKPSKIPYLETTGMPTRILLRKRRFKCYHCSKIMVAETSIVKKNHQIPRIINQKIAQKLIEKISMTDIAHQLSISTSTVIRKLNDFHFKHDFSCLSEIMSWDEYAFTKGKMSFIAQDFNKLNIITVLEGRTQAIIRNHFLRYDRVVRCRVKIITMDMFSPYYDLAKQLRFQISRLRLKQSPRLFHSRMLKSCWIAFTLYNILAVL

SEQ ID NO: 3901 - protein, 277 aa, Streptococcus pneumoniae
LEVRLPNRVIFQKSTMRNTKKLRQFGIFLLIILLSTYLPQTIRLYVTIILGLGADVYSLILTMGLVGSFLLLIWRLKKKKMLFIFEKKSWNWSFVFYLFATYVVYQILGNFWARYAHLINHRNIHDEYFTVVLSNGQPTFLSTILSFVLPVIIDPVFEETLDRGYFMNTFFPKSKYYLDVILSGLIFGLSHLILSHRDPISLLYYSLIGFFFALVYRSTDNLRLTILCHSFLTFSIMQNLSGFLFTIISIIIFLDSGRQRKKCLISIKHFFFLLLAL

SEQ ID NO: 3902 - protein, 83 aa, Streptococcus pneumoniae
LTFLIELFTSYFKSLYFKKVLAMTGTETFTVISTEDLEQTSGGLAVWEDGYSRWLYYREFAPYMRQGALNSYIDAWKYGFRTG

SEQ ID NO: 3903 - protein, 255 aa, Streptococcus pneumoniae
MNIAKIVREAREQSRLTTLDFATGIFDEFIQLHGDRSFRDDGAVVGGIGWLGDQAVTVVGIQKGKSLQDNLKRNFGQPHPEGYRKALRLMKQAEKFGRPVVTFINTAGAYPGVGAEERGQGEAIARNLMEMSDLKVPIIAIIIGEGGSGGALALAVADRVWMLENSIYAILSPEGFASILWKDGTRAMEAAELMKITSHELLEMDVVDKVISEVGLSSKELIKSVKKELQTELARLSQKPLEELLEERYQRFRKY

SEQ ID NO: 3904 - protein, 288 aa, Streptococcus pneumoniae
MALFSKKDKYIRINPNRSVREKPQAKPEVPDELFSQCPGCKHTIYQKDLGSERICPHCSYTFRISAQERLALTIDMGTFKELFTGIESKDPLHFPGYQKKLASMREKTGLHEAVVTGTALIKGQTVALGIMDSNFIMASMGTVVGEKITRLFEYATVEKLPVVLFTASGGARMQEGIMSLMQMAKISAAVKRHSNAGLFYLTILTDPTTGGVTASFAMEGDIILAEPQSLVGFAGRRVIENTVRESLPEDFQKAEFLLEHGFVDAIVKRRDLPDTIASLVRLHGGSPR

SEQ ID NO: 3905 - protein, 455 aa, Streptococcus pneumoniae
MFRKILIANRGEIAVRIIRAARELGIATVAVYSTADKEALHTLLADEAVCIGPGKATESYLNINAVLSAAVLTEAEAIHPGFGFLSENSKFATMCEEVGIKFIGPSGHVMDMMGDKINARAQMIKAGVPVIPGSDGEVHNSEEALIVAEKIGYPVMLKASAGGGGKGIRKVEKPDDLVSAFETASSEAKANYGNGAMYIERVIYPARHIEVQILGDEHGHVIHLGERDCSLQRNNQKVLEESPSIAIGKTLRHEIGAAAVRAAEFVGYENAGTIEFLLDEASSNFYFMEMNTRVQVEHPVTEFVSGVDIVKEQICIAAGQPLSVKQEDIVLRGHAIECRINAENPAFNFAPSPGKITNLYLPSGGVGLRVDSAVYPGYTIPPYYDSMIAKIIVHGENRFDALMKMQRALYELEIEGVQTNADFQLDLISDRNVIAGDYDTSFLMETFLPKYQEKE

SEQ ID NO: 3906 - protein, 140 aa, Streptococcus pneumoniae
MIDIQGIKEALPHRYPMLLVDRVLEVSEDTIVAIKNVTINEPFFNGHFPQYPVMPGVLIMEALAQTAGVLELSKPENKGKLVFYAGMDKVKFKKQVVPGDQLVMTATFVKRRGTIAVVEAKAEVDGKLAASGTLTFAIGN

SEQ ID NO: 3907 - protein, 161 aa, Streptococcus pneumoniae
MNLNDIKDLMTQFDQSSLREFSYKNGTDELQFSKNEARPVPEVATQVAPAPVLATPSPVAPTSAPAETVAEEVPAPAEASVASEGNLVESPLVGVVYLAAGPDKPAFVTVGDSVKKGQTLVIIEAMKVMNEIPAPKDGVVTEILVSNEEMVEFGKGLVRIK

SEQ ID NO: 3908 - protein, 92 aa, Streptococcus pneumoniae
LFLVRKYLYHQPSLLQDICWGLRRAVEAIVTIEAMRHNFVPMTAGTSEVSDYIEANVVYGQGLEKEIPYAISNTFGFGGHNAVLAFKRWENR

SEQ ID NO: 3909 - protein, 359 aa, Streptococcus pneumoniae
VKRMKLNRVVVTGYGVTSPIGNTPEEFWNSLATGKIGIGGITKFDHSDFDVHNAAEIQDFPFDKYFVKKDTNRFDNYSLYALYAAQEAVNHANLDVEALNRDRFGVIVASGIGGIKEIEDQVLRLHEKGPKRVKPMTLPKALPNMASGNVAMRFGANGVCKSINTACSSSNDAIGDAFRSIKFGFQDVMLVGGTEASITPFAIAGFQALTALSTTEDPTRASIPFDKDRNGFVMGEGSGMLVLESLEHAEKRGATILAEVVGYGNTCDAYHMTSPHPEGQGAIKAIKLALEEAEISPEQVAYVNAHGTSTPANEKGESGAIVAVLGKEVPVSSTKSFTGHLLGAAACSRSYRHHRSYAS

SEQ ID NO: 3910 - protein, 243 aa, Streptococcus pneumoniae
MKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGMIESDMTAILSDKIKEATLAQIPMKEFGQAEQVADLTVFLAGQDYLTGQVVAIDGGLSM

SEQ ID NO: 3911 - protein, 73 aa, Streptococcus pneumoniae
FPIKPTTLDILMIAPSLAFIIGFKTDCVILKAPVRLTLSTFSKSASVILSIRVSWVIPALLTKTSTEPSSAIA

SEQ ID NO: 3912 - protein, 306 aa, Streptococcus pneumoniae
MTKTAFLFAGQGAQYLGMGRDFYDQYPIVKETIDRASQVLGYDLRYLIDTEEDKLNQTRYTQPAILATSVAIYRLLQEKGYQPDMVAGLSLGEYSALVASGALDFEDAVALVAKRGAYMEEAAPADSGKMVAVLNTPVEVIEEACQKASELGVVTPANYNTPAQIVIAGEVVAVDRAVELLQEAGAKRLIPLKVSGPFHTALLEPASQKLAETLAQVSFSDFTCPLVGNTEAAVMQKEDIAQLLTRQVKEPVRFYESIGVMQEAGISNFIEIGPGKVLSGFVKKIDQTAHLAHVEDQASLVALLEK

SEQ ID NO: 3913 - protein, 324 aa, Streptococcus pneumoniae
MKTRITELLKIDYPIFQGGMAWVADGDLAGAVSKAGGLGIIGGGNAPKEVVKANIDKIKSLTDKPFGVNIMLLSPFVEDIVDLVIEEGVKVVTTGAGNPSKYMERFHEAGIIVIPVVPSVALAKRMEKIGADAVIAEGMEAGGHIGKLTTMTLVRQVATAISIPVIAAGGIADGEGAAAGFMLGAEAVQVGTRFVVAKESNAHPNYKEKILKARDIDTTISAQHFGHAVRAIKNQLTRDFELAEKDAFKQEDPDLEIFEQMGAGALAKAVVHGDVEGGSVMAGQIAGLVSKEETAEEILKDLYYGAAKKIQEEASRWTGVVRND

SEQ ID NO: 3914 - protein, 74 aa, Streptococcus pneumoniae
MAVFEKVQEIIVEELGKDASEVTLESTFDDLDADSLDLFQVISEIEDAFDIQIEAENDLKTVGDLVAYVEEQAK

SEQ ID NO: 3915 - protein, 188 aa, Streptococcus pneumoniae
LVSETLLKPVDWSDRSTAVLFGDGAAGVLLEASEQEHFLAESLNSDGSRSECLTYGHSGLHSPFSDQESADSFLKMDGRTVFDFAIRDVAKSIKQTIDESPIEVTDLDYLLLHQANDRILDKMARKIGVDRAKLPANMMEYGNTSAASIPILLSECVEQGLIPLDGSQTVLLSGFGGGLTWGTLILTI

SEQ ID NO: 3916 - protein, 139 aa, Streptococcus pneumoniae
MAFAKISQVAHYVPEQVVTNHDLAQIMDTNDEWISSRTGIRQRHISRTESTSDLATEVAKKLMAKAGITGEELDFIILATITPDSMMPSTAARVQANIGANKTFAFDLTAACKGFVFALSTAEKFIASGRFQKGLVIGK

SEQ ID NO: 3917 - protein, 65 aa, Streptococcus pneumoniae
LQKPLFQILQKLVKISQTFTHDSNFFLAHAINNFFYHGLVEAFMQSMNQATLLCQMQMHHTTILF

SEQ ID NO: 3918 - protein, 144 aa, Streptococcus pneumoniae
MDYQRINEYLTSIFNNVLVIEEVNLRGSRFKDISIKEMHTIDVIGKAPDVTPSQVSKELMVTLGTVTTSLNNLERKGYIERVRSEQDRRVVHLHLTKKGRLIHRLHKRFHKAMVEKIIDGMSEEEIAVMGKGLTNLYQFLEDLK

SEQ ID NO: 3919 - protein, 65 aa, Streptococcus pneumoniae
LKQRISKKECELIRREEDLNLQENKKYLHHSLNFDIILSVKCFDCKSFLKKEGYEKWTTNESMNI

SEQ ID NO: 3920 - protein, 97 aa, Streptococcus pneumoniae
KGALMEHIIYQLEEDLAILTLNRPEVANGFHIPMCEEILEALTLAEENSAVHFILINANGKVFSVGGDLVEMNRAVDEDDIPSLDKNRRGWAIRISY

SEQ ID NO: 3921 - protein, 75 aa, Streptococcus pneumoniae
MKTICDLRTVQGKDCQVLFKLINNVFHQGSFLFYKQFILFENLFKPRQLPSATSKQYFELTSASFLVCSLIFIEC

SEQ ID NO: 3922 - protein, 454 aa, Streptococcus pneumoniae
MKVVKFGGSSLASASQLEKVLNIVKSDSERRFVVVSAPGKRNAEDTKVTDALIKYYRDYVAGNDISKSQSWIIDRYAAMVSELGLKPAVLEKISKSIHTLATLPIEENEFLYDTFLAAGENNNAKLIAAYFNQNGIDARYMHPREAGIVVTSEPGHARIIPSSYDKIEELTNTNEVLVIPGFFGVTKENQICTFSRGGSDITGSIIAAGVKADLYENFTDVDGIFAAHPGIIHQPHSIPELTYREMRELAYAGFSVLHDEALLPAYRGKIPLVIKNTNNPDHPGTRIVLKHSNDEFPVVGIAGDSGFVSINMSKYLMNREIGFGRKVLQILEELNIGWEHMPTGIDDLSIILRSRQLTPIKEEEILRQLVQKAKVDHAEIEHDLSIIMIVGEKMKSHIGVTATATRALSENKINIQMMSQGSSEVSIMFVVNKDQEKAAIKALYNAFFGESKED

SEQ ID NO: 3923 - protein, 123 aa, Streptococcus pneumoniae
MAQSLNKTVLLSTTGTSYLSIAGKVGKFLVGDQALEFYPDVNVEQFIQIPWSHINQIGANVTGCKISRHFEVFTDKGKFLFASKDSGAILKIARDKLGNDKVVKLPTLIQTISQKFKNLFAKK

SEQ ID NO: 3924 - protein, 374 aa, Streptococcus pneumoniae
MLDIKRIRTDFEAVAEKLATRGVDAAVLNEMKEIDAKRRNILVKVETLKAERNTVSAEIAQAKRNKENTDDKIAAMQNLSAEVKALDAELAEIDAKLTEFTTTLPNIPADSVPVGADEDDNVEVRRWGTPREFDFEPKAHWDLGEDLGILDWERGGKVTGARFLFYKGLGARLERAIYNFMLDEHGKEGYTEVITPYIVNHDSMFGTGQYPKFKEDTFELSDTNFVLIPTAEVPLANYYRDEILDGKDLPIYFTAMSPSFRSEAGSAGRDTRGLIRLHQFHKVEMVKFAKPEESYEELEKMTANAENILQKLNLPYRVVALSTGDMGFSAAKTYDLEVWIPRQNNYVKSQAVQTQKISKPVVPKSVTVMKQMAR

SEQ ID NO: 3925 - protein, 90 aa, Streptococcus pneumoniae
  UNSURE (36): Xaa at each above location is unknown.
KHSSKTQPSIPCRCSLYWRYGLLSCEDLRLGSVDSXTKQLREISSCSNTEDFQARRAQIRYRDEADGKVKLPPYLERFWTCSWTYSGCNS

SEQ ID NO: 3926 - protein, 303 aa, Streptococcus pneumoniae
LEVRMKKLPLVFSGCLLGLAGAGNLILDTLPVLSHLFSLTGLVLWIYFLILHLFNWKETKQELTKPPLLSGMATFPMAGMILSTYVFRVFSYLPLVAQGIWWFSFLLDLTLIAGFTIKFACPGRRVHATPSWTVLYVGIAVAALTYPLVGIIEIAYATLSFGFLLTFYLYPLIYSDLKKHPLPLALLGQEGIYCAPFSLLLASLVRVGGTSLPTWGLIVMILASQSFFFFVLTRMPNILKQGFQPAFSALTFPTIITATSLKMAQGILKLPFLDYLVLAETIICLTILFFVLGAYLIWLRKKV

SEQ ID NO: 3927 - protein, 68 aa, Streptococcus pneumoniae
KGIEIEGQEKTKTQGRIGNFDNTYQRIGQGSHCYPHIENRPTWSGMNPPPWTSKLDGKTSNQGQIQEK

SEQ ID NO: 3928 - protein, 182 aa, Streptococcus pneumoniae
MTTFTIHTVESAPAEVKEILETVEKDNNGYIPNLIGLLANAPTVLEAYQIVSSIHRRNSLTPVEREVVQITAAVTNGCAFCVAGHTAFSIKQIQMNDDLIQALRNRTPIETDPKLDTLAKFTLAVINTKGRVGDEALSEFLEAGYTQQNALDVVFGVSLAILCNYANNLANTPINPELQPYA

SEQ ID NO: 3929 - protein, 440 aa, Streptococcus pneumoniae
MLELLKSIDDFAWGPPLLILLVGTGIYLTMRLGLLQVLRLPKAFQLIFIQDKGHGDVSSFAALCTALASTVGTGNIIGVATAIKVGGPGALFWMWMAAFFGMATKYAEGLLAIKYRTKDDHGAVAGGPMHYILLGMGEKWRPLAVLFAVAGVLVALLGIGTFTQVNSITESIQNTTTISPAITALVLSVFVAIAVFGGLKSISKVSTTVVPFMAIIYILGTLTVIFFNIGKIPGTIALVFTSAFSPLAAVGGFAGASVRMAIQNGVARGVFSNESGLGSAHIAAAAAKTNEPVEQGLISMTGTFIDTLIICTLTGLTILVTGVWSGDLNGVALTQSAFSTVFSHFGPALLTIFLVLFAFTTILGWNYYGERCFEFLFGVRFIWLYRVVFVLMVLLGGFIELDMVWIIADIVNALMALPNLIALLVLSPVVIAETKKYFDK

SEQ ID NO: 3930 - protein, 778 aa, Streptococcus pneumoniae
MNKKILETLEFDKVKALFEPHLLTEQGLEQLRQLAPTAKADKIKQAFAEMKEMQALFVEQPHFTILSTKEIAGVCKRLEMGADLNIEEFLLLKRVLLTSRELQSFYANLENVSLEELALWFEKLHDFPQLQGNLQAFNDAGFIENFASEELARIRRKIHDSESQVRDVLQDLLKQKAQMLTEGIVASRNGRQVLPVKNTYRNKIAGVVHDISASGNTVYIEPREVVKLSEEIASLRADERYEMLRILQEISERVRPHAAEIANDAWIIGHLDLIRAKVRFIQERQAVVPQLSENQEIQLLHVCHPLVKNAVANDVYFGQDLTAIVITGPNTGGKTIMLKTLGLTQVMAQSGLPILADKGSRVGIFEEIFADIGDEQSIEQSLSTFSSHMTNIVDILGKVNQHSLLLLDELGAGTDPQEGAALAMAILEDLRLRQIKTMATTHYPELKAYGIETAFVQNASMEFDTATLRPTYRFMQGVPGRSNAFEIAKRLGLSEVIVGDASQQIDQDNDVNRIIEQLEEQTLESRKRLDNIREVEQENLKMNRVLKKLYNELNREKETELNKAREQAAEIVDMALSESDQILKNLHSKSQLKPHEIIEAKAKLKKLAPEKVDLSKNKVLQKAKKKRAPKVGDDIVVLSYGQRGTLTSQLKDGRWEAQVGLIKMTLEEKEFDLVQAQQEKPVKKKQVNVVKRTSGRGPQARLDLRGKRYEEAMNELDAFIDQALLNNMAQVDIIHGIGTGVIREGVTKYLQRNKHVKSFGYAPQNAGGSGATIVTFKG

SEQ ID NO: 3931 - protein, 250 aa, Streptococcus pneumoniae
MDRGYESYNLMAHFQEKGWLYIIRIRDGKQSMPSSFNLPNTECFDQKVSLKLSRKQTNQLKKLYRDFPNDYHFIPHNSIFDFLPETSRKQDPVTLYELPFRMVRLEVEEGKYETLVTNTDYSVQELKNLYASRWGIETSFRDLKYSIGLVNFHAKKKGGILQEIFARFTNFNFCRWVTSQVAIDSSHKKQRYKVCFSDAAYACRLFFNGSLSSLQLKNYLKKQLSIIRPNRKYSRKIKAQSVVDFIYRVT

SEQ ID NO: 3932 - protein, 64 aa, Streptococcus pneumoniae; identical to SEQ ID NO: 3389

SEQ ID NO: 3933 - protein, 181 aa, Streptococcus pneumoniae; identical to SEQ ID NO: 3390

SEQ ID NO: 3934 - protein, 182 aa, Streptococcus pneumoniae
MISFLLLLVLVWGFYIGYRRGLLLQVYYLISAMASAFMAGQFYKGLGEQFHLLLPYANSQEGQGTFFFPSDQLFQLDKVFYAGIGYLLVFGIVYSIGRLLGLLLHLIPSKKLGGKLFQVSAGILSMLVTLFVLQMALTILATIPMAVIQNPLEKSIVAKHIIQSIPITTSWLKQIWVTNLIG

SEQ ID NO: 3935 - protein, 103 aa, Streptococcus pneumoniae
VNFMANLNRFKFTFGKKSLTLTSEHDNLFMEEIAKVATEKYQAIKEQMPSADDETIALLLAVNCLSTQLSREIEFDDKEQELEELRHKLVTCKQEQSKIEDSL

SEQ ID NO: 3936 - protein, 293 aa, Streptococcus pneumoniae
MASITLTPSEKDIQAFLEHYQTSLAPSKNPYIRYFLKLPQATVSIYTSGKILLQGEGAEKYASFFGYQAVEQTSGQNLPLIGTDEVGNGSYFGGLAVVAAFVTPDQHDFLRKLGVGDSKTLTDQKIRQIAPILKEKIQHQALLLSPSKYNEVIGDRYNAVSVKVALHNQAIYLLLQKGVQPEKIVIDAFTSAKNYDKYLAQEANRFSNPISLEEKAEGKYLSVAVSSVIARDLFLENLENLGRELGYQLPSGAGTASDKVASQILQAYGMQGLNFCAKLHFKNTEKAKKRLER

SEQ ID NO: 3937 - protein, 204 aa, Streptococcus pneumoniae
MNSFKNFLKEWGLFLLILSLLALSRIFFWSNVRVEGHSMDPTLADGEILFVVKHLPIDRFDIVVAHEEDGNKDIVKRVIGMPGDTIRYENDKLYINDKETDEPYLADYIKRFKDDKLQSTYSGKGFEGNKGTFFRSIAQKAQAFTVDVNYNTNFSFTVPEGEYLLLGDDRLVSSDSRHVGTFKAKDITGEAKFRFWPITRIGTF

SEQ ID NO: 3938 - protein, 92 aa, Streptococcus pneumoniae
LVILGLLGFLKCSDTGDWPEAEFSFPCDIFCFEGTYVAAVARNQAVISEEKVFSFWNSKAKVGVVVDINCEGLGFLSDTSKESSFISFKALA

SEQ ID NO: 3939 - protein, 788 aa, Streptococcus pneumoniae
MEVYFSGTIERIIFENPSNFYRILLLEIDDTDAEDFDDFEIIVTGTMADVIEGEDYTFWGQIVQHSKYGEQLQISRYDRAKPTSKGLVKYFSSSHFKGIGLKTAQKIVDTYGENTIDEILQHPEKLEGIAGLSAKNREAFVSTLRLNYGTEMILAKLANYGIPNKLAFQIQDFYKEETLDVVENYPYQLVEDIKGLGFTIADQLAEELGIESQAPERFRAGLVHSLFQTCMETGDTYVEARDLLEQTLTLLESSRPVELDPSQVAQELSYLIEEDKVQQIDTKIFDNSLFFAEEGIRSHLIRILEKGKQKSQDLETIQKHITTVEQELGIEYDNIQKQAICDAIQNKVFILTGGPGTGKTTVINGIIAVYALLEGLDFRKKNNLPILLAAPTGRAARRMNELTGLPSATIHRHLGMTGDDDTSHLEDYLDADFIIVDEFSMVDTWLANQLFSNISSNSKILIVGDSDQLPSVSPGQVLADLLHIPLIPQTRLEKIYRQSKESTIVTLASQIRQGILPADFTQKKADRSYFEIASGHIPATIEKILGAALRNGIPARDIQVLAPMYRGTAGIDAINQLMQDLLNPPQKDQLSFEAPQCHYRKRDKVIHLVNDAEINVFNGDLGAITDLIPGKYTESKQDEIVIDFDGNEVSYPRNEWYKIRLAYAMSIHKSQGSEFPVVILPITSASRRMLERNLIYTAITRAKSKLILLGELQAFDYATQHIGTARKTYLIERFSDLLENVEEKQQAVSETVTSSASEQSYILTEENWDRIPAMIGITDTDLKEIFGK

SEQ ID NO: 3940 - protein, 427 aa, Streptococcus pneumoniae
MSVSFENKETNRGVLTFTISQDQIKPELDRVFKSVKKSLNVPGFRKGHLPRPIFDKKFGEESLYQDVMNALLPNAYEAAVKEAGLEVVAQPKIDVTSMEKGQDWVIAAEVVTKPEVKLGDYKNLEVSVDVEKEVTDADVEERIERERNNLAELVIKEAAAENGDTVVIDFVGSIDGVEFDGGKGENFSLGLGSGQFIPGFEDQLVGHSAGETVDVIVTFPEDYQAEDLAGKEAKFVTTIHEVKAKEVPALDDELAKDIDEEVETLADLKEKYRKELAAAKEEAYKDAVEGAAIDTAVENAEIVELPEEMIHEEVHRSVNEFLGNLQRQGINPDMYFQITGTTQEDLHNQYQAEAESRTKTNLVIEAVAKAEGFDASEEEIQKEVEQLAADYNMEVAQVQNLLSADMLKHDITIKKAVELITSTATVK

SEQ ID NO: 3941 - protein, 378 aa, Streptococcus pneumoniae
MKHSVHFGAGNIGRGFIGEILFKNGFHIDFVDVNNQIIYALNEKGKYEIEIAQKGQSRIEVTNVAGINSKEHPEQVIEAIQKTDIITTAIGPNILPFIAELLAKGIEARRVAGNTQALDVMACENMIGGSQFLYQEVKKYLSPEGLTFADNYIGFPNAAVDRIVPTQSHEDSLFVMVEPFNEWVVETKRLKNPDLRLKDVHYEEDLEPFIERKLFSVNSGHATSAYIGAHYGAKTILEALQNPNIKSRIESVLAEIRSLLIAKWNFDKKELENYHKVIIERFENPFIVDEVSRVARTPIRKLGYNERFIRPIRELKELSLSYKNLLKTVGYAFDYRDVNDEESIRLGELLAKQSVKDVVIQVTGLDDQELIEQIVEYI

SEQ ID NO: 3942 - protein, 145 aa, Streptococcus pneumoniae
MKLEKHLIKLNKQFSNKEEAICYCGQVLYEGGYVNEDYIEAMIERDKELSVYMGNFIAIPHGTDAAKKDVLKSGITVVQVPRGVDFGNVSNPQVATVLFGIAGIGNEHLEIIQKISIFCADVDNVLKLADAQSKEEVLRLFDAVE

SEQ ID NO: 3943 - protein, 651 aa, Streptococcus pneumoniae
MLLTKREEQLLKAFLHVGKLSMQDMTEILQVSSRTIYRTLSDLTDSMEQYGIEITKHGKYYILTGELDDLPTELEVLVEYSPQERQELITYRLLTESGFVTNEALQECTKVSNVTIIQDISDIDKRLLDFDLKIERQKGYRISGDSVGKRRFLAILLTNCISVADFSTGNFGSFDILEADRTRLASQIVNKQLSGFPDMDARMKMFFAILLSLIGQEQNIENSPNTSKQALEISQKIFQAYSKQTAQFYSIQEIIYFASILDELIIKRQDNPLFTEKFDGEFFYNISNLIDTVSMYTKIDFFKDKVLFNFLFHHIRLSLGVPILFQSENLPESVQILVERNKFLYTVISLLVNDIFPKYLHTDYEYGMIALHFISSLGRSPEIYPVRVLLLTDERRVTRDLLVSKIKSVAPFVELIDIQSLVDYHSIDLSQYDYILSTKPLTNQEIDVISSFPTVKELLELQERLQYVQAHRTIVARDAIAPEKSYDLQDYLISSSQLLSQFELVQLENNQSFEHTVEQIIQYQKNVSDRDYLTRKLLSHFQNSPMAIPNTGLVLLHSQSSKVTTNSFTMFELKLPISALSMKREEEEVKRCLLMLMSKEASEEARDLMTAISQSIIENHLYTEIYKTGNQSIIYQMLNTIFNEKIKKLEN

SEQ ID NO: 3944 - protein, 595 aa, Streptococcus pneumoniae
EKEDDLMEEKVSLKVRVQKLGTSLSNMVMPNIGAFIAWGVLTALFIADGYLPNEQLATVVGPMLTYLLPILIGYTGGYMIHGQRGAVVGAIATVGAITGSSVPMFIGAMVMGPLGGWTIKKFDEKFQEKIRPGFEMLVNNFSAGLVGFALLLLAFYAIGPVVSTLTGAVGNGVEAIVNAHLLPMANIIIEPAKVLFLNNALNHGIFTPLGVEQVAQAGKSILFLLEANPGPGLGILLTYAVFGKGSAKSSSWGAMVIHFFGGIHEIYFPYVMMKPTLFLAAMAGGISGTFTFQLLDAGLKSPASPGSIIAIMATAPKGVWPHLNVLLGVLVAAVVSFLVAALILHADKSTEDSLEAAQAATQAAKAQSKGQLVSTSVDAVVSTDSVEKIIFACDAGMGSSAMGASILRDKVKKAGLEIPVSNQAISNLLDTPKTLIVTQEELTPRAKDKSPSAIHVSVDNFLASPRYDEIVASLTGASPIAEIEGDIPTSAPVDSQEIDLNHIDAVVVAYGKAQGTATMGCETIRAIFRNKNIRIPVSTAKISELGEFNSKNIMIVTTISLQAEVQQAAPNSQFLIVDSLVTTPEYDKMAARMYK

SEQ ID NO: 3945 - protein, 66 aa, Streptococcus pneumoniae
LSYLFYSQRSKNAMIEGIIEEKDFSRFDDNISHRKEVSIDNSLNTIPNSSSKSRYDWTDCVESQKQ

SEQ ID NO: 3946 - protein, 190 aa, Streptococcus pneumoniae; identical to SEQ ID NO: 2680

SEQ ID NO: 3947 - protein, 277 aa, Streptococcus pneumoniae
MTEFSLDLLLKVIKLARSTYYYHLKQLDKTDKDQELKAEIQSIFIEHKGNYTYRRVHLELRNRGYLVNHKRVQGLMKVLNLQAKMRQKRKYSSHKGDVGKKAENLIQSQFEGSKTMEKCYTDVTEFAIPASTQKLYLSPVLDGFNSEIIAYHLSTSPNLEQVQTMLEQAFTEKHYENTILHSDQGWQYQHDSYHRFLESKGTQASMLRKGNSQDNGMMESFFGILKSEMFYGYEKTFKSLNQLEQAIIDYIDYYNNKRIKVKLKGLSPVQYRTKSFG

SEQ ID NO: 3948 - protein, 340 aa, Streptococcus pneumoniae
MKLFKKMMQVVLATFFFGLLGTSTVCADDSEGWQFVQENGRTYYKKGDLKETYWRVIDGKYYYFDPLSGEMVVGWQYIPAPHKGVTIGPSPRQEIAFRPDWFYFGQDGVLQEFVGKQVLEAKTATNTNKHHGEEYDSPAEKRVYYFEDQRSYHTLKTGWVYDDGDWYYLQKDGGFDSRINRLTVGELARGWVKDYPLTYDEEKLKPAPWYYLDPATGIMQTGWQHLGNKWYYLRSSGAMATGWYQDGSTWYYLDAENGDMKTGWQNLGNKWYYLRSSGAMATGWYQEGSTWYYLNASNGDMKTGWFQVNGNWYYAYDSGALAVNTTVGGYYLNYNGEWVK

SEQ ID NO: 3949 - protein, 97 aa, Streptococcus pneumoniae
MNEICHLFIYSVLKGYSLEGWKKINGSWYYYRQHDKQTGWQEINDTWYYLDSSGKMLTDWQKVNGKWYYLNSNRAMVTGSQTIDGKVYNFASSGEWI

SEQ ID NO: 3950 - protein, 218 aa, Streptococcus pneumoniae
LIKIDNTLQYPYSTSAMVLSKYYGVADGMNVEGRGSANFIKDNVLITAAHNYYRHDYGKEADDIYVLPAVSPSQEPFGKIKVKEVRYLKEFRNLNSKDAREYDLALLILEKPIGAKLGTLGLPTSQKNLTGITVTITGYPSYNFKIYQMYTDKKQVLSDDGMFLDYQVDTLEGSSGSTVYDASHRVVGVHTLGDGANQINSAVKLNERNLSFIYLFGS

SEQ ID NO: 3951 - protein, 79 aa, Streptococcus pneumoniae
MKKTVYKKLGISIIASTLLASQLSTVSALSVISSTGEEYEVSETLEKGPGSNDSSLSEISPTYGSYYQKQSEVLSVMMI

SEQ ID NO: 3952 - protein, 90 aa, Streptococcus pneumoniae
LSIKWSLLDNIWLRRVAIDHQLLRKEKTNTQLMEKILLHNLNQTEFFINKAIGWTLRAYSKTNPTWVACFIDENKERMAELSIKEASKYL

SEQ ID NO: 3953 - protein, 84 aa, Streptococcus pneumoniae
VAANYLKAMQSYLKETDLPKLEQLVVTKSWWDTVDILDRVVGSLVYEHPELEEIILILFENLFKPRQLYLQPQNSVLSNLRLAS

SEQ ID NO: 3954 - protein, 210 aa, Streptococcus pneumoniae
MKILLVDDHEMVRLGLKSYFDLQDDVEVVGEAFNGSQGIDLALELRPDVIVMDIVMPEMNGIDATLAILKEWPEAKILIVTSYLDNEKIMPVLDAGAKGYMLKTSSADELLHAVSKVAAGELAIEQEVSKKVEYHRNHMELHEELTARERDVLQLIAKGYENQRIADDLFISLKTVKTHVSNILAKLEVSDRTQAAVYAFQHHLVGQEEF

SEQ ID NO: 3955 - protein, 331 aa, Streptococcus pneumoniae
MKKQAYVIIALTSFLFVFFFSHSLLEILDFDWSIFLHDVEKTEKFVFLLLVFSMSITCLLALFWRGIEELSLRKMQANLKRLLAGQEVVQVADPDLDASFKSLSGKLNLLTEALQKAENHSLAQEEEIIEKERKRIARDLHDTVSQELFAAHMILSGISQQALKLDREKMQIQLQSVTAILETAQKDLRVLLLHLRPVELEQKSLIEGIQILLKELEDKSDLRVSLKQNMTKLPKKIEEHIFRILQELISNTLRHAQASCLDVYLYQTDVELQLKVVDNGIGFRLGSLDDLSYGLRNIKERVEDMAGTVQLLTAPKQGLAVDIRIPLLDKE

SEQ ID NO: 3956 - protein, 232 aa, Streptococcus pneumoniae
MRKFKIFLFIEACLLTGALILMVSEHFSRFLLILFLFLLLIRYYTGKEGNNLLLVAATILFFFIVMLNPFVILAIFVAVIYSLFLLYPMMNQEKEQTNLVFEEVVTVKKEKNRWFGNLHHFSSYQTCQFDDINLFRFMGKDTIHLERVILTNHDNVIILRKMVGTTKIIVPVDVEVSLSVNCLYGDLTFFNQPKRALRNEHYHQETKDYLKSNKSVKIFLTTMIGDVEVVRG

SEQ ID NO: 3957 - protein, 336 aa, Streptococcus pneumoniae
MTTNRKDEHILYALEQKSSYNSFDEVELIHSSLPLYNLDEIDLSTEFAGRKWDFPFYINAMTGGSNKGREINQKLAQVAESCGILFVTGSYSAALKNPTDDSFSVKSSHPNLLLGTNIGLDKPVELGLQTVEEMNPVLLQVHVNVMQELLMPEGERKFRSWQSHLADYIKQIPVPIVLKEVGFGMDAKTIERAYEFGVRTVDLSGRGGTSFAYIENRRSGQRDYLNQWGQSTMQALLNAQEWKDKVELLVSGGVRNPLDMIKCLVFGAKAVGLSRTVLELVETYTVEEVIGIVQGWKADLRLIMCSLNCATIADLQKVDYLLYGKLKEAKDQMKKA

SEQ ID NO: 3958 - protein, 335 aa, Streptococcus pneumoniae
MIAVKTCGKLYWAGEYAILEPGQLALIKDIPIYMRAEIAFSDSYRIYSDMFDFAVDLRPNPDYSLIQETIALMGDFLAVRGQNLRPFSLKICGKMEREGKKFGLGSSGSVVVLVVKALLALYNLSVDQNLLFKLTSAVLLKRGDNGSMGDLACIVAEDLVLYQSFDRQKVAAWLEEENLATVLERDWGFFISQVKPTLECDFLVGWTKEVAVSSHMVQQIKQNINQNFLSSSKETVVSLVEALEQGKAEKVIEQVEVASKLLEGLSTDIYTPLLRQLKEASQDLQAVAKSSGAGGGDCGIALSFDAQSTETLKNRWADLGIELLYQERIGHDDKS

SEQ ID NO: 3959 - protein, 344 aa, Streptococcus pneumoniae
LYHSLGNQFDTRTRTSRKIRRERSCSDMDREPVTVRSYANIAIIKYWGKKKEKEMVPATSSISLTLENMYTETTLSPLPANVTADEFYINGQLQNEVEHAKMSKIIDRYRPAGEGFVRIDTQNNMPTAAGLSSSSSGLSALVKACNAYFKLGLDRSQLAQEAKFASGSSSRSFYGPLGAWDKDSGEIYPVETDLKLAMIMLVLEDKKKPISSRDGMKLCVETSTTFDDWVRQSEKDYQDMLIYLKENDFAKIGELTEKNALAMHATTKTASPAFSYLTDASYEAMDFVRQLREKGEACYFTMDAGPNVKVFCQEKDLEHLSEIFGQRYRLIVSKTKDLSQDDCC

SEQ ID NO: 3960 - protein, 292 aa, Streptococcus pneumoniae
MTKKVGVGQAHSKIILIGEHAVVYGYPAISLPLLEVEVTCKVVPAESPWRLYEEDTLSMAVYASLEYLDITEACIRCEIDSAIPEKRGMGSSAAISIAAIRAVFDYYQADLPHDVLEILVNRAEMIAHMNPSGLDAKTCLSDQPIRFIKNVGFTELEMDLSAYLVIADTGVYGHTREAIQVVQNKGKDALPFLHALGELTQQAEVAISQKDAEGLGQILSQAHLHLKEIGVSSPEADFLVETTLSHGALGAKMSGGGLGGCIIALVTNLTHAQELAERLEEKGAVQTWIESL

SEQ ID NO: 3961 - protein, 109 aa, Streptococcus pneumoniae
MTRKVYDTDLNDQEWAKIEPYFSKHRTYKWPKRVLVNETLYVTKTGCQWRMLPHDFPLYLMVWSFFRRSMTTGWFQVNGRWYYAYSSGALAVNTTVDGYSVNYNGEWVR

SEQ ID NO: 3962 - protein, 291 aa, Streptococcus pneumoniae
LYPPELDSKILSIIKKAVTIRTTHTYEYQYSLLFGDAGYLWLLLHLFSISKNQYYLQLANVTAKKLIENYDTLEEIDFALGKSGVLLSLIKYYQFTNDNTLKIFIHNSIGEIYHYFLQRDTAKESILDYSFAHGYCGIAYALFAYSKVLEPSMFYNDLHTFHTELKKLLEKVTSNTENLGNLQLSWCKGISGIILYLCMYDCDGNKDIISKYQEFVFNHHLKMMTGYCHGITSLLQTTVYNQNKLLMKKIQQVILACSERDDHGLLMFQGDSGKADLFDFGIGSMGYIGVY

SEQ ID NO: 3963 - protein, 410 aa, Streptococcus pneumoniae
MKLFWTNNIYRQLLLNSCFSSFGDSIFYLAIINYVAQYNFAPLAILLISISEMVPLLSQLFLGILGDFQENRVKHALWIAKIKILLYAILTVFLVLSPFSLVSVIMIVIINLISDTLSYLSAYMMNALYISVIKDDLHDAMGFRQSLMRVVRIVANLAGAFLINVISIQTISLINTLTFVIAFLGLYVIRHTLYEVEKRIEMSHTALSFKKYFQHLKQSLAVLLRLKDTVILLFLTTSMIAILDVSPRLIALRFIQQTLAQLSIGQLLALLSIIMSCGAILGNMTSSNLFKNIRFTHLLVFCEISLLTLITSILCQAYIVIFMTSFISSTIIGILSPRLQAAVFAHIPSDKMGTVGSALSTVDILAPSLLSLLALSIASGVSVQLALIFLYLILIALIFCQWLVKFNTHN

SEQ ID NO: 3964 - protein, 332 aa, Streptococcus pneumoniae
MKLLKKTMQAGLTVIFFGLLATNTVFADNSEVWQFVQENGRTYYKKGDLKETYWRVIDGKYYYFDSLSGEMVVGWQYIPFPSKGSTIGPYPNGIRLEGFPKSEWYYFDKNGVLQEFVGWKTLEIKTKDSVGRKYGEKREDSEDKEEKRYYTNYYFNQNHSLETGWLYDQSNWYYLAKTEINGENYLGGERRAGWINDDSTWYYLDPTTGIMQTGWQYLGNKWYYLRSSGAMATGWYQEGTTWYYLDQPNGDMKTGWQNLGNKWYYLRSSGAMVTGWVKDDSTWYYLNAGNGDMKTGWFQVNGRWYYAYSSGALAVNTTVDGYSVNYNGEWVR

SEQ ID NO: 3965 - protein, 370 aa, Streptococcus pneumoniae
LQLCNCFFEEFLYIDIQSSFYYNRFRRIYKMKLLKKMMPIALAVFFFGLLATSTVFADTMGGRFVDKDNRKYYVKDDHKAIYWHKIDGKTYYFGDIGEMVVGWQYLEIHGTGYRDDLFDNRPVFEIGLQEKWYYFGQDGALLEQTDKQVLEAKTSENTGKVYGEQYPLSAEKKTYYFDNNYAVKTGWIYEDGNWYYLNKLGNFGDDSYNPLPIGEVAKGWTQDFHVTIDIDRSKPAPWYYLDASGKMLTDWQKVNGKWYYFGSSGSMATGWKYVRGKWYYLDNKNGDMKTGWQYLGNKWYYLRSSGAMVTGWYQDGSTWYYLDAENGDMKIGWTKVNGKWYYLNSSGAMVTGSQTIDGKVYNFASSGEWI

SEQ ID NO: 3966 - protein, 229 aa, Streptococcus pneumoniae
MGKRILLLEKERNLAHFLSLELQKEQYRVDLVEEGQKALSMALQTDYDLILLNVNLGDMMAQDFAEKLSRTKPASVIMILDHWEDLQEELEVVQRFAVSYIYKPVFIENLVARISAIFRGRDFIDQHCSLMKVPRTYRNLRIDVEHHTVYRGEEMIALTRREYDLLATLMGSKKVLTREQLLESVWKYESATETNIVDVYIRYLRSKLDVKGQKSYIKTVRGVGYTMQE

SEQ ID NO: 3967 - protein, 457 aa, Streptococcus pneumoniae
LPLILNLVVTQLLSTTGSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVSDVLEEISAKAPEDGKPCVTYIGPDGAGHYVKMVHNGIEYGDMQLIAESYDLMQHLLGLSAEDMAEIFTEWNKGELDSYLIEITADILSRKDDEDQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 3968 - protein, 464 aa, Streptococcus pneumoniae
MSKKRRNRHKKEGQEPQFDFDEAKELTVGQAIRKNEEVEAGVLPEDSILDKYVKQHRDEIEADKFATRQYKKEEFVETQSLDDLIQEMREAVEKSEASSEEVPSSEDILLPLPLDDEEQGLDPLLLDDENPTEMTEEVEEEQNLSRLDQEDSEKKSKKGFILTVLALVSVIICVSAYYVYRQVNRSTKEIETSQSTTANQSDVDDFNTLYDAFYTDSNKTALKNSQFDKLSQLKTLLDKLEGSREHTLAKSKYDSLATQIKAIQDVNAQFEKSAIVDGVLDTHAKAKSDAKFTDIKTGNTELDKVLDKAISLGKSQQTSTFSSSSSQTSSSSSSQASSNTTSEPKPSSSNETRSSRSEVNMGLSSAGVAVQRSASRVAYNQSAIDDSNNSAWDFADGVLEQILATSRSRGYITGDQYILERVNIVNGNGYYNLYKPDGTYLFTLNCKTGYFVGNGAGHADDLDY

SEQ ID NO: 3969 - protein, 385 aa, Streptococcus pneumoniae
MKKEFNLIATVAAGLEAVVGREVRELGYDCQVENGRVRFQGDVRAIIETNLWLRAADRIKIIVGTFPAKTFEELFQGVFALDWENYLPLGARFPISKAKCVKSKLHNEPSVQAISKKAVVKKLQKHYARPEGVPLMENGPEFKIEVSILKDVATVMIDTTGSSLFKRGYRTEKGGAPIKENMAAAILQLSNWYPDKTLIDPTCGSGTFCIEAVMIARKMAPGLRRSFAFEEWNWISDRLIQEVRTEAAKKVDRELELDIMGCDIDARMVEIAKANAQAAGVAGDITFKQMRVQDLRSDKINGVIISNPPYGERLSDDAGVTKLYAEMGQVFAPLKTWSKFILTSDEAFESKYGSQADKKRKLYNGTLKVDLYQYFGQRVKRQEVK

SEQ ID NO: 3970 - protein, 109 aa, Streptococcus pneumoniae
MASIIFSAKDIFEQEFGREVRGYNKVEVDEFLDDVIKDYETYAALVKSLRQEIADLKEELTRKPKPSPVQAEPLEAAITSSMTNFDILKRLNRLEKEVFGKQILDNSDF

SEQ ID NO: 3971 - protein, 175 aa, Streptococcus pneumoniae
MATALVLGYSAFDLGLFSDKDPRLKLIKKAIRKDLEAMAADGVSWLVFTGSLGFEYWVLEVAQEMKTEYGFQLATIFAFETHGENWNEGNQMKLSRFKQVDFVKYAYPRYEHKGQLRDYQQFLLENTTSSYLFYDEENETKLAYFYQKMKNQEDYFIKRLTFDQLNELAENFSEN

SEQ ID NO: 3972 - protein, 198 aa, Streptococcus pneumoniae
MVNYPHKVSSQKRQTSLSQPKNFANRGMSFEKMINATNDYYLSQGLAVIHKKPTPIQIVQVDYPQRSRAKIVEAYFRQASTTDYSGVYNGYYIDFEVKETKQKRAIPMKNFHPHQIQHMEQVLAQQGICFVLLHFSSQQETYLLPAFDLIRFYHQDKGQKSMPLEYIREYGYEIKAGAFPQIPYLNVIKEHLLGGKTR

SEQ ID NO: 3973 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGIYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTDMMKTVLTYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 3974 - protein, 67 aa, Streptococcus pneumoniae
SGVVFDCCVLLLGLVVVLLFVLGVVELDCEVELSDDELELSVDGGCCGAGEFHVERAPFLNTNSPFL

SEQ ID NO: 3975 - protein, 1767 aa, Streptococcus pneumoniae
MNKGLFEKRCKYSIRKFSLGVASVMIGAAFFGTSPVLADSVQSGSTANLPADLATALATAKENDGRDFEAPKVGEDQGSPEVTDGPKTEEELLALEKEKPAEEKPKEDKPAAAKPETPKTVTPEWQTVEKKEQQGTVTIREEKGVRYNQLSSTAQNDNAGKPALFEKKGLTVDANGNATVDLTFKEDSEKGKSRFGVFLKFKDTNNNVFVGYDKDGWFWEYKSPTTSTWYRGSRVAAPETGSTNRLSITLKSDGQLNASNNDVNLFDTVTLPAAVNDHLKNEKKILLKAGSYDDERTVVSVKTDNQERVKTEDTPAQKETGPVVDDRKVTYDTIQSKVLKAVIDQAFPRVKEYTLNGHTLPGQVQQFNQVFINNHRITPEVTYKKINETTAEYLMKLRDDAHLINAEMTVRLQVVDNQLHFDVTKIVNHNQVTPGQKIDDERKLLSSISFLGNALVSVSSDQTGAKFDGATMSNNTHVSGDDHIDVTNPMKDLAKGYMYGFVSTDKLAAGVWSNSQNSYGGGSNDWTRLTAYKETVGNANYVGIHSSEWQWEKAYKGIVFPEYTKELPSAKVVITEDANADKKVDWQDGAIAYRSIMNNPQGWEKVKDITAYRIAMNFGSQAQNPFLMTLDGIKKINLHTDGLGQGVLLKGYGSEGHDSGHLNYADIGKRIGGVEDFKTLIEKAKKYGAHLGIHVNASETYPESKYFNEKILRKNPDGSYSYGWNWLDQGINIDAAYDLAHGRLARWEDLKKKLGDGLDFIYVDVWGNGQSGDNGAWATHVLAKEINKQGWRFAIEWGHGGEYDSTFHHWAADLTYGGYTNKGINSAITRFIRNHQKDAWVGDYRSYGGAANYPLLGGYSMKDFEGWQGRSDYNGYVTNLFAHDVMTKYFQHFTVSKWENGTPVTMTDNGSTYKWTPEMRVELVDADNNKVVVTRKSNDVNSPLYRERTVTLNGRVIQDGSAYLTPWNWDANGKKLSTDKEKMYYFNTQAGATTWTLPSDWAKSKVYLYKLTDQGKTEEQELTVKDGKITLDLLANQPYVLYRSKQTNPEMSWSEGMHIYDQGFNSGTLKHWTISGDASKAEIVKSQGANDMLRIQGNKEKVSLTQKLTGLKPNTKYAVYVGVDNRSNAKASITVNTGEKEVTTYTNKSLALNYVKAYAHNTRRNNATVDDTSYFQNMYAFFTTGSDVSNVTLTLSREAGDQATYFDEIRTFENNSSMYGDKHDTGKGTFKQDFENVAQGIFPFVVGGVEGVEDNRTHLSEKHDPYTQRGWNGKKVDDVIEGNWSLKTNGLVSRRNLVYQTIPQNFRFEAGKTYRVTFEYEAGSDNTYAFVVGKGEFQSGRRGTQASNLEMHELPNTWTDSKKAKKATFLVTGAETGDTWVGIYSTGNASNTRGDSGGNANFRGYNDFMMDNLQIEEITLTGKMLTENALKNYLPTVAMTNYTKESMDALKEAVFNLSQADDDISVEEARAEIAKIEALKNALVQKKTALVADDFESLDAPAQPGEGLENAFDGNVSSLWHTSWNGGDVGKPATMVLKEPTEITGLRYVPRGSGSNGNLRDVKLVVTDESGKEHTFTATDWPDNNKPKDIDFGKTIKAKKIVLTGTKTYGDGGDKYQSAAELIFTRPQVAETPLDLLGYEAALAKAQKLTDKDNQEEVASVQASMKYATDNHLLTERMVEYFADYLNQLKDSATKPDAPTVEKPEFKLSSLASEQGKTPDYKQEIARPETPEQILPATGESQSDTALFLAGVSLALSALFVVKTKKD

SEQ ID NO: 3976 - protein, 660 aa, Streptococcus pneumoniae
MKSSKLFALAGVTLLAATTLAACSGSGSSTKGEKTFSYIYETDPDNLNYLTTAKAATANITSNVVDGLLENDRYGNFVPSMAEDWSVSKDGLTYTYTIRKDAKWYTSEGEEYAAVKAQDFVTGLKYAADKKSDALYLVQESIKGLDAYVKGEIKDFSQVGIKALDDQTVQYTLNKPESFWNSKTTMGVLAPVNEEFLNSKGDDFAKATDPSSLLYNGPYLLKSIVTKSSVEFAKNPNYWDKDNVHIDKVKLSFWDGQDTSKPAENFKDGSLTAARLYPTSASFAELEKSMKDNIVYTQQDSITYLVGTNIDRQSYKYTSKTSDEQKASTKKALLNKDFRQAIAFGFDRTAYASQLNGQTGASKILRNLFVPPTFVQADGKNFGDMVKEKLVTYGDEWKDVNLADSQDGLYNPEKAKAEFAKAKSALQAEGVQFPIHLDMPVDQTATTKVQRVQSMKQSLEATLGADNVIIDIQQLQKDEVNNITYFAENAAGEDWDLSDNVGWGPDFADPSTYLDIIKPSVGESTKTYLGFDSGEDNVAAKKVGLYDYEKLVTEAGDETTDVAKRYDKYAAAQAWLTDSALIIPTTSRTGRPILSKMVPFTIPFALSGNKGTSEPVLYKYLELQDKAVTVDEYQKAQEKWMKEKEESNKKAQEDLAKHVK

SEQ ID NO: 3977 - protein, 77 aa, Streptococcus pneumoniae
PKLNFKKRGWLFSQSFEGAKATAIIMSLLETAKRHQLNSEKYLFYLLECLPNEETLVNKEVLEAYLPWTKVVQEKCK

SEQ ID NO: 3978 - protein, 149 aa, Streptococcus pneumoniae; identical to SEQ ID NO: 3463

SEQ ID NO: 3979 - protein, 57 aa, Streptococcus pneumoniae
LPFLVLNLLKLTDAGTKQRSLPLRAGDVLDVSVVVHQLAKPPSLFPGKITDHNKLNL

SEQ ID NO: 3980 - protein, 85 aa, Streptococcus pneumoniae
LVNCEPLEAYRQLEEAELVGCWAHVRRKFFEATPKQADKSSLGAKGLAYCDQLFSLERDWEALPADERLQKRQEHLQPLMEDFFA

SEQ ID NO: 3981 - protein, 142 aa, Streptococcus pneumoniae; identical to SEQ ID NO: 3462

SEQ ID NO: 3982 - protein, 283 aa, Streptococcus pneumoniae
MILITGANGQLGTELRYLLDERNEEYVAVDVAKMDITNEEMVEKVFEEVKPTLVYHCAAYTAVDAAEDEGKELDFAINVTGTKNVAKASEKHGATLVYISTDYVFDGKKPVGQEWEVDDRPDPQTEYGRTKRMGEELVEKHVSNFYIIRTAWVFGNYGKNFVFTMQNLAKTHKTLTVVNDQYGRPTWTRTLAEFMTYLAENRKEFGYYHLSNDATEDTTWYDFAVEILKDTDVEVKPVDSSQFPAKAKRPLNSTMSLAKAKATGFVIPTWQDALQEFYKQEVR

SEQ ID NO: 3983 - protein, 349 aa, Streptococcus pneumoniae
MTEYKNIIVTGGAGFIGSNFVHYVYENFPDVHVTVLDKLTYAGNRANIEEILGNRVELVVGDIADAELVDKLAAQADAIVHYAAESHNDNSLNDPSPFIHTNFIGTYTLLEAARKYDIRFHHVSTDEVYGDLPLREDLPGHGEGPGEKFTAETKYNPSSPYSSTKAASDLIVKAWVRSFGVKATISNCSNNYGPYQHIEKFIPRQITNILSGIKPKLYGEGKNVRDWIHTNDHSSGVWTILTKGQIGETYLIGADGEKNNKEVLELILKEMGQAADAYDHVTDRAGHDLRYAIDASKLRDELGWKPEFTNFEAGLKATIKWYTDNQEWWKAEKEAVEANYAKTQEIITV

SEQ ID NO: 3984 - protein, 198 aa, Streptococcus pneumoniae
MSDNFFGKTLAVRKIDAIPGLLEFDIPVHGDNRGWFKENFQKEKMEPLGFPESFFAAGKLQNNVSFSRKNVLRGLHAEPWDKYISVADDGKVLGSWVDLREGETFGNTYQTVIDASKGIFVPRGVANGFQVLSDTVSYSYLVNDYWALELKPKYAFVNYADPSLGIEWENIAEAEVSEADKNHPLLKDVKPLKKEDLE

SEQ ID NO: 3985 - protein, 289 aa, Streptococcus pneumoniae
MKGIILAGGSGTRLYPLTRAASKQLMPVYDKPMIYYPLSTLMLAGIKDILIISTPQDLPRFKDLLLDGSEFGIKLSYAEQPSPDGLAQAFLIGEEFIGDDSVALILGDNIYHGPGLSKMLQKAAQKEKGATVFGYQVKDPERFGVVEFDTDMNAISIEEKPENPRSNYAVTGLYFYDNDVVEIAKGIKPSARGELEITDINKAYLNRGDLSVELMGRGFAWLDTGTHESLLEASQYIETVQRMQNVQVANLEEIAYRMGYISCEDVLELAQPLKKNEYGQYLLRLIGEA

SEQ ID NO: 3986 - protein, 475 aa, Streptococcus pneumoniae
VGSIVMKLKFLITNLFHVLLSNLITILTSVIVVLILPKIMGVTEYSYWQLYIFYLTYIGFFHLGWIDGIYLKYGGLEYQNLDKKQFYSQILQFSSFLILISFLLFGFNLLTVTDQNAKYIYNMTIISMIVTNLRMLFVYILQMTNRLKDSSIILISDRVIYVILLFLFIIFKWHEYKVMIWADVLGRTFSLLLSFWICKDIVFQSLSEFILDLRESFDNIRVGINLMLSNIASSMIIGIVRMGIQWNWNIETFGKVSLTLSISNLLMTFINAIGLVVFPLLKRTKTENLSKIYSNLRNVLMLIMFAILLIYYPLKIVLDLWLPAYQDALIFMTLIFPMSVYEGKMALVINTYLKALRMERDILKINTLIMLFSMLVTLITTLLLNSLELTVVSIVVLLALRSVIAELILSKKLDVSVKKDIVLEFLLTIVFISSSWYLPIWPAVIVYLLAYTLYLYLKRKDIKMYIEYFRKKIFE

SEQ ID NO: 3987 - protein, 94 aa, Streptococcus pneumoniae
TITAGQIGKYQLEEIKTIVKRNSNTISFLTETSSFLDRISSAITLRKASKTTIDTTVSSKLFNNRVVIRVTNILNNIIKVFILRISLSILNAFK

SEQ ID NO: 3988 - protein, 447 aa, Streptococcus pneumoniae
MLLNFLFIFIFLLIIITFILFEGDLFQPAVILTLAYFISIASALVNRNVWGTELHFKTFGLILLGVATFIIVSLLTKLSYKPKVEGISYKELKEINPSKIIYGILLILNLVMLFLYIHEIQKVVLFSGRGFSNITDLISNYRYLSYYSNEVEDRVSGMINQLAKIIPATTFVSLYIFINNYFITKQIKKNFIYLIPIAIFFVYAIISGGRLPLIRLVIGTLLILYIYSVYGSHKSQLTRSFKMITRSLFAFLMLIVLFFLLKFVLGRSSQEDFISYITRYMGGSIQLFDLFVIDPIRRNKELGAETFSGIYEMLAKLGFDNNIIKGLEWRISPNYYSLGNVYTAIRRYYSDFGVIGIVICQSFTAWLYTLGYEKIRHHSLVTNGQRFRLILLAASFYPLFLNSIEDVFYISMVTIGYGIQIVIFYLVFWVLLKVQVDFNKGKLRINR

SEQ ID NO: 3989 - protein, 328 aa, Streptococcus pneumoniae
MGKSVAILMTTYNGERYLSQQIDSIRSQTFTNWTLFIRDDGSKDKTVEVIQRYSKIDDRIRLVENPSKFHGAYYNFFNLIEYVKNNYQFDYYFFCDQDDIWKEHKLEIQLLRFSKDEMPEMVYSDMSTIDANNKLIDISINNIMGIELPNINNLYFIHAYIWGCTAGFNHALLEMVPSVDIDKDYLYIEKLSHDNYFAKFALEYGKVLFCPEQLVLYRRHGHNVTTSHHFKLSPLNILRKAILGFNELALTHAGVYNQTLYMLKKASEKSPLSDRLLEIQEVIKIGGLKGVRYFCQNRISRKQLVRTIGLYTIMLFGTYKKYIMKELS

SEQ ID NO: 3990 - protein, 241 aa, Streptococcus pneumoniae
MIMSIYKLYKDIERKTMSPAKKAMAKNDYFAFYVGRPLSYLLTVPFLKTNITPNQVSYLSIAPLILGFLTMTFTTNFILLLLAWFLFFLWNLLDGVDGNLARYREQYSKDGSVVDAMAGYVAMVLTYFGAGIVATHLNGSDMYVILGALSGISLIFPRLVMHKYINTVARNESVNNIKDKSNFSTIKLLALNMTSITGIPQVLLLVTILTNQWEFFTLVYFTINFLLMIFSLYSLFKKENV

SEQ ID NO: 3991 - protein, 185 aa, Streptococcus pneumoniae
LKVQEKLKLLKEFIKICSKNKMKYFASGGSLLEAARYKGFIPWNDDMALGLPRKHFEKFINEIDFEKYNKNYILESSEMNLGIFQYKLKSAILILGKSYDVCLNLFLLDRMSELVIDGESGFKVPLYNLEVAVDRSRSIIENRELANELGSVAFQRVQSIFEIKEKVSELENIFMSLGEDDNVNI

SEQ ID NO: 3992 - protein, 314 aa, Streptococcus pneumoniae
MDIVYATDNNFVDVLSASIKSLYTTNSDLDLNLWIIADKVSDRNKEKINRLSKQFAQREINWIENVEIPFKLHLDRGSISSFSRLFLGSVLPSSMSKVLYLDSDIIVMDSLRSILDIDFKDKILYGVNDTFNKEYKQVLGIPIDKPMFNAGVMLINLELWRNNNVEEKFLQVIQKFNGTILQGDLGVLNAVLYNSFGVLPPEYNYMTIFEDLTYEEMIVFKKPINYYSKEEIKNARERIVLRHFTTCFLSLRPWQENSEVAHVEIFKKYYRGTYKQVSPSKLSRIYKILPKKMSLYLLGFIQSKVRPKLYRILK

SEQ ID NO: 3993 - protein, 455 aa, Streptococcus pneumoniae
MNGKLVKPSLAIVQSFLVILLAYLLSTVRETEIVSTTAIVLYILHYFAFYISDYGQDFFKRGYLIELVQTLKYILFFALAISISNFFLEDRFSISRRGMIYFLLLHVLLVYVLNRFIKWYWKRAYPNFKGSKKILLLTATSRVEKVLDRLIESDDVVGELVAVSVLDKPDFQHDYLKVVAEGEIVNFATHEVVDEVFINLPSEKYNIGELVSQFETMGVDVTVNLNAFDCILAHNKQICEMAGLNVVTFSTTFYKTSHVIAKRVIDIIGSLVGLILCGLVSIVLVPLIRKDGGSAIFAQTRIGKNGRHFTFYKFRSMCVDAEEKKRELMEQNTMQGGMFKVDEDPRITKIGHFIRKTSLDELPQFYNVLKGDMSLVGTRPPTVDEYEHYTPEQKRRLSFKPGITGLWQVSGRSEIKNFDEVVKLDVAYIDGWTIWKDIEILLKTVKVVLMKDGAK

SEQ ID NO: 3994 - protein, 226 aa, Streptococcus pneumoniae
MPTLEISQVKLELAKKAEEYYNALCTNLQLSGDDLKVFSITSVKPGEGKTTTSTNIARAFARAGYKTLLIDADMRNSVMSGVFKSRERITGLTEFLSGTTDLSQGLCDTNIENLFVIQAGSVSPNPTALLQSRNFSTMLETVRKYFDYIVVDTAPVGVVIDAAIITQKCDASILVTKAGETKRRDIQKAKEQIEQTGKPCLGVVLNKFDTSVDEYGSYGSYGKKKK

SEQ ID NO: 3995 - protein, 231 aa, Streptococcus pneumoniae
MMKEQNTIEIDVFQVLKTLWKHKLIILLVALVTGAGAFAYSTFIVKPEYTSTTRIYVVNRNQEGKSGLTNQDLQAGTYLVKDYREIILSQDVLEKVATNLKLDMPAKALTSKVQVTVPTDTRIVSISVKDKEPEEASRIANSLREVAAGKIVAVTRVSDVTTLEEARPATTPSSPNVRRNTLVGFLGGAVVTVITVLLIELLDTRVKRPEEVEEVLQVPLLGVVPDLDKMK

SEQ ID NO: 3996 - protein, 259 aa, Streptococcus pneumoniae
LHLSKRLFRTCWRADEMIDIHSHIVFDVDDGPKSREESKALLTEAYRQGVRTIVSTSHRRKGMFETPEEKIAENFLQVREIAKEVASDLVIAYGAEIYYTPDVLDKLENNRIPTLNNSRYALIEFSMNTPYRDIHSALNKILMLGITPVIAHIERYDVLENNEKRVRELIDMGCYTQINSSHVLKSKLFGEPYKFMKKRAQYFLERDLVHIIASDMHNVDGRPPHMAEAYDLVSQKYGEAKAQELFIDNPRKIVMDQLI

SEQ ID NO: 3997 - protein, 484 aa, Streptococcus pneumoniae
VLIMSRRFKKSGSQKVKRSVNIVLLTIYLLLVCFLLFLIFKYNILAFRYLNLVATAFVLLVALIGLLSIIYKKAEKFTIFLLVLSILVSSVSLFAVQQFVGLTNRLNATSNYSEYSLSVAVLADSEIENVTQLTSVTAPTGTDNENIQKLLADIKSSQNIDLTVNQSSSYLSAYRSLIAGETKAIVLNSVFENIIESEYPDHASKIKKIYTKGFIKKVEAPKTSKNQSFNIYVSGIDTYGPISSVSRSDVNILMTVNRDTKKILLTTTPRDAYVPIADGGNNQKDKLTHAGIYGVDSSIHTLENLYGVDINYYVRLNFTSFLKLIDLLGGVDVYNDQEFTALANKKHYSIGNVHLDSEEALAFVRERYSLADGDRDRGRNQQKVIVAILQKLTSTEVLKNYSTIIDSLQDSIQTNMPLETMINLVNAQLESGGTYKVNSQDLKGRGRTDLPSYAMPDSNLYVMEINDSSLASVKTAIQDVLEGR

SEQ ID NO: 3998 - protein, 357 aa, Streptococcus pneumoniae
MKRIQLNMNETKKYLVIKAIAQGKKTKKRACVELNLSERQINRLLLAYQQKEKEAFRHGNRNRKPKHAIPDEIKERILKKYLSYQTYKPNVRHFCELLAEEEGIQLSDTTVRKILYKKNILSPKSHRKTKKRVRKQAKLNPKQPLDNPILPTAENFLEDPKKVHPSRPRKKFAGELIQMDASPHAWFGVETSNLHLAIDDASGNILGAYFDKQETLNAYYHVLEQILANHGIPLQIKTDKRTVFTYQASNSKKMEDDTHTQFGYACHQLGILLETTSIPQAKGRVERLNQTLQSRLPIELERNNIHTLEEANTFLPSYIQTFNEQFGNKTKLSVFEEAPKPSERNLILARLAGESRR

SEQ ID NO: 3999 - protein, 120 aa, Streptococcus pneumoniae
LDWRERVVDSGHHIRFQNRCYIPTEQGKEVYFIRKTKALVIKAFDGDIYLNIADKIYHTKELLNHELYSKNFEQEPEQKKERRKYIPPQTHPWKLTSFKQYLHKNKKDYEEFKGGFFSTC

SEQ ID NO: 4000 - protein, 316 aa, Streptococcus pneumoniae
MNSIRKTLNKNQNKKKKDASISLHKPIRGNSHLSNNIFIKIKRIMKSLKEDFSVRAEKYENYQETFQGPNSFSKTDPDATFMRMKEDHMKNGQLKAAYNLQIATENQFVLHYDVFSNPTDTKTLLPFLETYPHDLKTVVADAGYGSEENLLRLDEKEVNHLIKYAMFDKEQKRGYKQSARNLANWHYNDKEDSYTHPDGWYYRFHHTKHQKTQTDFQQEIKVYYADEPESAPQKGLYMNEGYQNLKAKECQALLSPQGRQIFAQRKIDVEPVFGQIKACLGYKRCNLRGKRQVRIDMGLVLMANNLLKYNKRTTQN

SEQ ID NO: 4001 - protein, 178 aa, Streptococcus pneumoniae
MKLTYDDKVQIYELRKQGYSLEKLSNKFGINNSNLRYMIKLIDRYGIEFVKKGKNQYYSPELKQEMIDKVLHANWSQDRVSLKYALPNRGMLPNWLAQYKKNGYTIVEKTRGRPAKMERKRKKTWEEMTELERLQEENERLRTEVAYLKKLKELEERDEALERERQKQLEKWFQEDFD

SEQ ID NO: 4002 - protein, 160 aa, Streptococcus pneumoniae
MVSGGFRLDFLLETARLARSTYYYQLKQLDGVDKDKEIKTEIQAIYNEHKGNYGYRRIHLELRNRGFVVNHKKVQRLMKVLGLTARIRRKRKYSSYQGEIGKKAENLIQRQFEATKPMEKCYTDVTEFAIPNSTQKLYLSPVLDGFNSEISPIIFQLHQT

SEQ ID NO: 4003 - protein, 277 aa, Streptococcus pneumoniae; identical to SEQ ID NO: 3261

SEQ ID NO: 4004 - protein, 536 aa, Streptococcus pneumoniae
MQEKWWHNAVVYQVYPKSFMDSNGDGVGDLPGITSKLDYLAKLGITAIWLSPVYDSPMDDNGYDIADYQAIAAIFGTMEDMDQLIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLVRADFELLDTADKVFAYIRKDGDRRFLVVANLSNDKQNFSVDGKVRSVLIENTAAKEVLEKQVLAPWDAFCVEMTD

SEQ ID NO: 4005 - protein, 494 aa, Streptococcus pneumoniae
MKNQAFSSEQYLNLQRDHILERIIQLDGKLYIEFGGKMLEDFHAARVLPGYEPDNKIKLLQELKEQVEVVIAINASNIEHSKARGDLGISYDQEVLRLIDKFNELGIFVGSVVITQYTGQPAADAFRNQLEKNGIDSYLHYPIKGYPTDMDHIISSKGMGKNDYIKTSRNLIVVTAPGPGSGKLATCMSNMYHDQINGIKSGYAKFETFPVWNLPLHHPVNLAYEAATADLDDVNMIDPFHLQTYGETTVNYNRDIEIFPVLKRMLERILGKSPYASPTDMGVNMVGFAITDDEAAVEASKQEIIRRYYQTVLDFKAEKVGEAAVKKIELLMNDLGITPADRKVAVVARQKAEETGGPALAFELPNGEIVTGKNSELFGPTAAALINAIKKSADIAKEVKLIEPEVVKPIQGLKIDHLGSRNPRLHSNEILIALAITATENPDAARAMEELGNLKGSEAHSTIILTDEDKNVLRKLGINVTFDPYYQYDRLYRK

SEQ ID NO: 4006 - protein, 160 aa, Streptococcus pneumoniae
MSKEVIVESFELDHTIVKAPYVRLIGEETGPKGDIISNYDIRLVQPNEDSIPTAGLHTIEHLLAKLIRTRIDGMIDCSPFGCRTGFHMIMWGRHTSAKIAAVIKDSLKEIAETTTWEDVPGTTIESCGNYKDHSLFSAKEWAKLILEQGISDDAFERHVI

SEQ ID NO: 4007 - protein, 701 aa, Streptococcus pneumoniae
MNNNFNNFNNMDDLFNQLMGGMRGYSSENRRYLINGREVTPEEFAHYRATGQLPGNAETDVQMPQQASGMKQDGVLAKLGRNLTAEAREGKLDPVIGRNKEIQETSEILSRRTKNNPVLVGDAGVGKTAVVEGLAQAIVNGDVPAAIKNKEIISIDISGLEAGTQYRGSFEENVQNLVNEVKEAGNIILFFDEIHQILGAGSTGGDSGSKGLADILKPALSRGELTVIGATTQDEYRNTILKNAALARRFNEVKVNAPSAENTFNILQGIRDLYQQHHNVILPDEVLKAAVDYSVQYIPQRSLPDKAIDLVDVTAAHLAAQHPVTDVHAVEREIETEKDKQEKAVEAEDFEAALNYKTRIAELERKIENHTEDMKVTASVNDVAESVERMTGIPVSQMGASDIERLKDMAHRLQDKVIGQDKAVEVVARAIRRNRAGFDEGNRPIGSFLFVGSTGVGKTELAKQLALDMFGTQDAIIRLDMSEYSDRTAVSKLIGTTAGYVGYDDNSNTLTERVRRNPYSIILLDEIEKADPQVITLLLQVLDDGRLTDGQGNTVNFKNTVIIATSNAGFGYEANLTEDADKPELMDRLNPFFRPELLNRFNAVIEFSHLTKEDLSKIVDLMLAEVNQTLAKKDIDLVVSQAAKDYITEEGYDEVMGVRPLRRVVEQEIRDKVTDFHLDHLDAKHLEADMEDGVLVIREKA

SEQ ID NO: 4008 - protein, 79 aa, Streptococcus pneumoniae
LFFDFHCVFKHKNTLKHQGAILTSNIKLLGSGDLLEAQLPKRRSQPSTRSKDFLYQTIPQAQNGDVQASYGKYVYHLSV

SEQ ID NO: 4009 - protein, 326 aa, Streptococcus pneumoniae
MFISISAGIVTFLLTLVGIPAFIQFYRKAQITGQQMHEDVKQHQAKAGTPTMGGLVFLITSVLVAFFFALFSSQFSNNVGMILFILVLYGLVGFLDDFLKVFRKINEGLNPKQKLALQLLGGVIFYLFYERGGDMLSVFGYQVHLGIFYIVFALFWLVGFSNAVNLTDGVDGLASISVVISLSAYGVIAYVQGQMDILLVILAMIGGLLSFFIFNHKPAKIFMGDVGSLALGGMLAAISMALHQEWTLLIIGIVYVFETTSVMMQVSYFKLTGGKRIFRMTPVHHHFELGGLSGKGNPWSEWKVDFFFWGVGLLASLLTLAILYLM

SEQ ID NO: 4010 - protein, 750 aa, Streptococcus pneumoniae
MKWTKRVIRYATKNRKSPAENRRRVGKSLSLLSVFVFAIFLVNFAVIIGTGTRFGTDLAKEAKKVHQTTRTVPAKRGTIYDRNGVPIAEDATSYNVYAVIDENYKSATGKILYVEKTQFNKVAEVFHKYLDMEESYVREQLSQPNLKQVSFGAKGNGITYANMMSIKKELEAAEVKGIDFTTSPNRSYPNGQFASSFIGLAQLHENEDGSKSLLGTSGMESSLNSILAGTDGIITYEKDRLGNIVPGTEQVSQRTMDGKDVYTTISSPLQSFMETQMDAFQEKVKGKYMTATLVSAKTGEILATTQRPTFDADTKEGITEDFVWRDILYQSNYEPGSTMKVMMLAAAIDNNTFPGGEVFNSSELKIADATIRDWDVNEGLTGGRMMTFSQGFAHSSNVGMTLLEQKMGDATWLDYLNRFKFGVPTRFGLTDEYAGQLPADNIVNIAQSSFGQGISVTQTQMIRAFTAIANDGVMLEPKFISAIYDPNDQTARKSQKEIVGNPVSKDAASLTRTNMVLVGTDPVYGTMYNHSTGKPTVTVPGQNVALKSGTAQIADEKNGGYLVGVTDYIFSAVSMSPAENPDFILYVTVQQPEHYSGIQLGEFANPILERASAMKDSLNLQTTAKALEQVSQQSPYPMPSVKDISPGDLAEELRRNLVQPIVVGTGTKIKNSSAEEGKNLAPNQQVLILSDKVEEVPDMYGWTKETAETLAKWLNIELEFQGSGSTVQKQDVRANTAIKDIKKITLTLGD

SEQ ID NO: 4011 - protein, 105 aa, Streptococcus pneumoniae
MAEKMEKTGQILQMQLKRFSRVEKAFYFSIAVTTLIVAISIIFMQTKLLQVQNDLTKINAQIEEKKTELDDAKQEVNELLRAERLKEIANSHDLQLNNENIRIAE

SEQ ID NO: 4012 - protein, 316 aa, Streptococcus pneumoniae
MTKEFHHVTVLLHETIDMLDVKPDGIYVDATLGGAGHSEYLLSKLSEKGHLYAFDQDQNAIDNAQKRLAPYIEKGVVTFIKDNFRHLQARLREAGVQEIDGICYDLGVSSPQLDQRERGFSYKKDAPLDMRMNQDASLTAYEVVNHYDYHDLVRIFFKYGEDKFSKQIARKIEQAREVKPIETTTELAEIIKLVKPAKELKKKGHPAKQIFQAIRIEVNDELGAADESIQQAMDMLALDGRISVITFHSLEDRLTKQLFKEASTVEVPKGLPFIPDDLKPKMELVSRKPILPSAEELEANNRSHSAKLRVVRKIHK

SEQ ID NO: 4013 - protein, 64 aa, Streptococcus pneumoniae
MNRVKEFRKELGISQLELAKDIGVSRQTINMIENDKYNPTLELCLNLARSLQTDLNSLFWKEDF

SEQ ID NO: 4014 - protein, 141 aa, Streptococcus pneumoniae
LRVFIGQKEWNKISENHQIKEDDKDLVPNTIGLTPFVFVKGTRNTVCAFDQFFSEGFFFHEFAPFLKIFLPKETVEVSLEAAGEIETEFQSWIVLVVFNHIDGLSRDTDILGELELGNAQFLAKFFHTIHLVSFLICVVYI

SEQ ID NO: 4015 - protein, 93 aa, Streptococcus pneumoniae
MKKETFTEKLIKRTYGISGPLDEYKRREADSIGNQVFIVLFYLMIFGNLIPLLLAYKYPQEVALIYPPLILVIALIAAGYVTYQMKKNRHHSH

SEQ ID NO: 4016 - protein, 84 aa, Streptococcus pneumoniae
MLNEKESKQLHYPGLKAGLFFGLWMFFITPLLSILIDEGQDYFHSLLTIRNGVSSILGSIFFGASIQFLISRRIAKTKKNQDED

SEQ ID NO: 4017 - protein, 80 aa, Streptococcus pneumoniae
MKKEKKQLRYPGLKAGSIYGTVIFFIIPLIDTLTSENPNFISSLLNTKHIFKTMLGAFFFGVMIHIVDSLRIARAKKDQD

SEQ ID NO: 4018 - protein, 111 aa, Streptococcus pneumoniae
MKSLARLLNIHVFISIFLFFALISGAVSHTVLLLLLLFLPALNKGLEKIQSKRIPVLNAALFFLLISFPQLLTNPVQWKFSIFLVVTIISSLAYFYNFYQVVKEVDQKQLI

SEQ ID NO: 4019 - protein, 63 aa, Streptococcus pneumoniae
TFMFLSVFSFSLPLFQELFLIQFYYSYSSFFLRSIKDLRKYNQNGYLSSTQPSSFSSYPFHNF

SEQ ID NO: 4020 - protein, 333 aa, Streptococcus pneumoniae
LEKKLTIKDIAEMAQTSKTTVSFYLNGKYEKMSQETREKIEKVIHETNYKPSIVARSLNSKRTKLIGVLIGDITNSFSNQIVKGIEDIASQNGYQVMIGNSNYSQESEDRYIESMLLLGVDGFIIQPTSNFRKYSRIIDEKKKKMVFFDSQLYEHRTSWVKTNNYDAVYDMTQSCIEKGYEHFLLITADTSRLSTRIERASGFVDALTDANMRHASLTIEDKHTNLEQIKEFLQKEIDPDEKTLVFIPNCWALPLVFTVIKELNYNLPQVGLIGFDNTEWTCFSSPSVSTLVQPSFEEGQQATKILIDQIEGRNQEERQQVLDCSVNWKESTF

SEQ ID NO: 4021 - protein, 633 aa, Streptococcus pneumoniae
MKEERRQFFERIDGNQCRDYILSHCSKDYEKVKSSLERLMDNRFMFDSPWDMEPCSKIHQNQPMVWDQVFEDDPEWAYMLNRQEYLLQFMIGYVVEGDKDYIQKCKFFLFDWIEQVREFSPQSLMTRTLDTGIRSFTWLKLLLLLLKFDLLEEKELEKILVSLEKQIDFMKSYYRAKYTLSNWGILQTIPMLAIYHFFSDKMDLEEAYHFASEELKQQIETQILGDGSQFEQSILYHVEVYKALLDLCLLLPDLQDSYQELLEKMATYIQMMTGLDGRTLAFGDSDSTETTEMLSLSAVVLNKEDLLNGLDVKVDLLSLLFLGREKVKRLQEFERRAWQPKSMIFEDSGHVCIKDEHRYLFFKNGPLGSAHSHSDENSFCLQYQGQPIFIDAGRYSYREIYERYLLKSAWSHSTCIVDGKAPERITGSWEYEYYPHSLFCHHKEREGVHYIEGAYWSAEPDLPYLHKRKILMLVEDVWLLVDDIRCQGQHEALTQFILDKDVTYQDGKINQLRLWSEVDFDLEDTIISPKYNELERSSKLTKRQFFENQMLDYTIIAHESFEIIRHSVYQTDDREVENALAFEVKNDETDKLILLLSEDICVGEKLCLVDGTKMRGKCLVYDKINERMIRLQC

SEQ ID NO: 4022 - protein, 97 aa, Streptococcus pneumoniae
MDTTLFYGIVIVLAVSPLLLSSFHSIRQQKLLRKQMEQRQEYLASLTSGDEVLLLSGIHGKIISIQDDLVSLQIAKGVVIYVEKESVMGKTKELLFK

SEQ ID NO: 4023 - protein, 272 aa, Streptococcus pneumoniae
MTGSNKLTKRDYLKTSLRAFFCQNGFNYSNYQGLGYANVMYPALKKHYGEDQEGFYQALEENCEFYNTNPHFLPFITSLHLVMLENGRPAKETRSIKMALMGPLAGIGDSLSQFCLAPLFSTIAASFAQKSLVVGPILFFLAMNTILTAIKLSTGLYGYKLGTTVIDKLSEQMATISRIANIIGVTVIAGLAATSVKIMVPITFAAGEVKADAKQSIVSIQGMLDKVAPALLPALFTLLVYYLIKEKKWTTYKLVILTVIIGIIGSWLKIIA

SEQ ID NO: 4024 - protein, 259 aa, Streptococcus pneumoniae
MSINVFQAILIGLWTAFCFSGMLLGIYTNRCIVLSFGVGIILGDLPTALAMGAIGELAYMGFGVGAGGTVPPNPIGPGIFGTLMAITSAGKVSPEAALALSTPIAVAIQFLQTFAYTVRAGAPETAMKHLKNHNLKKFKFTLNATIWLFAFIGFTLGCLGALSMDTLLKLVDYIPPVLLTGLTVAGKMLPAIGFAMILSVMAKKELIPFVLLGYVCAAYLNIPTIGIAIVGTIFALIEFYNKPKTADHVVEEEAHDDWI

SEQ ID NO: 4025 - protein, 163 aa, Streptococcus pneumoniae
MTMPNIIMTRIDERLIHGQGQLWVKYLGCNTVIVANDEVSTDKMQQTLMKTVVPDSVAMRFFPLQKVIDIIHKANPAQTIFIVVKNVKDALTLVEGGVPIKEINIGNIHNATGKEQVTRSIFLGEEDKVALKELSQTHQVTFNTKTTPTGNDGAVQVNIMDYI

SEQ ID NO: 4026 - protein, 335 aa, Streptococcus pneumoniae
MDNTEWTNGFWTGELWLAYEYSQQDAFKNIAHKNVLSFLDRVNKRVELDHHDLGFLYTPSCMAEYKINGDGEAREATLKAADKLIERYQEKGGFIQAWGDLGKKEHYRLIIDCLLNIQLLFFAYQETGDQKYYDIAESHFYASANNVIRDDASSFHTFYFDPETGQPFKGVTRQGYSDDSCWARGQSWGVYGIPLTYRHLKDESCFDLFKGVTNYFLNRLPKDHVSYWDLIFNDGSDQSRDSSATAIAVCGIHEMLKHLPEVDADKDIYKHAMHAMLRSLIEHYANDQFTPGGTSLLHGVYSWHSGKGVDEGNIWGDYYYLEALIRFYKDWNLYW

SEQ ID NO: 4027 - protein, 145 aa, Streptococcus pneumoniae
LDIEQAVDNQTVMLFLAQVSPSLNKTTFFLIAFNQLICSFQGCFSSLSISIYLIFSHTRRCVQEAEIMVIQFYSLIDTIQERKNIFMSDVFKCILLTVFISQPQFSCPETIGPFRVIHDWIDIIKGSWCREIFLEIVKVELLTAE

SEQ ID NO: 4028 - protein, 144 aa, Streptococcus pneumoniae
MKIVLVGHGHFATGIYSSLQLIAGNQENVEAIDFVEGMSADELKQKILLAISNEEEVLILSDLLGGSPFKVSSTIMGENPAKTMNVLSGLNLAMLMEAVFARMAHSFDEVVNKSVVAAQGGVVNGKELFSTDAEEEEEDFESGI

SEQ ID NO: 4029 - protein, 217 aa, Streptococcus pneumoniae
MTNTSFSIEQFSLKGKIALITGASYGIGFAIAKSYAEAGATIVFNDINQDLVNKGIEAYREVGIEAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEEWFSPPI

SEQ ID NO: 4030 - protein, 124 aa, Streptococcus pneumoniae
MWPLTKLLASLARKTAGPIKSSGFPQRAAGVFAMMNWSNGWREPLFLQLTKRCCLRSGNITRSNSVTLDIGSTVFRRNVAGQHFQAPFSSSISANCFTSQFAHHRTNIDNLSMPFLYHRRNNCL

SEQ ID NO: 4031 - protein, 97 aa, Streptococcus pneumoniae
PATLRLNTVEPISNVTELDRVILPLLKQHLFVSCKKSGSRHPFDQFIIAKTPAARWGNPEDLMGPAVFLASDASNFVNGHILYVDGGILAYIGKQPE

SEQ ID NO: 4032 - protein, 213 aa, Streptococcus pneumoniae
MKIALINENSQASKNHIIYDSLKEATDKKGYQLFNYGMRGEEGESQLTYVQNGLMAAILLNTKAVDFVVTGCGTGVGAMLALNSFPGVVCGLAVDPTDAYLYSQINGGNALSIPYAKGFGWGAELTLKLMFERLFAEEMGGGYPRERVIPEQRNARILNEVKQITHNDLMTILKIIDQDFLKDTISGKYFQEYFFENCQDDEVAAYLKEVLAK

SEQ ID NO: 4033 - protein, 333 aa, Streptococcus pneumoniae
MTKILLFGEPLIRISPLDATSIGDHVASSTYFGGSEINIACNLQALGISTKVFTALPANEIGDRFLTFLKQHQIDTSSICRLGDRIGLYYLENGFGCRQSEVFYDRKHTSISQIRPNMLDMDSLFQGISHFHFSGITVAIGQEVRAILLLLLEEAKRRGIVVSMDLNLRTKMISVLEAKYEFSKFARFTDYCFGIDPLMIDDQNLEMFPRDSASLEEVENRMRLLKEAYGFKAIFHTLRSSDEQDKNVYQAYALEERFEESVQLKTAVYQRIGSGDAFISGALYQLLHHSSLKTTIDFAVASATLKCTLPGDHLSTSATSIENLLANAQDIIR

SEQ ID NO: 4034 - protein, 209 aa, Streptococcus pneumoniae
MTKSDTIIELKKQKIVAVIRGNTKEEGLQASIACIKGGIKAIEIAYTNQYAGQIIKELVDLYQDDQSVCIGAGTVLDAVTARDAILAGANYVVSPSFHAETAKMCNLYSTPYIPGCITLTEITTALEAGSEIIKLFPGSTLSPAYISAVKAPIPQVSVMVTGGVGLNNIPQWFAAGADAVGIGGELNKLASQGNFDRISEIAQQYITLR

SEQ ID NO: 4035 - protein, 117 aa, Streptococcus pneumoniae
VEVFYHIVFTPKYRRKVIYNQYRSSLGEIFHRLCSYKGVEMIEGHLMPDHVHMLVSIPSRLSVSSFMGYLKGKSALMMFDKHANLKYKFGNRHFWAEGYYVSPVGLNEATIKKYSQD

SEQ ID NO: 4036 - protein, 1078 aa, Streptococcus pneumoniae
LILQYVYWSVYMQTKTKKLIVSLSSLVLSGFLLNHYMTVGAEETTTNTIQQSQKEVQYQQRDTKNLVENGDFGQTEDGSSPWTGSKAQGWSTWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTARLDDWNGIIAGNQYYDSKNEQMAKLNQELEGKVADSLSSISSQADRTYLWEKFSNYKMSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 4037 - protein, 158 aa, Streptococcus pneumoniae
MTSLYDFSVLNQNNQATPLDSYRGKVLLIVNTATGCGLTPQYQGLQELYERYQDQGFEILDFPCNQFMGQAPGSAEEINAFCSLHFQTTFPRFAKIKVNGKEADPLYVWLKDHKSGPLGKRIEWNFAKFLISRDGQVFERFSSKTDPKQIEEAIQTLL

SEQ ID NO: 4038 - protein, 737 aa, Streptococcus pneumoniae
LKIFKGEFYRISVLTDKLVRLEYSQTGSFEDRTTQLIYNRDFGQVSLDYIETSNVLDIMTDYFHLHFNKGEFNAENLFIELKGNFAVYGSRWYFGESIETLKGTARTLDKADGAISLEDGIISRNGIALLDDSQGFIWDEQSGYIERENQIDLYFFAYGHDYRGAIRDFYHLTGSTPLLPRYALGNWWSRYWPYTSDEYLDLIDRFETEKIPLSIGVLDMDWHITDIPARFGSGWTGYSWNRNLIPNPEQLLQQLHDRKLKLSLNVHPADGIRAYEEAYPQIAKRLGLNVELEEPAIFDFFNPSFREAYFKDVHYELEKQGVDFWWIDWQQGTQGMLDPLWLLNHYHYQDSCKNAEGGLILSRYAGPGSHRYPVGFSGDTIISWNSLRFQPYFTATASNIGYSWWSHDIGGHMLGDYDEELQTRWLQFGVFSPITRLHSSRSPFNSKEPWFFSETTSKIMKKYLRLRHQMIPYLYTMNVKTHEEGAPLISPIYYFYPENDESYNVPNQYFFGTELMVAPIVEKMDLTFQSAKVDVWFPEGEWYDFFSEKKYTGGVKLSVYRDISTTPVFAKSGAIIPLVGSEIGMGVDLPEVVDWYVFPGKQHSFEMLEDQNGQRYKTRLSIDWEMGMVELALQGDSSIVPSNRKHRIHFKGTNVSIIELPNKNDTAKFEWKDNKRTSLNDEVFRLLKTASLPYELKDRLLNQFINAKNSHDLMNILHHQDKELRGRLLEMIFTSQN

SEQ ID NO: 4039 - protein, 60 aa, Streptococcus pneumoniae
LLFYYCIVFYDNILYFIVFLNNSSSLFINYSNYFLFCFIPYIAKKYEKAEKNILKRPLHC

SEQ ID NO: 4040 - protein, 448 aa, Streptococcus pneumoniae
MDQQNGLFGFLENHVMGPMGKLAQFKVVRAITAAGMAAVPFTIVGSMFLVFSILPQAFSFWPIVADIFSASFDKFRSLYMVANYATMGSLSLYFVLSLAYELTKIYAEEEELNMNPLNGALLALMAFVMTVPQIIFDGGMMKTVTSLKEGAVIADGWAMGNGVARFGTTGIFTAIIMAIVTVLIYRMCVKHNWVIKMPEAVPEGVSRGFTALVPGFVVAFVVIFINGLLVAMGTDIFKVIAIPFGFVSNLTNSWIGLMIIYLLTQLLWIVGIHGANIVFAFVSPIALANMAENAAGGHFAVAGEFSNMFVIAGGSGATLGLCLYIAFASKSEQLKAIGRASVVPALFNINEPLIFGLPIIYNPALAIPFILAPMVTATIYYVANSLNFIKPIIAQVPWPTPVGIGAFLGTADLRAVLVALVCAFAAFLVYLPFIRVYDQKLVKEEQGI

SEQ ID NO: 4041 - protein, 168 aa, Streptococcus pneumoniae
MDKKERQKIEQQRREMALTNTFFNRYLLLRYSIALFFFGNIYWLLNQFINPSPIIIFPIMLIVFSILATVEQFKLYGNRKEKLGITLMFVRIQMLISIGLLVLTWTSWFKNLFPIFENNQVARLFVFVVLLLGLVLSLLDIRRIKKIYKRTDKVYQQFVQLEKNSLSL

SEQ ID NO: 4042 - protein, 104 aa, Streptococcus pneumoniae
MNQEELQVAAFEIILHSGNARSEIHEAFAKMREGSFDDAESKLNQSNEIILEAHHAQTKLLQEYASGVEIKIEIIMVHAQDHLMTTMTLLEVAKEMLALYKKVN

SEQ ID NO: 4043 - protein, 659 aa, Streptococcus pneumoniae
MNVLNIKEKDILQFLIKNKERFVTSKELAEYLSCSDRTVRNVLKLIEKTMIIQGVRLISKQGQGYQIFFENQGAYQEFRQTYELEEDYTKTAVSKGDDRLVFILNKLLFEQVPVLFDDLADELYVSRSTLSHDFRKIRVMLSEYNLSIESRANKGVYVSGEERDKRRFIINYFLENQFFKTIHCYVKFNFFDQTVPLEEFARIVLDECQEANLKLSDFVLQNLVVHIALSVIRLKSGFEIKNIDCQMTDDATERKVAQRILSKVREVTNQEFPVQEIDYITLHLLAKSQQCQKNQKNISEEVLKKSLFKTFQNLGLDDMYNFSSDFQLIEGLITHLMTLQVRLESRITLNNPLVDEIKQNYSDIFFMTREILANMDKFLEWTISDDEVAYVSLHFLAAMERSKESTKFNILAICATGFGAAQMLRNRLETEFGKRVEVVDVIGYYELNQEKLKGIDFIVSAVDLSNLYFQIPVFKVSVFLKSDEMEMIRKAMDQMQVSSYVPSSKINKFENNGFRQYFSKENFLICTESDKVNLLEKMVEGLSVGESNEFEQSLLYGIKQREELSSVVFSEKIAVPHPIQPFGTEGKVSVAICKDSLLWDNQSSYVQLVFLLSPSIYGNEGLATVTKKIVSLTENDELQNQLISCNNFEDFINIFEKIK

SEQ ID NO: 4044 - protein, 113 aa, Streptococcus pneumoniae
LDLRKGENIMAKALIICAAGMSSSLMAQKTTEFLKGKGKDIVVDAISATEGGKAIAAAAFDLYLVSPQTKMYFKQFEEAGSKAGKPVVQIPPQAYIPIPMGIEKMANLILENI

SEQ ID NO: 4045 - protein, 79 aa, Streptococcus pneumoniae
MIGSIAAILTTFAFLPQVFRVVKTKDTGSIALGMYVMQVIGIALWLAHGIRIGDLPLILANSVSFLLSGIILFYKLKYK

SEQ ID NO: 4046 - protein, 492 aa, Streptococcus pneumoniae
LRFIIRVSKSGGKKMTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVIFKRYKDKVKYWMTFNEINNQANYQEDFAPFTNSGIVYEEGDNREAIMYQAAHYELVASARAVKIGHEINPDFQIGCMIAMCPIYPATCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDKVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 4047 - protein, 121 aa, Streptococcus pneumoniae
LKDDFGGYKMTLTIHVYYKGDGDSAIKFAREMLDSGLVEEIRNQKGNLKYEYFLPIEKEGTILLIDQWINQETLDKHYQSKTMQKILDLRKKYHLQMQVERYIEDDSGMPESDKSFIDTGN

SEQ ID NO: 4048 - protein, 68 aa, Streptococcus pneumoniae
MDNARFHRMGKLELLCEEFGHKLLPLPPYSSEYNPIEKTWAHIKKHLKKVLPSCNTFYEALLSCSCFN

SEQ ID NO: 4049 - protein, 130 aa, Streptococcus pneumoniae
MSQAQYAGTGRRKNAVARVRLVPGTGKITVNKKDVEEYIPHADLRLVINQPFAVTSTVGSYDVFVNVVGGGYAGQSGAIRHGIARALLQVDPDFRDSLKRAGLLTRDSRKVERKKPGLKKARKASQFSKR

SEQ ID NO: 4050 - protein, 148 aa, Streptococcus pneumoniae
MNKTTFMAKPGQVERKWYVVDATDVPLGRLSAVVASVLRGKNKPTFTPHTDTGDFVIVINAEKVKLTGKKATDKIYYTHSNHPGGLKQISAGELRSKNAVRLIEKSVKGMLPHNTLGRAQGMKLKVFVGAEHTHAAQQPEVLDISGLI

SEQ ID NO: 4051 - protein, 121 aa, Streptococcus pneumoniae
LITITKSPVSVCGVNVGLFFPRSTLATTAERRPSGTSVASTTYHLRSTWPGLAINVVLFMISPIYSSIFVYGDGCSFPSKSIWKVPGPFKWGKQYRLLSYQISPLKVNRYEKYFSVTSQSN

SEQ ID NO: 4052 - protein, 105 aa, Streptococcus pneumoniae
MAFTNTHMRSASFGIVTSLPDDIIDSFWYIIDHFLKNVFELEEELEFQLLNNQGKITFHFSSQHLPTAIDFDFNHPFDPRYPPRVLVLDMDGRETILLPEENDLF

SEQ ID NO: 4053 - protein, 130 aa, Streptococcus pneumoniae
LTNCELVGIYILKESSVLATEPWGGVEQDSFANQVVEVETWLPAQDLLETLLAIESELGRVREVHWGPRLIDLDLLFVEDQILYTDDLILPHPYIAERLFVLESLQEIAPHFIHPILKQPIRNLYDALKK

SEQ ID NO: 4054 - protein, 169 aa, Streptococcus pneumoniae
MDQLQIKDLEMFAYHGLFPSEKELGQKFVVSAILSYDMTKAATDLDLTASVHYGELCQQWTTWFQETSEDLIETVAYKLVERTFESYPLVQEMKLELKKPWAPVHLSLDTCSVTIHRRKQRAFIALGSNMGDKQANLKQAIDKLRARGHLYSQRVQCLSDGALGWSGAG

SEQ ID NO: 4055 - protein, 184 aa, Streptococcus pneumoniae
MDTQKIEAAVKMIIEAVGEDANREGLQETPARVARMYQEIFSGLGQTAEEHLSKSFEIIDDNMVVEKDIFFHTMCEHHFLPFYGRAHIAYIPDGRVAGLSKLARTVEVYSKKPQIQERLNIEVADALMDYLGAKGAFVVIEAEHMCMSMRGVRKPGTATLTTVARGLFETDKDLRDQAYRLMGL

SEQ ID NO: 4056 - protein, 440 aa, Streptococcus pneumoniae
MKEIENNQWIANYRTDQPHFGLERMVELLALRGNPHLKLKVLHIGGTNGKGSTIAFLKKMLEKLGLRVGVFSSPYLIHYTDQISINGESISEVRLEALMADYQSLLEGEAVANLQGTTEFEIITALAYDYFASEQVDVAIMEVGMGGLLDSTNVCQPILTGITTIGLDHVALLGDTLEAIAEQKAGIIKQGMPLVTGRIAPEALAVIDRIAEGKDAPRLAYGTDYQVRHQESVVTGEVFDYTSAVRQGRFQTSLLGLYQIENAGMAIALLDTFCQEDGRELASNDFLGQALEETSWPGRLEIVSRDPLMILDGAHNPHAIKALLVTLQERFADYHKEILFTCIKTKALEDMLDLLGAMPDTELTLTHFADSRATDENVLKEAAKSRNLSYQDWHDFLEQNLTDKKEEKQTVRIVTGSLYFLSQVRAYLMERKNENGYTKD

SEQ ID NO: 4057 - protein, 326 aa, Streptococcus pneumoniae
MMKSLEGVIDMSSKANHAKTAICGIINVTPDSFSDGGQFFALEQALQQARKLIAEGASMLDIGGESTRPGSSYVEVEIEEEIQRVVPVIKAIRKESDVLISIDTWKSQVAEAALAAGANLVNDITGLMGDEKMAHVIAKDGAKVVIMFNLVMARPQHPSSLIFPHFGFNQAFTEEELADFETLPIEELMETFFERALARANQAGIAQENILLDPGIGFGLTKKENLLLLRDLDKLHQKGYPIFLGVSRKRFVINILEENGFEVNPETELGFHNWDTASAHVTSIAARQGVEVVRVHDVASHKMAVEIASAIRLADEAENLDLKQYK

SEQ ID NO: 4058 - protein, 235 aa, Streptococcus pneumoniae
MKDKTIWQEVLNRGKWVLILLVAFVLSQFPIGLALFLANKQFPILQSGLLVGALSIVVLIVFIIGARKTQLATFNLSFFKAKDLARLVLSYLVIFATNLLGSLLLRLTNEVTTNNQSILNGIVQNSSLISTFFLLVLIAPICEEILCRGIIPKKIFRGKEKLGFVVGAIVFALLHMPTNLPSVIIYGGMSTVLTWTAYKTERLEMSILLHMILNGIAFCLLALLVLISRNLGLSF

SEQ ID NO: 4059 - protein, 61 aa, Streptococcus pneumoniae
LVQSRLAGKKLKSRSYSELYHSVLIGYWLLPHLLVEAGVNPRDLSQKSPDNSVPSEPSLLP

SEQ ID NO: 4060 - protein, 493 aa, Streptococcus pneumoniae
MINDIILLLFVKIKRRLMMDKLFKLKENGTDVRTEVLAGLTTFFAMSYILFVNPQILSQTGMPAQGVFLATIIGAVAGTLMMAFYANLPYAQAPGMGLNAFFTFTVVFGLGYSWQEALAMVFICGIISLIITLTNVRKMIIESIPNALRSAISAGIGVFLAYVGIKNAGLLKFTIDPGNYTVVGEGADKAQATIAANSSAVPGLVSFNNPAVLVALAGLAITIFFVIKGIKGGIILSILTTTVLAIAVGLVDLSSIDFANNHVGAAFEDLKTIFGAALGSEGLGALVSDTARLPETLMAILAFSLTDIFDTIGTLIGTGEKVGIVATNGENHQSAKLDKALYSDLIGTTVGAIAGTSNVTTYVESAAGIGAGGRTGLTALVVAICFALSSFFSPLLAIVPTAATAPILIIVGIMMLSNLKNIPWDDMAEAVPAFFTSIFMGFSYSITQGIAVGFLTYTLTKVVKGQAKDVHVMIWILDALFILNYISMALSMV

SEQ ID NO: 4061 - protein, 270 aa, Streptococcus pneumoniae
MTKKIIAVDLDGTLLNSDSQISDFTKRTIKKVAEKGHQVIITTGRPYRMSKDFYRELGLDTPMINFNGSLTHLPDQVWDFEKCLTVDKKYLLDMVQRSEDIQADFIAGEYRKKFYITNPNEEIANPKLFGVEAFQPEDQFQPELVTKDPNCILLQTRASDKYALAKDMNAFYQHQLSINTWGGPLNILECTPKGVNKAFALDYLLKIMNRDKKDLIAFGDEHNDTEMLAFAGKGYAMKNANPELLPYADEQISLSNDQDGVAKTLQDLFL

SEQ ID NO: 4062 - protein, 310 aa, Streptococcus pneumoniae
MKAVVVNPESTGVAIEEKVLRPLETGEALVEVEYCGVCHTDLHVAHGDFGQVPGRVLGHEGIGIVKEIAPDVKSLKVGDRVSVAWFFEGCGTCEYCTTGRETLCRTVKNAGYSVDGGMAEQCIVTADYAVKVPDGLDPAQASSITCAGVTTYKAIKEAKVEPGQWVVLYGAGGLGNLAVQYAKKVFNAHVIAVDINNDKLALAKEVGADIVINGLEVEDVAGLIKEKTDGGAHSAVVTAVSKVAFNQAVDSIRAGGRVVAVGLPSEMMELSIVKTVLDGIQVIGSLVGTRKDLEEAFQFGAEGLVVPVVQ

SEQ ID NO: 4063 - protein, 332 aa, Streptococcus pneumoniae
MTIMSIGIIIASHGEFAAGIHQSGSMIFGEQEKVQVVTFMPNEGPDDLYAKFNNAVAAFDAEDEVLVLADLWSGSPFNQASRVMGENPERKFAIITGLNLPMLIQAYTERLMDAAAGVEKVAANIIKEAKDGIKALPEELNPVEEVASAAAAPVAQAAIPEGTVIGDGKLKINLARLDTRLLHGQVATAWTPDSKANRIIVASDNVAKDDLRKELIKQAAPGNVKANVVPIQKLIEISKDPRFGETHALILFETPQDALRAIEGGVPIKTLNVGSMAHSTGKTLVNTVLSMDKEDVATFEKMRDLGVEFDVRKVPNDSKKDLFDLINKANVK

SEQ ID NO: 4064 - protein, 267 aa, Streptococcus pneumoniae
MSIISMVLVVVVAFFAGLEGILDQFQFHQPLVACTLIGLVTGHLEAGIILGGSLQMIALGWSNIGAAIAPDAALASVAAAIIMVLGGDFTKTGIGVAQAVAIPLAVAGLFLTMIVRTISVGLVHTADAAAKKGDFGAVERAHFIALLFQGLRIALPAALLLMVPTETVQSILSAMPDWLKDGMAIGGGMVVAVGYAMVINMMATREVWPFFALGFVLAAVSDITLIGFGAIGVAIALIYLHLSKTGGNGGGGAATSNDPIGDILEDY

SEQ ID NO: 4065 - protein, 303 aa, Streptococcus pneumoniae
MTEKLQLTKSDRKKVWWRSTFLQGSWNFERMQNLGWAYTLIPAIKKLYTKKEDQIAALERHLEFFNTHPYVAAPVMGVTLALEEERANGVEIDDAAIQGVKIGMMGPLAGIGDPVFWFTVRPILGSLGASLALTGNILGPLLFFVAWNLIRMSFLWYVQEIGYKAGSEITKDMSGGILQDITKGASILGMFILAVLVQRWVNIKFAFDVSKVQLDEKAYIHWDKLPEGSKGIQEAFAQVGQGLSQTPEKVTTFQQNLDMLIPGLSGLLLTLLCMYLLKKKVSPITIILALFAVGIVAHVLHIM

SEQ ID NO: 4066 - protein, 444 aa, Streptococcus pneumoniae
MNAIQESFTDKLFANYEANVKYQAIENAASHNGIFAALERRQSHVDNTPVFSLDITKDKVTNQKASGRCWMFAALNTFRHKLISQYKLENFELSQAHTFFWDKYEKSNWFLEQVIATSDQELTSRKVSFLLQTPQQDGGQWDMVVSLFEKYGVVPKSVYPESVSSSSSRELNAILNKLLRQDAQILRDLLVSGADQATVQAKKEDLLQEIFNFLAMSLGLPPRKFDFAYRDKDNNYKSEKGITPQEFYKKYVNLPLEDYVSVINAPTADKPYGKSYTVEMLGNVVGSRAVRYINVPMERLKELAIAQMQAGETVWFGSDVGQLSNRKAGILATDVYDFESSMDIKLTQDKAGRLDYSESLMTHAMVLTGVDLDENGKSTKWKVENSWGDKVGTDGYFVASDAWMDEYTYQIVVRKELLTAEEQAAYGAEPIVLAPWDPMGALAE

SEQ ID NO: 4067 - protein, 240 aa, Streptococcus pneumoniae
MRLDKFLVACAVGSRTEVKNLLKAGRVTVNGKKEKSAKLQIDEKIDEIRFDGQVLEYEEFVYYMMNKPKGVISATEDPKHRTVLDLLDDLARSKEIFPVGRLDIDTHGLLLLTNDGQLAHVLLSPKRHVDKTYLAQVKGIMTQEDVEIFAEGIPLKDFTCQPAILELVSIDTEKNQSQIRVTIAEGKFHQIKRMVGYCGKEVVDLQRLTMGTLVLDENLERGEWRRLTKEELEILRANII

SEQ ID NO: 4068 - protein, 136 aa, Streptococcus pneumoniae
LYSLQTTSDSLCRRCGGYASSVLSATSKQCFELTSSVLSTTSKRCFELTSSVLSTTSKRCFELTSSVLSATSKQCFEQPAASFLVCSLIFIEYNTKGSPSATFFLCFLNQASMFSLDTAIHHDIITSTITQNLFRF

SEQ ID NO: 4069 - protein, 76 aa, Streptococcus pneumoniae
MKIKEQTRKLAAGCSKHCFEVADRTDEVSSKHCFEVADRTDEVSNIYTGKATLTRFEEIFEEYETKRRLVIVPASF

SEQ ID NO: 4070 - protein, 76 aa, Streptococcus pneumoniae
MLGSMFVGLLVGFLAGAMTNRGERMGCFGKMFLGWIGAFLGHLLFGTWGPVLSGTAIIPAVLGAMIVLAIFWRRGS

SEQ ID NO: 4071 - protein, 413 aa, Streptococcus pneumoniae
MVLPNFKENLEKYAKLLVANGINVQPGHTLALSIDVEQRELAHLIVKEAYALGAHEVIVQWTDDVINREKFLHAPMERLDNVPEYKIAEMNYLLENKASRLGVRSSDPGALNGVDADKLSASAKAMGLAMKPMRIATQSNKVSWTVAAAAGLEWAKKVFPNAASDEEAVDFLWDQIFKTCRVYEADPVKAWEEHAAILKSKADMLNKEQFSALHYTAPGTDLTLGLPKNHVWESAGAVNAQGEEFLPNMPTEEVFTAPDFRRADGYVTSTKPLSYNGNIIEGIKVTFKDGQIVDITAEKGDQVMKDLVFENAGARALGECALVPDPSPISQSGITFFNTLFDENASNHLAIGAAYATSVVDGAEMSEEELEAAGLNRSDVHVDFMIGSNQMDIDGIREDGTRVPLFRNGNWAN

SEQ ID NO: 4072 - protein, 60 aa, Streptococcus pneumoniae
FILIYFKGVLMKLRIFAEDKPAKKVFEYQLELADRTILLSTALLSGAIALAGIFSALKEK

SEQ ID NO: 4073 - protein, 76 aa, Streptococcus pneumoniae
IKINHCDCLSSANLKSIPTYLLYKPKANLAGYGIHELLENAWMPSMNDHDIWQDVLFLEPENSKLLLIILPSNHAS

SEQ ID NO: 4074 - protein, 92 aa, Streptococcus pneumoniae
VLKIRYHKQFKKDFKLAMKRGLKAELLEEVLNFLVQEKEHPARYRDHSLTASKHFQGVRECHTQPDWLLVYKVDKSELILNLLRTGSHSDLF

SEQ ID NO: 4075 - protein, 87 aa, Streptococcus pneumoniae
MSKMSMSIRLDSEVKEQAQQVFSNLGMDMTTAINIFLRQAIQYQGLPFDVRLDENRKLLQVLTDLDQNRNMSQSFESVSDLMEDLRA

SEQ ID NO: 4076 - protein, 1463 aa, Streptococcus pneumoniae
MSNSFEILMNQLGMPAEMRQAPALAQANIERVVVHKISKVWEFHFVFSNILPIEIFLELKKGLSEEFSKTGNKAVFEIKARSQEFSNQLLQSYYREAFSEGPCASQGFKSLYQNLQVRAEGNQLFIEGSEAIDKEHFKKNHLPNLAKQLEKFGFPTFNCQVEKNDVLTQEQEEAFHAENEQIVQAANEEALRAMEQLEQMAPPPAEEKPVFDFQAKKAAAKPKLDKAEITPMIEVTTEENRLVFEGVVFDVEQKVTRTGRVLINFKMTDYTSSFSMQKWVKNEEEAQKFDLIKKNSWLRVRGNVEMNNFTRDLTMNVQDLQEVVHYERKDLMPEGERRVEFHAHTNMSTMDALPEVEEIVATAAKWGHKAVAITDHGNVQSFPHGYKAAKKAGIQLIYGMEANIVEDRVPIVYNEVEMDLSEATYVVFDVETTGLSAIYNDLIQVAASKMYKGNVIAEFDEFINPGHPLSAFTTELTGITDDHVKNAKPLEQVLQEFQEFCKDTVLVAHNATFDVGFMNANYERHDLPKISQPVIDTLEFARNLYPEYKRHGLGPLTKRFGVALEHHHMANYDAEATGRLLFIFIKEVAEKHGVTDLARLNIDLISPDSYKKARIKHATIYVKNQVGLKNIFKLVSLSNTKYFEGVPRIPRTVLDAHREGLILGSACSEGEVFDVVVSQGVDAAVEVAKYYDFIEVMPPAIYAPLIAKEQVKDMEELQTIIKSLIEVGDRLGKPVLATGNVHYIEPEEEIYREIIVRSLGQGAMINRTIGHGEHAQPAPLPKAHFRTTNEMLDEFAFLGEELARKLVIENTNALAEIFEPVEVVKGDLYTPFIDKAEETVAELTYKKAFEIYGNPLPDIVDLRIEKELTSILGNGFAVIYLASQMLVQRSNERGYLVGSRGSVGSSFVATMIGITEVNPLSPHYVCGQCQYSEFITDGSYGSGFDMPHKDCPNCGHKLSKNGQDIPFETFLGFDGDKVPDIDLNFSGEDQPSAHLDVRDIFGEEYAFRAGTVGTVAAKTAYGFVKGYERDYGKFYRDAEVERLAQGAAGVKRTTGQHPGGIVVIPNYMDVYDFTPVQYPADDVTAEWQTTHFNFHDIDENVLKLDVLGHDDPTMIRKLQDLSGIDPNKIPMDDEGVMALFSGTDVLGVTPEQIGTPTGMLGIPEFGTNFVRGMVDETHPTTFAELLQLSGLSHGTDVWLGNAQDLIKQGIADLSTVIGCRDDIMVYLMHAGLEPKMAFTIMERVRKGLWLKISEEERNGYIEAMKANKVPEWYIESCGKIKYMFPKAHAAAYVMMALRVAYFKVHHPIYYYCAYFSIRAKAFDIKTMGAGLEAIKRRMEEISEKRKNNEASNVEIDLYTTLEIVNEMWERGFKFGKLDLYRSQATEFLIDGDTLIPPFVAMDGLGENVAKQLVRAREEGEFLSKTELRKRGGLSSTLVEKMDEMGILGNMPEDNQLSLFDELF

SEQ ID NO: 4077 - protein, 693 aa, Streptococcus pneumoniae
MAREFSLEKTSNIGIMAHVDAGKTTTTERILYYTGKIHKIGETHEGASQMDWMEQEQERGITITSAATTAQWNNHRVNIIDTPGHVDFTIEVQRSLRVLDGAVTVLDSQSGVEPQTETVWRQATEYGVPRIVFANKMDKIGADFLYSVSTLHDRLQANAHPIQLPIGSEDDFRGIIDLIKMKAEIYTNDLGTDILEEDIPAEYLDQAQEYREKLIEAVAETDEELMMKYLEGEEITNEELKAGIRKATINVEFFPVLCGSAFKNKGVQLMLDAVIDYLPSPLDIPAIKGINPDTDAEETRPASDEEPFAALAFKIMTDPFVGRLTFFRVYSGVLQSGSYVLNTSKGKRERIGRILQMHANSRQEIDTVYSGDIAAAVGLKDTTTGDSLTDEKSKIILESINVPEPVIQLMVEPKSKADQDKMGIALQKLAEEDPTFRVETNVETGETVISGMGELHLDVLVDRMRREFKVEANVGAPQVSYRETFRASTQARGFFKRQSGGKGQFGDVWIEFTPNEEGKGFEFENAIVGGVVPREFIPAVEKGLVESMANGVLAGYPMVDVKAKLYDGSYHDVDSSETAFKIAASLSLKEAAKSAQPAILEPMMLVTITVPEENLGDVMGHVTARRGRVDGMEAHGNSQIVRAYVPLAEMFGYATVLRSASQGRGTFMMVFDHYEDVPKSVQEEIIKKNKGED

SEQ ID NO: 4078 - protein, 118 aa, Streptococcus pneumoniae
TIIKLSFNVNHWVTCKNTVSHRFYQTFFNRWDKFTRNHTTDDCVFEFESFTFFVWSKFNPYITELTFTTRLTFEESTCLSRSAECFTVRYLRRTYVRFNFELTTHTINKDVKVKFTHT

SEQ ID NO: 4079 - protein, 149 aa, Streptococcus pneumoniae
TTQYWEEFNVDSRFTDTSFQFFVSDFFTFEVFHHQFFVSFSNCFNQFFTVFLSLVKVFSWDVFFKDIRTKVVSIDFSFHLDQVNDTTEVIFRTDWQLDWVCICLKTIVKCAYRVKEVSTDFVHFVGKYDTWNSVLSCLTPNCFSLRLNT

SEQ ID NO: 4080 - protein, 143 aa, Streptococcus pneumoniae
MNLIGCNRNLLRFPIFSGTFLTLSHPILPTEVCECTVSFSHTVSIFTFLNCCTSVVSSIQDFFCKTVLHCVFTTKTSDCYQPTKSKCCTTFWTNFNWDLVVRTTNTTCTYFKYRHDVFHSCFKYFKCIVASSFFDLLKSTVND

SEQ ID NO: 4081 - protein, 156 aa, Streptococcus pneumoniae
MSRKNRAPKRDVLPDPLYNSQLVTRLINRVMLDGKRGTAASIVYGAFEQIKEATGNDALEVFETAMENIMPVLEVRARRVGGSNYQVPVEVRPERRTTLGLRWLVTIARLRGEHTMQDRLAKEILDAANNTGAAVKKREDTHRMAEANRAFAHFRW

SEQ ID NO: 4082 - protein, 137 aa, Streptococcus pneumoniae
MPTINQLVRKPRKSKVEKSKSPALNVGYNSHKKVQTNVSSPQKRGVATRVGTMTPKKPNSALRKFARVRLSNLIEVTAYIPGIGHNLQEHSVVLLRGGRVKDLPGVRYHIVRGALDTAGVNDRKQGRSKYGTKRPKA

SEQ ID NO: 4083 - protein, 1204 aa, Streptococcus pneumoniae
DTAAGSGKNESDISSPRNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKTYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSPESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 4084 - protein, 307 aa, Streptococcus pneumoniae
LDVYGIGEHHRADFAVSAPEIVLAAGAVNTKKIRLTSAVSILSSMDPIRLFQQYATIDALSNGRSEIMAGRGSFTESFPLFGYDLKDYDSLFDEKLDLLQLVNEKTKLDWQGRLTQTIAGKEVYPRPVQDKLPMWIATGGHVESTVKIAQAGLPIVYAIIGGNPRYFKKLIQAYREIGSEAGHADKDLKVGAHSWGWIAEDGEQAVKDYFHPTKQVVDAISKDRPHWQELRYEQYLEQVGPNGAMFVGNPDQVAEKLIRMIEDLGLDRFMLHLPLGSMPHDQVLRAIELFGTQVAPKVRAYFAMKEA

SEQ ID NO: 4085 - protein, 602 aa, Streptococcus pneumoniae
MCGIVGVVGNTNATDILIQGLEKLEYRGYDSAGIFVLDGADNHLVKAVGRIAELSAKTAGVEGTTGIGHTRWATHGKPTEDNAHPHRSETERFVLVHNGVIENYLEIKEEYLAGHHFKGQTDTEIAVHLIGKFAEEEGLSVLEAFKKALHIIRGSYAFALIDSENPDVIYVAKNKSPLLIGLGEGYNMVCSDAMAMIRETNQYMEIHDQELVIVKADSVEVQDYDGNSRERASYTAELDLSDIGKGTYPYYMLKEIDEQPTVMRKLIQAYTDDAGQVVVAPAIIKAVQDADRIYILAAGTSYHAGFASKKMLEELTDTPVELGISSEWGYGMPLLSKKPLFIFISQSGETADSRQVLVKANEMGIPSLTVTNVPGSTLSREANYTMLLHAGPEIAVASTKAYTAQIAALAFLAKAVGEANGNAKAQAFDLVHELSIVAQSIESTLSEKETIEAKVRELLETTRNAFYIGRGQDYYVAMEASLKLKEISYIQCEGFAAGELKHGTIALIEEGTPVLALLSDPVLANHTRGNIQEVAARGAKVLTIAEENVAKDTDDIVLTTVHPYLSPISMVVPTQLVAYFATLHRGLDVDKPRNLAKSVTVE

SEQ ID NO: 4086 - protein, 459 aa, Streptococcus pneumoniae
MLRFPKDFVWGSSTSGPQTEGRVAGDGKGDNLWDYWFQVEPNRYYNGIGSDKTSTFYENWERDIELLLETGHTAFRTSIQWSRIFPQGCGKVNTQGVDFYRKVFEAIKAKGIRLLVNLYHFDLPFALQEDGDGWENKATVSAYEDYARFCFETYGDLVDQWITFNEPIVPVEFGYFYDAHYPHKVDAEPAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 4087 - protein, 346 aa, Streptococcus pneumoniae
KWQQTSTNQATVLSLKKKLLVLQRQMLNQLMKLQPSSMFQKNKRLKPSSTLQMASLLQPFLVGNDQLNEVKLKNHLGADFFDVASEEEVANVVQAGFGSLGPVGLPENIKIIADRKVQDVRNAVVGANEDGYHLTGVNPGRDFTAEYVDIREVREGEISPDGQGVLNFARGIEIGHIFKLGTRYSASMGADVLDENGRAVPIIMGCYGIGVSRLLSAVMEQHARLFVNKTPKGEYRYAWGINFPKELAPFDVHLITVNVKDEEAQALTEKLEASLMGAGYEVLTDDRNERVGVKFSDSDLIGLPIRITVGKKAADGIVEVKIKATGDTIEVHADNVLETLEILSKK

SEQ ID NO: 4088 - protein, 335 aa, Streptococcus pneumoniae
MKQSKMPIPTLREMPSDAQVISHALMLRAGYVRQVSAGVYSYLPLANRVIEKAKNIMRQEFEKIGAVEMLAPALLSAELWRESGRYETYGEDLYKLKNREKSDFILGPTHEETFTAIVRDSVKSYKQLPLNLYQIQPKYRDEKRPRNGLLRTREFIMKDAYSFHANYDSLDSVYDEYKAAYERIFTRSGLDFKAIIGDGGAMGGKDSQEFMAITSARTDLDRWVVLDKSVASFDEIPAEVQEEIKAELLKWIVSGEDTIAYSSESSYAANLEMATNEYKPSNRVVAEEEVTRVATPDVKSIDEVAAFLNVPEEQTIKTLFYIADGELVAALSSWK

SEQ ID NO: 4089 - protein, 419 aa, Streptococcus pneumoniae
MLGILTFILVFGIIVVVHEFGHFYFAKKSGILVREFAIGMGPKIFAHIGKDGTAYTIRILPLGGYVRMAGWGDDTTEIKTGTPVSLTLADDGKVKRINLSGKKLDQTALPMQVTQFDFEDKLFIKGLVLEEEKTFAVDHDATVVEADGTEVRIAPLDVQYQNATIWGKLITNFAGPMNNFILGVVVFWVLIFMQGGVRDVDTNQFHIMPQGALAKVGVPETAQITKIGSHEVSNWESLIQAVETETKDKTAPTLDVTISEKGSDKQVTVTPEDSQGRYLLGVQPGVKSDFLSMFVGGFTTAADSALRILSALKNLIFQPDLNKLGGPVAIFKASSDAAKNGIENILYFLAMISINIGIFNLIPIPALDGGKIVLNILEAIRRKPLKQEIETYVTLAGVVIMVVLMIAVTWNDIMRLFFR

SEQ ID NO: 4090 - protein, 267 aa, Streptococcus pneumoniae
MTQDLQKRTLFAGIALAIFLPILMIGGLLLQIAIGIIAMLAMHELLKMRGLETMTMEGLLTLFATFALTIPLENYLTFLPVDGNVVAYSVLISIMLGTTVFSKSYTIEDAVFPLAMSFYVGFGFNALLDARVAGLDKALLALCIVWATDSGAYLVGMNYGKRKLAPRVSPNKTLEGALGGILGAILVTIIFMIVDSTVALPYGIYKMSVFAIFFSIAGQFGDLLESSIKRHFGVKDSGKFIPGHGGVLDRFDSMLLVFPIMHLFGLF

SEQ ID NO: 4091 - protein, 258 aa, Streptococcus pneumoniae
LNRNKIMFGFFKKDKAVEVEVPTQVPAHIGIIMDGNGRWAKKRMQPRVFGHKAGMEALQTVTKAANKLGVKVITVYAFSTENWTRPDQEVKFIMNLPVEFYDNYVPELHANNVKIQMIGETDRLPKQTFEALTKAEELTKNNTGLILNFALNYGGRAEITQALKLISQDVLDAKINPGDITEELIGNYLFTQHLPKDLRDPDLIIRTSGELRLSNFLPWQGAYSELYFTDTLWPDFDEAALQEAILAYNRRHRRFGGV

SEQ ID NO: 4092 - protein, 190 aa, Streptococcus pneumoniae
MNTVKNKQEILEAFRENPDMMAILTIIRDLGLKDSWLAAGSVRNFIWNLLSDKSPFDHETDIDVIFFDPDFSYEETLLLKKKLREDFPQYQWELKNQVYMHQHSPHTASYTSSRDAMSKYPERCTAVGLRLNEESDFELYVPYGLEDILNFQVRPTPHFLENEDRMELYQTRLSKKNWQEKWKNLIFKNT

SEQ ID NO: 4093 - protein, 332 aa, Streptococcus pneumoniae
MSRILDNEIMGDEELVERTLRPQYLREYIGQDKVKDQLQIFIEAAKMRDEALDHVLLFGPPGLGKTTMAFVIANELGVNLKQTSGPVIEKAGDLVAILNELEPGDVLFIDEIHRLPMSVEEVLYSAMEDFYIDIMIGAGEGSRSVHLELPPFTLIGATTRAGMLSNPLRARFGITGHMEYYAHADLTEIVERTADIFEMEITHEAASELALRSRGTPRIANRLLKRVRDFAQIMGNGVIDDIITDKALTMLDVDHEGLDYVDQKILRTMIEMYSGGPVGLGTLSVNIAEERETVEDMYEPYLIQKGFIMRTRSGRVATAKAYEHLGYEYSEK

SEQ ID NO: 4094 - protein, 34 aa, Streptococcus pneumoniae
MTGPDVCLRLTPSSLAITKAMVVFPRPGGPNKST

SEQ ID NO: 4095 - protein, 138 aa, Streptococcus pneumoniae
MITIKKQEIVKLEDVLHLYQAVGWTNYTHQPEMLEHALSHSLVIYLALDGDAVVGLIRLVGDGFSSVFVQDLIVLPIYQRQGIGSALMKEALKDYKDAYQVQLVTEETEKNVGFYRSMGFEILSTYNCIGMTWANREK

SEQ ID NO: 4096 - protein, 231 aa, Streptococcus pneumoniae
MPVNEYGQMIGESMEGYTPGALPSIDFLEGRYARIEALSVEKHAEDLLAVYGPDTPREMWTYLFQEPVADMGELVSLLNQMLARKDRFYYAIIDKATGKALGTFSLMRIDQNNRVIEVGAVTFSPELRGTRIGTEAQYLLARYIFEELNYRRYEWKCDALNLPSRRVAERLGFVYEGTFRQAVVYKGRTRDTDWLSMIDMDWPQVKDRLETWLRPENFDKNGQQYKSLREL

SEQ ID NO: 4097 - protein, 63 aa, Streptococcus pneumoniae
RIPTLFHNDINEFSWLKQFGKLFEVGNQQINWLFYNNINQFIWYTNHFHDFLTVNFCFDFFIR

SEQ ID NO: 4098 - protein, 833 aa, Streptococcus pneumoniae
MSFYNHKEIEPKWQGYWAEHHTFKTGTDASKPKFYALDMFPYPSGAGLHVGHPEGYTATDILSRYKRAQGYNVLHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLNDLDELDWSESIKDMQRNWIGKSTGANVTFKVKGTDKEFTVFTTRPDTLFGATFTVLAPEHELVDAITSSEQAEAVADYKHQASLKSDLARTDLAKEKTGVWTGAYAINPVNGKEMPIWIADYVLASYGTGAVMAVPAHDQRDWEFAKQFDLPIVEVLEGGDVKEAAYTEDGLHVNSDFLDELNKEDAIAKIVAWLEKKGCGQEKVTYRLRDWLFSRQRYWGEPIPIIHWEDGTSTAVPETELPLVLPVTKDIRPSGTGESPLANLTDWLEVTREDGVKGRRETNTMPQWAGSSWYYLRYIDPHNTEKLADEDLLKQWLPVDIYVGGAEHAVLHLLYARFWHKFLYDLGVVPTKEPFQKLFNQGMILGTSYRDHRGALVATDKVEKRDGSFFHIETGEELEQAPAKMSKSLKNVVNPDDVVEQYGADTLRVYEMFMGPLDASIAWSEEGLEGSRKFLDRVYRLITSKEILAENNGALDKAYNETVKAVTEQIESLKFNTAIAQLMVFVNAANKEDKLYVDYAKGFIQLIAPFAPHLAEELWQTVAETGESISYVAWPTWDESKLVEDEIEIVVQIKGKVRAKLMVAKDLSREELQEIALADEKVKAEIDGKEIVKVISVPNKLVNIVVK

SEQ ID NO: 4099 - protein, 362 aa, Streptococcus pneumoniae
MRIFASPSRYIQGENALFENAKSILDLGNYPILLCDQLVYDIVGKRFEDYLHRYGFHIVLALFNGEASDNEINRVVALAEKENCDSIIGLGGGKTIDSAKAIADLIEKPVIIAPTIASTDAPVSALSVIYTDEGAFDHYLFYSKNPDLVLVDTKVISQAPKRLLASGIADGLATWVEARAVMQANGKTMLGQQQTLAGVAIAKKCEETLFADGLQAMAACEAKVVTPALENIVEANTLLSGLGFESGGLAAAHAIHNGFTALTGDIHHLTHGEKVAYGTLVQLLLENRPKEELDKYIEFYKKIGMPTTLKEMHLDQVGYDDLIKVGKQATMEGETIHQMPFKISPSDVAQAIIAVDAYVNSK

SEQ ID NO: 4100 - protein, 222 aa, Streptococcus pneumoniae
MEFMLDTLNLDEIKKWSEILPLAGVTSNPTIAKREGSINFFERIKDVRELIGSTPSIHVQVISQDFEGILKDAHEIRRQAGDDIFIKVPVTPAGLRAIKVLKKEGYHITATAIYTVIQGLLAIEVGADYLAPYYNRMENLNIDSNSVIRQLALAIDRQNSPSKILAASFKNVAQVNNALAAGAHAVTAGADVFESAFAMPSIQKAVDDFSDDWFVIQNSRSI

SEQ ID NO: 4101 - protein, 815 aa, Streptococcus pneumoniae
VLTMVNTEVARTTIKTEYFGSLTERMNKYREDVLNKKPYIDAERAVLATRAYERYKEQPNVLKRAYMLKEILENMTIYIEEESMIAGNQASSNKDAPIFPEYTLEFVLNELDLFEKRDGDVFYITEETKEQLRSIAPFWENNNLRARAGALLPEEVSVYMETGFFGMEGKMNSGDAHLAVNYQKLLQFGLRGFEERARKAKVALDLTDPASIDKYHFYDSIFIVIDAIKVYAKRFVALAKSLAENANPKRKKELLEIADICSRVPYEPATTFAEAIQSVWFIQCILQIESNGHSLSYGRFDQYMYPYMKADLESGKETEDSIVERLTNLWIKTITINKVRSQSHTFSSAGSPLYQNVTIGGQTRDKKDAVNPLSYLVLKSVAQTHLPQPNLTVRYHAGLDARFMNECIEVMKLGFGMPAFNNDEIIIPSFIAKGVLEDDAYDYSAIGCVETAVPGKWGYRCTGMSYMNFPKVLLITMNDGIDPASGKRFAPSFGHFKDMKNFSELENAWDKTLRYLTRMSVIVENSIDLSLEREVPDILCSALTDDCIGRGKHLKEGGAVYDYISGLQVGIANLSDSLAAIKKLVFEEERISPSQLWHALETDYAGEEGKVIQEMLIHDAPKYGNDDDYADKLVTAAYDIYVDEIAKYPNTRYGRGPIGGIRYSGTSSISANVGQGRGTLATPDGRNAGTPLAEGCSPSHNMDQHGPTSVLKSVSKLPTDEIVGGVLLNQKVNPQTLAKEEDKLKLIALLRTFFNRLHGYHIQYNVVSRETLIDAQKHPEKHRDLIVRVAGYSAFFNVLSKATQDDIIGRTEHTL

SEQ ID NO: 4102 - protein, 426 aa, Streptococcus pneumoniae
QKIIAPMMKFVNMRGIIALKDGMLAILPLTVVGSLFLIMGQLPFEGLNKSIASVFGANWTEPFMQVYSGTFAIMGLISCFSIAYSYAKNSGVEALPAGVLSVSAFFILLRSSYIPKQGEAIGDAISKVWFGGQGIIGAIIIGLVVGSIYTFFIKRKIVIKMPEQVPQAIAKQFEAMIPAFVIFLSSMIVYILAKSLTNGGTFIEMIYSAIQVPLQGLTGSLYGAIGIAFFISFLWWFGVHGQSVVNGVVTALLLSNLDANKAMLASANLSLENGAHIVTQQFLDSFLILSGSGITFGLVVAMLFAAKSKQYQALGKVAAFPAIFNVNEPVVFGFPIVMNPVMFVPFILVPVLAAVIVYGAIATGFMQPFSGVTLPWSTPAILSGFLVGGWQGVITQLVILAMSTLVYFPFFKVQDRLAYQNEIKQS

SEQ ID NO: 4103 - protein, 102 aa, Streptococcus pneumoniae
MVKIGLFCAAGFSTGMLVNNMKIAAQASGVEAEIEAFSQSKLADYAPNIDVALLGPQVAYTLDKSKEICDKCDVPIAVIPMMDYGMLDGKKVLDLALSLISG

SEQ ID NO: 4104 - protein, 106 aa, Streptococcus pneumoniae
MEIIVPDQIIMGLILYAGDAKQHIYKALDYIKNGTCERCEEEIQLADAALLEAHNLQTKFLAQEASGTKTEITALFVHSQDHLMTSMTEINLIKEIISLRKELHKK

SEQ ID NO: 4105 - protein, 326 aa, Streptococcus pneumoniae
MNQDRNKLLSKIAYLYYIENLNQSQIAAKLGIYRTSISRMLTEARNVGIVKIEIENFDTNMFKLENYVKEKYSLESLEIIPNEFDDTPTILSERISQVAAGVLRNLIDDNMKIGFSWGKSLSNLVDLIHSKSVRNVHFYPLAGGPSHIHAKYHVNTLIYEISRKFHGECTFMNATIVQENKLLADGILQSRYFENLKNSWKDLDIAVVGIGDFSNKGKHQWLDMLTEDDFKELTKVKTVGEICCRFFDSKGKEVYENLQERTIAISLEDLKNIPQSLAVAYGDTKVSSILSVLRANLVNHLITDKNTILKVLEEDGDLTFREILGE

SEQ ID NO: 4106 - protein, 248 aa, Streptococcus pneumoniae
MKRLEQIIKLVSEHEKIDVNTLSEKLNVSKVTIRKDLDKLESKGLLHREHGYAVLNSGDDLNVRLSINYEIKRKIVQEAVKLVSDNETIMIESGSTCALLAEEICKQKRNVTIVTNSFFIANFVRAYDSCRIIVLGGEFQKDSQVTVGPLLKEMIQTFHVRQAFVGTDGYDKEMGFTGKDLMRSEVVQYISAASDKVIVLTDSSKFDKRGTVRRFALSQVYEVITDEKLSKQNIATLENAGIMVKVVS

SEQ ID NO: 4107 - protein, 258 aa, Streptococcus pneumoniae
MEISKGIIFNIQHFSIHDGPGIRTTVFLKGCPLRCPWCSNPESQRMKPEKMKDAQREKFTLVGEEKTVEEIITEVLKDKEFYEESGGGLTLSGGEIFAQFEFAKAILKSAKEHHIHTAIETTAFVDHEKFIDLIQYVDFIYTDLKHYNSIKHKKVTGVFNQMIIKNIHYAFSQNKTIVLRIPVIPNFNNSLEDAEKFATLFNSLNIDQVQLLPFHQFGENKYRLLNRKYEMDGINALHPEDLIDYQKVFLNHHINCYF

SEQ ID NO: 4108 - protein, 82 aa, Streptococcus pneumoniae
LFADNKHLYKVIKEDFPMTLNEYILQYRLKQAIDKMAESPNSPLSAISDQVGFSDYKYFAKVFKKHLHISPKELKLLGRIVK

SEQ ID NO: 4109 - protein, 64 aa, Streptococcus pneumoniae
MNIEGYSDLLKPELKGKIATADPANSSSAFAQLTNMLQAQGGYKDDKAWSYVKDLFTLIDGIVK

SEQ ID NO: 4110 - protein, 122 aa, Streptococcus pneumoniae
MTVGLSYEDPAVKLLNDGANIKVVYPKEGTVFLPASAAIVKKSKNMENAKKFIDFIISQEVQDTLGTTTTNRPVRKNAKTSENMKPIDKIKTLTEDYDYVIKNKSDIVKKYNEVFTDIQSKQ

SEQ ID NO: 4111 - protein, 317 aa, Streptococcus pneumoniae
MSEIEIINAKKIYHDVSVIENLNITIPKGSLFTLLGASGCGKTTLLRMIAGFNSIKDGEFYFDDTKINNMEPSKRNIGMVFQNYAIFPHLTVRDNVAFGLMQKKVPKEELIQQTNKYLELMQIAQYADRKPDKLSGGQQQRVTLACALAVNPSVLLMDEPLSNLEAKLRLDMRQAIREIQHEVGITTVYVTHDQEEAMAISDQIAVMKDGVIQQIGRPKELYHKPANEFVATFIGRTNIIPANLEKRSDGAYIVFSDGYALRMPALDQVEEQAIHVSIRPEEFIKDESGDIEGTISDSVYLGLNTKYFIETGFASKI

SEQ ID NO: 4112 - protein, 208 aa, Streptococcus pneumoniae
MECKKLNIWTASSFFIFLTYLVFLVYPIVTVLKQALIHEGQFSLANFVTFFSKVYYSETLVNSFKVSITATVTSLVVGTLLAYLFSMYDFKGKKFLQILIIIASMSAPFVGAYSWVLLLGRNGVITKFLTNALHLPAIDIYGFKGIVLVFTLQLFPLVFLYVAETMNSIDNSLLEAAESMGSFGFKPIVTVVLPLLVPTLLAAPCLYL

SEQ ID NO: 4113 - protein, 256 aa, Streptococcus pneumoniae
MAAIYATVYGIIFISVLPQIYLIYTSFLKTSGMVFVKGYSPNSYKLAFNRMGSAIFNTIRIPLIALVLVVLFATFISYLAVRKRNLFTNLIDNLSMVPYIVPGTVLGIAFISSFNTGLFGSGFLMITGTAFILIMSLSVRRLPYTIRSSVASLQQIAPSIEEAAESLGSSRLNTFAKITTPMMLSGIISGAILSWVTLISELSTSILYPPLQCQNKNNDCSYLYRGSQRKLRCSRSLVNYPDCSNSRFLALVYENL

SEQ ID NO: 4114 - protein, 65 aa, Streptococcus pneumoniae
FQNSLLLSSILLYNVKTRTMTVAIYTEVLRGNYGVAAALSTILTVLTVGSLLLFMKISKSNSITL

SEQ ID NO: 4115 - protein, 249 aa, Streptococcus pneumoniae
MGGFYFIIHDIIEANGGRKMVKVRLYLVRHGKTMFNTIGRAQGWSDTPLTAEGERGIQELGIGLRESDLQFERAYSSDSGRTIQTMGIILEELGLQGKIPYRMDKRIREWCFGSFDGAYDGDLFMGIIPRIFNVDHVHQLSYAELAEGLVEVDTAGWAEGWEKLSGRIKEGFEIIAKEMEDQGGGNALVVSHGMTIGTIVYLINGMHPHGLDNGSVTILEYEDGQFRVEVVGDRSYRELGREKMEEGSI

SEQ ID NO: 4116 - protein, 445 aa, Streptococcus pneumoniae
MDIRQVTETIAMIEEQNFDIRTITMGISLLDCIDPDINRAAEKIYQKITTKAANLVAVGDEIAAELGIPIVNKRVSVTPISLIGAATDATDYVVLAKALDKAAKEIGVDFIGGFSALVQKGYQKGDEILINSIPRALAETDKVCSSVNIGSTKSGINMTAVADMGRIIKETANLSEIGVAKLVVFANAVEDNPFMAGAFHGVGEADVIINVGVSGPGVVKRALEKVRGQSFDVVAETVKKTAFKITRIGQLVGQMASERLGVEFGIVDLSLAPTPAVGDSVARVLEEMGLETVGTHGTTAALALLNDQVKKGGVMACNQVGGLSGAFIPVSEDEGMIAAVQNGSLNLEKLEAMTAICSVGLDMIAIPEDTPAETIAAMIADEAAIGVINMKTTAVRIIPKGREGDMIEFGGLLGTAPVMKVNGASSVDFISRGGQIPAPIHSFKN

SEQ ID NO: 4117 - protein, 119 aa, Streptococcus pneumoniae
LSIFVRIMLYYLKRILFNVKVSYFKKNWSLLMKAIITVVGKDKSGIVAGVSGKIAELGLNIDDISQTVLDEYFTMMAVVSSDEKQDFTYLRNEFEAFGQTLNVKINIQSAAIFEAMYNI

SEQ ID NO: 4118 - protein, 128 aa, Streptococcus pneumoniae
MAYRKLGRTSSQRKAMLRDLTTDLLINESIVTTEARAKEIRKTVEKMITLGKRGDLHARRQAAAFVRNEIASENYDEATDKYTSTTALQKLFSEIAPRYAERNGGYTRILKTEPRRGDAAPMAIIELV

SEQ ID NO: 4119 - protein, 311 aa, Streptococcus pneumoniae
MIEFEKPNITKIDENKDYGKFVIEPLERGYGTTLGNSLRRVLLASLPGAAVTSINIDGVLHEFDTVPGVREDVMQIILNIKGIAVKSYVEDEKIIELDVEGPAEVTAGDILTDSDIEIVNPDHYLFTIGEGSSLKATMTVNSGRGYVPADENKKDNAPVGTLAVDSIYTPVTKVNYQVEPARVGSNDGFDKLTLEILTNGTIIPEDALGLSARILTEHLDLFTNLTEIAKSTEVMKEADTESDDRILDRTIEELDLSVRSYNCLKRAGINTVHDLTEKSEAEMMKVRNLGRKSLEEVKLKLIDLGLGLKDK

SEQ ID NO: 4120 - protein, 133 aa, Streptococcus pneumoniae
MSQLLLVEKLEVHDEESYQELYRSHVQVVRLQTCHNLYFHQFLLYLVFQTRSFSYSLLNEKQCNAMIIHGDVLEDEHHCVGTGVTSRIAVTSRPAAASARIADSRPEPGPFTVTSTDLRPCSCADLAAASEAI

SEQ ID NO: 4121 - protein, 140 aa, Streptococcus pneumoniae
LAKPTRKRRVKKNIESGIAHIHATFNNTIVMITDVHGNAIAWSSAGALGFKGSRKSTPFAAQMASEAAAKSAQEHGLKSVEVTVKGPGSGRESAIRALAAAGLEVTAIRDVTPVPTQWCSSSKTSPCIIIALHCFSFKRE

SEQ ID NO: 4122 - protein, 121 aa, Streptococcus pneumoniae
MARIAGVDIPNDKRVVISLTYVNGIGLATSKKILAAAGISEDVCVRDLTSDQEDAIRREVDAIKVEGDLRRKVNLNIKRLMEIGSYRGIRHRRGLPVRGQNTKNNARTRKGKAVAIAGKKK

SEQ ID NO: 4123 - protein, 55 aa, Streptococcus pneumoniae
VAKDYVIEVEGKVVDTMPNAMFTVELENGHQILATVSGKMRKNYIRVLAGDRVTV

SEQ ID NO: 4124 - protein, 212 aa, Streptococcus pneumoniae
MNLLIMGLPGAGKGTQAAKIVEQFHVAHISTGDMFRAAMANQTEMGVLAKSYIDKGELVPDEVTNGIVKERLSQDDIKETGFLLDGYPRTIEQAHALDKTLAELGIELEGVINIEVNPDSLLERLSGRIIHRVTGETFHKVFNPPVDYKEEDYYQREDDKPETVKRRLDVNIAQGEPIIAHYRAKGLVHDIEGNQDINDVFSDIEKVLTNLK

SEQ ID NO: 4125 - protein, 436 aa, Streptococcus pneumoniae
MFFKLLREALKVKQVRSKILFTIFIVLVFRIGTSITVPGVNANSLNALSGLSFLNMLSLVSGNALKNFSIFALGVSPYITASIVVQLLQMDILPKFVEWGKQGEVGRRKLNQATRYIALVLAFVQSIGITAGFNTLAGAQLIKTALTPQVFLTIGIILTAGSMIVTWLGEQITDKGYGNGVSMIIFAGIVSSIPEMIQGIYVDYFVNVPSSRITSSIIFVIILIITVLLIIYFTTYVQQAEYKIPIQYTKVAQGAPSSSYLPLKVNPAGVIPVIFASSITAAPAAILQFLSATGHDWAWVRVAQEMLATTSPTGIAMYALLIILFTFFYTFVQINPEKAAESLQKSGAYIHGVRPGKGTEEYMSKLLRRLATVGSLFLGVISILPIAAKDVFGLSDVVAFGGTSLLIIISTGIEGIKQLEGYLLKRKYVGFMDRTE

SEQ ID NO: 4126 - protein, 146 aa, Streptococcus pneumoniae
MKLHELKPAEGSRKVRNRVGRGTSSGNGKTSGRGQKGQKARSGGGVRLGFEGGQTPLFRRLPKRGFTNINAKEYAIVNLDQLNVFEDGAEVTPVVLIEAGIVKAEKSGIKILGNGELTKKLTVKAAKFSKSAEEAITAKGGSVEVI

SEQ ID NO: 4127 - protein, 60 aa, Streptococcus pneumoniae
MAQIKITLTKSPIGRIPSQRKTVVALGLGKLNSSVIKEDNAAIRGMITAVSHLVTVEEVN

SEQ ID NO: 4128 - protein, 164 aa, Streptococcus pneumoniae
MAFKDNAVELEERVVAVNRVTKVVKGGRRLRFAALVVVGDHNGRVGFGTGKAQEVPEAIRKAVDDAKKNLIEVPMVGTTIPHEVLSEFGGAKVLLKPAVEGSGVAAGGAVRAVVELAGVADITSKSLGSNTPINIVRATVEGLKQLKRAEEIAALRGISVSDLA

SEQ ID NO: 4129 - protein, 118 aa, Streptococcus pneumoniae
VISKPDKNKLRQKRHRRVRGKLSGTADRPRLNVFRSNTGIYAQVIDDVAGVTLASASTLDKEVSKGTKTEQAVAVGKLVAERANAKGISEVVFDRGGYLYHGRVKALADAARENGLKF

SEQ ID NO: 4130 - protein, 174 aa, Streptococcus pneumoniae
MSRIGNKVIVLPAGVELANNDNVVTVKGPKGELTREFSKDIEIRVEGTEVTLHRPNDSKEMKTIHGTTRALLNNMVVGVSEGFKKELEMRGVGYRAQLQGSKLVLAVGKSHPDEVEAPEGITFELPNPTTIVVSGISKEVVGQTAAYVRSLRSPEPYKGKGIRYVGEFVRRKAR

SEQ ID NO: 4131 - protein, 132 aa, Streptococcus pneumoniae
MVMTDPIADFLTRIRNANQAKHEVLEVPASNIKKGIAEILKREGFVKNVEIIEDDKQGVIRVFLKYGPNGEKVITNLKRVSKPGLRVYKKREDLPKVLNGLGIAILSTSEGLLTDKEARQKNVGGEVIAYVW

SEQ ID NO: 4132 - protein, 78 aa, Streptococcus pneumoniae
DIKGVKTPSKNRKLDEETKVSRKVYLFHTEFSPGSIGLANLNTSYSFGKKDQFALEHCFCIKLSIFARAVTLFVSCIN

SEQ ID NO: 4133 - protein, 89 aa, Streptococcus pneumoniae
MAKKSMVAREAKRQKIVDRYAEKRAALKAAGDYEGLSKLPRNASPTRLHNRCRVTGRPHSVYRKFGLSRIAFRELAHKGQIPGVTKASW

SEQ ID NO: 4134 - protein, 180 aa, Streptococcus pneumoniae
MANRLKEKYLNEVVPALTEQFNYSSVMAVPKVDKIVLNMGVGEAVSNAKSLEKAAEELALISGQKPLITKAKKSIAGFRLREGVAIGAKVTLRGERMYEFLDKLVSVSLPRVRDFHGVPTKSFDGRGNYTLGVKEQLIFPEINFDDVDKTRGLDIVIVTTANTDEESRALLTGLGMPFAK

SEQ ID NO: 4135 - protein, 101 aa, Streptococcus pneumoniae
MFVKKGDKVRVIAGKDKGTEAVVLTALPKVNKVIVEGVNIVKKHQRPTNELPQGGIIEKEAAIHVSNVQVLDKNGVAGRVGYKFVDGKKVRYNKKSGEVLD

SEQ ID NO: 4136 - protein, 122 aa, Streptococcus pneumoniae
MIQTETRLKVADNSGAREILTIKVLGGSGRKFANIGDVIVASVKQATPGGAVKKGDVVKAVIVRTKSGARRADGSYIKFDENAAVIIREDKTPRGTRIFGPVARELREGGFMKIVSLAPEVL

SEQ ID NO: 4137 - protein, 109 aa, Streptococcus pneumoniae
MKPPSRNSRATGPKIRVPRGVLSSRMITAAFSSNLMYEPSARRAPDLVRTITALTTSPFLTAPPGVACFTDATITSPMFANLRPEPPRTLIVKISRAPLLSATFKRVSV

SEQ ID NO: 4138 - protein, 86 aa, Streptococcus pneumoniae
MERNNRKVLVGRVVSDKMDKTITVVVETKRNHPVYGKRINYSKKYKAHDENNVAKEGDIVRIMETRPLSATKRFRLVEVVEEAVII

SEQ ID NO: 4139 - protein, 132 aa, Streptococcus pneumoniae
LNCFDTSDLFFNFFQASCLFQLTSSSLETKFKQFFFQFVFALREFFLRKTTKFFNKFFYFIKFHAFSLFCFTFYEFTFNWQFVASKSKRFTCNLFRYTSDFEHHFTTFNWCYPTFRCPFTRSHTHTDSFSSV

SEQ ID NO: 4140 - protein, 68 aa, Streptococcus pneumoniae
MKLNEVKEFVKELRGLSQEELAKRENELKKELFELRFQAATGQLEQTARLKEVKKQIARIKTVQSEAK

SEQ ID NO: 4141 - protein, 137 aa, Streptococcus pneumoniae
MLVPKRVKHRREFRGKMRGEAKGGKEVAFGEYGLQATTSHWITNRQIEAARIAMTRYMKRGGKVWIKIFPHKSYTAKAIGVRMGSGKGAPEGWVAPVKRGKVMFEIAGVSEEIAREALRLASHKLPVKCKFVKREAK

SEQ ID NO: 4142 - protein, 208 aa, Streptococcus pneumoniae
MRVGIIRDWDAKWYAEKEYADYLHEDLAIRKFVQKELADAAVSTIEIERAVNKVNVSLHTAKPGMVIGKGGANVDALRAKLNKLTGKQVHINIIEIKQPDLDAHLVGEGIARQLEQRVAFRRAQKQAIQRAMRAGAKGIKTQVSGRLNGADIARAEGYSEGTVPLHTLRADIDYAWEEADTTYGKLGVKVWIYRGEVLPARKNTKGGK

SEQ ID NO: 4143 - protein, 74 aa, Streptococcus pneumoniae
TFTLNKAAEIILKVLNSAVANAENNFGLDKANLVVSEAFANEGPTMKRFRPRAKGSASPINKRTAHITVAVAEK

SEQ ID NO: 4144 - protein, 81 aa, Streptococcus pneumoniae
LLIGEAEPFARGRKRFIVGPSFANASDTTKLALSKPKLFSALATAEFKTFKMISAALFRVNVQDCDCIGYAFTTDVIKNKT

SEQ ID NO: 4145 - protein, 93 aa, Streptococcus pneumoniae
MGRSLKKGPFVDEHLMKKVEAQANDEKKKVIKTWSRRSTIFPSFIGYTIAVYDGRKHVPVYIQEDMVGHKLGEFAPTRTYKGHAADDKKTRRK

SEQ ID NO: 4146 - protein, 277 aa, Streptococcus pneumoniae
VGIRVYKPTTNGRRNMTSLDFAEITTSTPEKSLLVALKSKAGRNNNGRITVRHQGGGHKRFYRLVDFKRNKDNVEAVVKTIEYDPNRSANIALVHYTDGVKAYIIAPKGLEVGQRIVSGPEADIKVGNALPLANIPVGTLIHNIELKPGRGGELVRAAGASAQVLGSEGKYVLVRLQSGEVRMILGTCRATVGVVGNEQHGLVNLGKAGRSRWKGIRPTVRGSVMNPNDHPHGGGEGKAPVGRKAPSTPWGKPALGLKTRNKKAKSDKLIVRRRNEK

SEQ ID NO: 4147 - protein, 98 aa, Streptococcus pneumoniae
MNVYDVIKKPVITDSSMAQLEAGKYVFEVDTRANKLLIKQAVEAALEGVKVANVNTINVKPKAKRVGRYTGFTNKTKKAIITLTADSKAIELFAAEAE

SEQ ID NO: 4148 - protein, 207 aa, Streptococcus pneumoniae
MANVTLFDQTGKEAGQVVLSDAVFGIEPNESVVFDVIISQRASLRQGTHAVKNRSAVSGGGRKPWRQKGTGRARQGSIRSPQWRGGGVVFGPTPRSYGYKLPQKVRRLALKSVYSEKVAENKFVAVDALSFTAPKTAEFAKVLAALSIDSKVLVILEERNEFAALSARNLPNVKVATATTASVLDIANSDKLLVTQAAISKIEEVLA

SEQ ID NO: 4149 - protein, 208 aa, Streptococcus pneumoniae
MTKGILGKKVGMTQIFTEAGELIPVTVIEATPNVVLQVKTVETDGYNAIQVGFDDKREVLSNKPAKGHVAKANTAPKRFIREFKNVEGLEVGAEITVETFAAGDVVDVTGTSKGKGFQGVIKRHGQSRGPMAHGSRYHRRPGSMGPVAPNRVFKGKNLAGRMGGDRVTIQNLEVVQVVPEKNVILIKGNVPGAKKSLITIKSAVKAGK

SEQ ID NO: 4150 - protein, 102 aa, Streptococcus pneumoniae
MANKKIRIRLKAYEHRTLDTAAAKIVESATRTGAQVAGPIPLPTERSLYTIIRATHKYKDSREQFEMRTHKRLIDIVNPTQKTVDALMKLDLPSGVNVEIKL

SEQ ID NO: 4151 - protein, 205 aa, Streptococcus pneumoniae
MKKKDLVDQLVSEIETGKVRTLGIYGHGASGKSTFAQELYQALDSTTVNLLETDPYITSGRHLVVPKDAPNQKVTASLPVAHELESLQRDILALQASMDVLTIEEPWKASEVLSGAKPILIVEGMSVGFLPKELFEKTICFYTDEETELKRRLARDTTVRNRDASFILASHQMRREQYLRYYKETESKADILVDQSEDKFDVKRT

SEQ ID NO: 4152 - protein, 196 aa, Streptococcus pneumoniae
MNNPKPQEWKSEELSQGRIIDYKAFNFVDGEGVRNSLYVSGCMFHCEGCYNVATWSFNAGIPYTAELEEQIMADLAQPYVQGLTLLGGEPFLNTGILLPLVKRIRKELPDKDIWSWTGYTWEEMMLETPDKLEFLSLIDILVDGRYDRTKRNLMLQFRGSSNQRIIDVQKSLKSGQVVIWDKLNDGKESYEQVKRE

SEQ ID NO: 4153 - protein, 68 aa, Streptococcus pneumoniae
QEFQFIWSFQHHFFPSVAGPGPDVLVWQFLPNPLNKWQENPSIKKRLPSQQSQTLNIGLSKICHDLLF

SEQ ID NO: 4154 - protein, 168 aa, Streptococcus pneumoniae
MELRRPRLADKKAVLDMMTEFEKSQSAHDGGFWDVEDFSYEEWLEGNRNKEMGIWLPENRVPSIQFVLFGESGCALGFLNLRLRLNEGLLNYAGHIGYSIRPSERGKGYAKETLRQGLQVAKEKNIKKALVTCSVNNLASRAVILANGGIFEDARNGVERYWIEVANE

SEQ ID NO: 4155 - protein, 154 aa, Streptococcus pneumoniae
LHNPCLFQMDGWSSQCGQHNSVTPHSVSIADSKILEHNLIHQTIRTVSMERDFQVAIFPFLYYGYLLATPRKKNPQHPKILHHGLIGSFQTLSSYLKQLSYPLILVCVIPSLPPTMRKARAGSHFYFFLFLFKNCSLKLSKRSFLPAPPLECFS

SEQ ID NO: 4156 - protein, 737 aa, Streptococcus pneumoniae
MHMIALEEKITILPTLFVEKRDGRRVVFDVDKIDKALHKAADKVMDVTPLVEKRLNDLTERIITEIHSRFPQGIKIYEIQNIVEHELLEAKEYALAEEYITYRTQRDFERSKATDINFSIHKLLNKDQTVVNENANKDSDVFNTQRDLTAGIVGKSIGLQMLPKHVANAHQKGDIHYHDLDYSPYTPMTNCCLIDFKGMLENGFKIGNAEVESPKSIQTATAQISQIIANVASSQYGGCSADRIDEILAPYAEKNYQKHLKDAEEWVLPEKREDYAWKKTQKDIYDAMQSLEYEINTLFTSNGQTPFTSLGFGLGTSRFEREIQKAILNIRIKGLGSEHRTAIFPKLIFTLKRGLNLEEGTPNYDIKQLALECATKRMYPDVLSYDKIVDLTGSFKVPMGCRSFLQGWKDENGVEVNSGRMNLGVVTVNLPRIALESEGDMNKFWEIFNERMNIAEDALVYRVERTKEATPANAPILYQYGAFGHRLGKEESVDQLFKNRRATVSLGYIGLYEVATVFFGNSWESNPDAKEFTLDIIHDMKRRVEEWSDQYGYHFSIYSTPSESLTDRFCRLDIDKFGSIPDITDKEYYTNSFHYDVRKNPTPFEKLDFEKVYPEAGASGGFIHYCEYPVLQQNPKALEAVWDYAYDRVGYLGTNTPIDRCYKCDFEGDFEPTERGFACPNCGNSDPKTVDVVKRTCGYLGNPQARPMVNGRHKEIAARVKHMNGSTIKIAGHQVTN

SEQ ID NO: 4157 - protein, 518 aa, Streptococcus pneumoniae
LNRRNDMSVYGRVEEVHKENREPLEYQIEQESHHRESSRLPLVKILLWSTLVTGITLGVPLLLDLMSAQEVQDFYAGWALHQTGKIYSDYYGSQGLLYYLLTYVSQGGFFFAIFEWLALVAGGFFLFRSADTLTEQGDQAGHLVTIFYMLVTGLAFGGGYATLLALPFLFAAFSLVAAYLSNPSHDKGFVRIGLALAGGFFFAPLSSLLFIAVVSLGLLVFNLGHRRFAHGFYQFLAVALGFSLVFYPTAYYSAATGSFGDAISGIRYPIDSIRFDFTSKILENMFFYGLLSLGLGFVVCIFLGLFQSKPFKLYVISVPASLVVILGLILLFFSQEPLHASYLMVVFPVFLLLLVTNIKSQQRGRSARRNRRETPVSLWSRFFKGNLYLLVFEFVYLLSVPFLMKFVLYPVPYQERNRLADLVKEETNTEDAIYAWDDTATLYRKSERLSPSAILSPLHYTATEENRNKLLNDLKEKQPKVIVVNDKVVVWSEVETLLKENYQQVKTDYSEFKVYKIK

SEQ ID NO: 4158 - protein, 491 aa, Streptococcus pneumoniae
MLLELCLVFGLFLYLGRMAPILWITVLILLSIITIISIVNRNTTPENKVTWLLVAFVPVFGPLLYLMFGERRLSKKEIKQLKKLGSMHFQEANSQLLKEKLKESDKAAYGVIKSLLSMDTNADIYDQTASTFFPNGEAMWKKMVEDLKKAEKFIFLEYYIIEEGLMWNRILDILEQKVAQGVEVKMLYDDIGCMATLTGDYAHRLRQLGIEAHKFNKVIPRLTVAYNNRDHRKILIVDGQIAYTGGVNLADEYINHVERFGYWKDSGIRLDGLAVKALTRLFLTTWYINRGEISDFDQYHLENHSIPSDGLTIPYGSGPKPIFRAQVGKKVYQSLINQATESVYITTPYLIIDYDLTETIKNAAMRGVDVRIITPYIPDKKFIQLVTRGAYPDLLSAGVRIYEYSPGFIHSKQMLVDEDFAVVGTINLDYRSLVHHYENAVLLYKTPSIREIARDFRNIFADSQEVYPHSIKTSWYQKLVKEIAQLFAPIL

SEQ ID NO: 4159 - protein, 185 aa, Streptococcus pneumoniae
LTPLFELVILGELLVRENFSKLVAERKFIMKLKRFTLSLASLASFSLLVACSQRAQQVQQPVAQQQVQQPAQQPAQQNTNTANAGGNQNQAAPVQNQPVAQPTDIDGTYTGQDDGDRITLVVTGTTGTWTELESDGDQKVKQVTFDSANQRMIIGDDVKIYTVNGNQIVVDDMDRDPSDQIVLTK

SEQ ID NO: 4160 - protein, 69 aa, Streptococcus pneumoniae
ALCEQATKRLKLAREARESVNLFNFMMNFLSATNLEKFSLTSNSPSITSSNKGVNLSAHGPAGSPVLLR

SEQ ID NO: 4161 - protein, 129 aa, Streptococcus pneumoniae
LERIRPQIYLDGAHNLPALTRLVEFIKEKEQEGYRPQILFGALKRKDYQGMLGYLTEKLPQVELKVTGFDYQGALDERDVTGYDIVSSYREFISDFEERADAQDLLFVTGSLYFISEVRGYLLDREQIN

SEQ ID NO: 4162 - protein, 160 aa, Streptococcus pneumoniae
LVAYLTRPMWVTGELAVITSIGLDHQETLGDSLEAIAEQKAGIFKAGKKAVIAKLPPEARLVCQKKAESLAVNLYQAGQDFLMLNGDFSSSLLNLSQLNIGLEGVYQQENAALALQTFLLFMGEGKEAVDEQAVRKALEQTHWGWSLGAYSPTDLLGWCS

SEQ ID NO: 4163 - protein, 164 aa, Streptococcus pneumoniae
MFEVEEWLHSRIGLNFRSCLGRMQQAVDLLGNPEQSYPIIHVTGTNGKGSTIAFMRELFMGHGKKVATFTSPHIVSINDRICINGQPIADADFIRLTDQVKEMEKTLLQTPAQLSFFELLTLVAFLYFREQEVDLVLLEVGIGGLLDTTNVGNWRACCHHLHWA

SEQ ID NO: 4164 - protein, 101 aa, Streptococcus pneumoniae
MSHDHNHDHEERELITLVDEQGNETLFEILLTIDGKEEFGKNYVLLVPVNAEEDEDGQVEIQAYSFIENEDGTEGELQPIPEDSEDEWNMIEEVFNSFMEE

SEQ ID NO: 4165 - protein, 139 aa, Streptococcus pneumoniae
MRIMGLDVGSKTVGVAISDPLGFTAQGLEIIQINEEQGQFGSDRVKELVDTYKVERFVVGLPKNMNNTSGPRVEASQAYGAKLEEFFGLPVDYQDERLTTVAAERMLIEQADISRNKRKKVIDKLAAQLILQNYLDRKF

SEQ ID NO: 4166 - protein, 88 aa, Streptococcus pneumoniae
MGFTEETVRFKLDDSNKKEISETLTDVYASLNDKGYNPINQIVGYVLSGDPAYVPRYNNARNQIRKYERDEIVEELVRYYLKGQGVDL

SEQ ID NO: 4167 - protein, 189 aa, Streptococcus pneumoniae
MKKIVLVSLAFLFVLVGCGQKKETGPATKTEKDTLQSALPVIENAEKNTVVTKTLVLPKSDDGSQQTQTITYKDKTFLSLTIQQKRPVSDELKTYIDQHGVEETQKALLEAEEKDKSIIEARKLAGFKLETKLLSATELQTTTSFDFQVLDVKKASQLEHLKNIGLENLLKNEPSKYISDRLANGATEQ

SEQ ID NO: 4168 - protein, 132 aa, Streptococcus pneumoniae
MIKIYTVSSCTSCKKAKTWLNAHQLSYKEQNLGKEGITREELLDILTKTDNGIASIVSSKNRYAKALGVDIEDLSVNEVLNLIMETPRILKSPILVDEKRLQVGYKEDDIRTFLPRSVRNVENAEARLRAAL

SEQ ID NO: 4169 - protein, 125 aa, Streptococcus pneumoniae; identical to SEQ ID NO: 3173

SEQ ID NO: 4170 - protein, 130 aa, Streptococcus pneumoniae
MMVNKKQVKVGISTIYYWFHNGHLGLTKADMLYPRKRKGVKKQASPNFKPAGKSIEERPDVINLRLENGHYEIDTVLLTKIKNYCLLVLTDRRSIQRIVRSSIISPPPPPPPPPPPPPPTGRLYSSAVKT

SEQ ID NO: 4171 - protein, 295 aa, Streptococcus pneumoniae
LVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPAAFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 4172 - protein, 61 aa, Streptococcus pneumoniae
VFDKKHAFANLLCKNFDELVILTKIAIVKHQALTRDRLNHASLMYSSSRFMASLIVSMLAA

SEQ ID NO: 4173 - protein, 256 aa, Streptococcus pneumoniae
MIQSITSQGLVLYNRNFREDDKLVKIFTEQVGKRMFFVKHAGQSKLAPVIQPLVLARFLLRINDDGLSYIEDYHEVMTFPKINSDLFVMAYATYVAALADASLQDNQQDAPLFAFLQKTLELMEAGLDYQVLTNIFEIQILTRFGISLNFNECVFCHRVGQAFDFSFKYGACLCPEHYHEDKRRCHLNPNIPYLLNQFQAIDFETLETISLKPGIKQELRQFMDQLYEEYVGIHLKSKKFIDSLADWGQLLKEEKK

SEQ ID NO: 4174 - protein, 330 aa, Streptococcus pneumoniae
MKKIAVDAMGGDYAPQAIVEGVNQALSDFSDIEVQLYGDEAKIKQYLTATERVSIIHTDEKIDSDDEPTRAIRNKKNASMVLAAKAVKDGEADAVLSAGNTGALLAAGFFIVGRIKNIDRPGLMSTLPTVDGKGFDMLDLGANAENTAQHLHQYAVLGSFYAKNVRGIAQPRVGLLNNGTESSKGDPLRKETYELLVADESLNFIGNVEARDLMNGVADVVVADGFTGNAVLKSIEGTAMGIMGLLKTAITGGGLRAKLGALLLKDSLRGLKKQLNYSDVGGAVLFGVKAPVVKTHGSSDAKAVYSTIRQIRTMLETDVVAQTAREFSGE

SEQ ID NO: 4175 - protein, 111 aa, Streptococcus pneumoniae
LELRLLFSLNDFNHISYVLELVNFFIADFDTKFIFQSQDKLHQVNRIRIQIVFQTQGFCHDKVLSLSLLDNGHNTVKNFFFCHLFYSPENSRAVWATTSVSSMVRIWRIVL

SEQ ID NO: 4176 - protein, 77 aa, Streptococcus pneumoniae
MTEKEIFDRIVTIIQERQGEDFVVTESLSLKDDLDADSVDLMEFILTLEDEFSIEISDEEIDQLQNVGDVVKIIQGK

SEQ ID NO: 4177 - protein, 97 aa, Streptococcus pneumoniae
MRNIGQAGKILADSGYQGLMKIYPQAQTPRKSSKLKPLTLEDKACNHALSKERSKVENIFAKVKTFKMFSTTYRNHRKRFGLRMNLIAGIINHELGF

SEQ ID NO: 4178 - protein, 76 aa, Streptococcus pneumoniae
MNTKKMSQFEIMDTEMLACVEGGGCNWGDFAKAGVGGGVARGLQLGIKTRTWQGAATGAAGGAILGGVAYAATCWW

SEQ ID NO: 4179 - protein, 68 aa, Streptococcus pneumoniae
MARCSNWCCGRSYTWRCGLCSDMLVVIMDFKSFIIGLVVGIFGPYMDDLIRKKFLKSSEKKTEKSIKK

SEQ ID NO: 4180 - protein, 719 aa, Streptococcus pneumoniae
MNMKFGKRHYRPQVDQMDCGVASLAMVFGYYGSYYFLAHLRELAKTTMDGTTALGLVKVAEEIGFETRAIKADMTLFDLPDLTFPFVAHVLKEGKLLHYYVVTGQDKDSIHIADPDPGVKLTKLPRERFEEEWTGVTLFMAPSPDYKPYKEQKNGLLSFIPILVKQRGLIANIVLATLLVTVINIVGSYYLQSIIDTYVPDQMRSTLGIISIGLVIVYILQQILSYAQEYLLLVLGQRLSIDVILSYIKHVFHLPMSFFATRRTGEIVSRFTDANSIIDALASTILSIFLDVSTVVIISLVLFSQNTNLFFMTLLALPIYTVIIFAFMKPFEKMNRDTMEANAVLSSSIIEDINGIETIKSLTSESQRYQKIDKEFVDYLKKSFTYSRAESQQKALKKVAHLLLNVGILWMGAVLVMDGKMSLGQLITYNTLLVYFTNPLENIINLQTKLQTAQVANNRLNEVYLVASEFEEKKTVEDLSLMKGDMTFKQVHYKYGYGRDVLSDINLIVPQGSKVAFVGISGSGKTTLAKMMVNFYDPSQGEISLGGVNLNQIDKKALRQYINYLPQQPYVFNGTILENLLLGAKEGTTQEDILRAVELAEIREDIERMPLNYQTELTSDGAGISGGQRQRIALARALLTDAPVLILDEATSSLDILTEKRIVDNLMALDKTLIFIAHRLTIAERTEKVVVLDQGKIVEEGKHADLLAQGGFYAHLVNS

SEQ ID NO: 4181 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSATQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 4182 - protein, 249 aa, Streptococcus pneumoniae
VVKCAQVIRKANFKMSKQLIYSGKAKDIYTTEDENLIISTYKDQATAFNGVKKEQIAGKGVLNNQISSFIFEKLNAAGVATHFVEKLSDTEQLNKKVKIIPLEVVLRNYTAGSFSKRFGVDEGIALETPIVEFYYKNDDLDDPFINDEHVKFLQIAGDQQIAYLKEETRRINELLKVWCTEIGLKLIDFKLEFGFDKDGKIILADEFSPDNCRLWDADGNHMDKDVFRRGLGELTDVYEIVWEKLQELK

SEQ ID NO: 4183 - protein, 253 aa, Streptococcus pneumoniae
MDKRIFVEKKADFQVKSESLVRELQHNLGLSSLKSIRIVQVYDVFDLAEDLFAPAEKHIFSEQGTDHVLDEVSVQADLANYAFFAIESLPGQFDQRAASSQEALLLLGSSSDVTVNTAQLYLVNKDIDATELEAVKNYLLNPVDSRFKDITTGIAKQEFSESDKTIPKLTFFESYTAEDFARYKAEQGMAMEVDDLLFIQDYFKSIGRVPTDTELKVLDTYWSDHCRHTTLETELKHIDFSAFKFPKQLAGNL

SEQ ID NO: 4184 - protein, 94 aa, Streptococcus pneumoniae
LFQSKTLSLLVTLSTSSNWQLALSGYLNAINPFDPPSVEAYKRNLLALLGKPGMENWSKGLTARLLLKKKGVGPLFLIFFSLRNWTHPGFVIYF

SEQ ID NO: 4185 - protein, 456 aa, Streptococcus pneumoniae
VAFYANVGILIKIGEIRQKNLKKTKVSVMIEKKKYWRKNMSHIKFDYSKVLDKFVAPHEVEYMQSQVTAADELIRKGTGAGSDFLGWLDLPEKYDREEFDRILKAAEQIKSDSDVLVVIGIGGSYLGAKAAIDFLNHHFANLQTKEERKAPQILYAGNSISSTYLADLVEYVADKDFSVNVISKSGTTTEPAIAFRVFKELLVKKYGQEEANKRIYATTDRQKGAVKVEADANGWGTFVVPDDIGGRFSVLTAVGLLPIAASGADIKALMEGANAARKDYTSDKISENEAYQYAAVRNILYRKGYATEILVNYEPSLQYFSEWWKQLAGESEGKDQKGIYPTSANFSTDLHSLGQFIQEGTRIMFETVVRVDKPRKNVLIPTLEEDLDGLGYLQGKDVDFVNKKATDGVLLAHTDGDVPNMYVTLPEQDAFTLGYTIYFFELAIGPFRLLECYQPI

SEQ ID NO: 4186 - protein, 245 aa, Streptococcus pneumoniae
LSDMIGLSLAFERRGIMARTVVGVAANLCPVDAEGKIIHSSVSCRFAEIIRQVGGLPLVIPVGDESVVRDYVEMIDKLILTGGQNVHPQFYGEKKTVESDDYNLVRDEFELALLKEALRQNKPIMAICRGVQLVNVAFGGTLNQEIEGHWQGLPFGTSHSIETVEGSVVAKLFGKESQVNSVHRQSIKDLAPNFRVTAIDSRDQTIEAIESIDEHRIIGLQWHSEFLVNEEDGNLELFEYLLNEL

SEQ ID NO: 4187 - protein, 603 aa, Streptococcus pneumoniae
LAVANCAKYNIRRSKMKTVQFFWHYFKVYKFSFVVVILMIVLATFAQALFPVFSGQAVTQLANLVQAYQNGNPELVWQSLSGIMVNLGLLVLVLFISSVIYMCLMTRVIAESTNEMRKGLFGKLAQLTVSFFDRRQDGDILSHFTSDLDNILQAFNESLIQVMSNIVLYIGLILVMFSRNVTLALITIASTPLAFLMLIFIVKMARKYTNLQQKEVGKLNAYMDESISGQKAVIVQGIQEDMMAGFLEQNERVRKATFKGRMFSGILFPVMNGMSLINTAIVIFAGSAVLLNDKSIETSTALGLIVMFAQFSQQYYQPIIQVAASWGSLQLAFTGAERIQEMFDAEEEIRPEKAPTFTKLQESVEISHIDFSYLPDKPILKDVSISAPKGQMTAVVGPTGSGKTTIMNLINRFYDVDAGGIYFDGKDIRGYDLDSLRSKVGIVLQDSVLFSGTIRDNIRFGVPDASQEMVEVAAKATHIHDYIESLPDKYDTLIDDDQSIFSAGQKQLISIARTLMTDPEVLILDEATSNVDTVTESKIQHAMEVVVAGRTSFVIAHRLKTILNADQIIVLKDGEVIERGNHHELLKLGGFYSELYHNQFVFE

SEQ ID NO: 4188 - protein, 71 aa, Streptococcus pneumoniae
TIPNPSNRRYDRVELSHQVIDTCFRLVNEPLVMFDVFITRDKTFMRYQTHDQLKQKAVVRSFRKLSSDWRK

SEQ ID NO: 4189 - protein, 107 aa, Streptococcus pneumoniae
LFQLVMSLITHKRFISCNENIKHYKRLIDKAETCVNDLMAEFNSIITTVTGIGNRLGAVILAEIRNIHAFDNPAQLQAFAGLDSSIYQSGQIDLAGRMVKRGSPHLR

SEQ ID NO: 4190 - protein, 195 aa, Streptococcus pneumoniae
LAQLIPRLFDPQNGAIKIGGTDIRDVSEGNLRQTVSSFSKRSILFSVTVADNLRQGKGNATLFEMERARNIAQASEFIHRMEKNFESPVEERGTNFSGGQKQRMSIARGIVSNPRILIFDDSTSALDAKSERLVQEALNKDLKGTTTIIIAQKISSVVHADKILVLNQGRLIGQGTHADLVANNAVYREIYETQK

SEQ ID NO: 4191 - protein, 360 aa, Streptococcus pneumoniae
MLIQKIKTYKWQALASLLMTGLMVASSLLQPRYLQEVLDALLTGKYEAIYSIGAWLIGVAVVGLVAGGLNVVLAAYIAQGVSSDLREDAFRKIQTFSYADIEQFNAGNLVVRMTNDINQIQNVVMMTFQILFRLPLLFIGSFILAVQTLPSLWWVIVLMVVLIFGLTAVMMGMMGPRFAKFQTLLERINAIAKENLRGVRVVKSFVQEKEQFAKFTEISDELFGQNLYIGYAFSVVEPFMMLVGYGAVFLSIWLVAGMVQSDPSVVGSIASFVNYLSQIIFTIVMVGFLGNSVSRAMISMRRIREILDAEPAMTFKDIPDEELVGSLSFENVTFTYPMDKEPMLKDVSFTIEPCQMVGVV

SEQ ID NO: 4192 - protein, 654 aa, Streptococcus pneumoniae
MNLVLSYEKESFEDLHLLDLRLATVEQTASSKLLQYVHRTQMRELNHLKPVIRYEIKDFLQMDYATKASLDLVENARSGKKQGSLFWLLDETKTAMGMRLLRSWIHRPLIDKERIVQRQEVVQVFLDHFFERSDLTDSLKGVYDIERLASRVSFGKTNPKDLLQLATTLSSVPRIRAILEGMEQPTLAYLIAQLDAIPELESLISAAIAPEAPHVITDGGIIRTGFDETLDKYRCVLREGTSWIAEIEAKERENSGISTLKIDYNKKDGYYFHVTNSQLGNVPAHFFRKATLKNSERFGTEELARIEGDMLEAREKSANLEYEIFMRIREEVGKYIQRLQALAQGIATVDVLQSLAVVAETQHLIRPEFGDDSQIDIRKGRHAVVEKVMGAQTYIPNTIQMAEDTSIQLVTGPNMSGKSTYMRQLAMTAVMAQLGSYVPAESAHLPIFDAIFTRIGAADDLVSGQSTFMVEMMEANNAISHATKNSLILFDELGRGTATYDGMALAQSIIEYIHEHIGAKTLFATHYHELTSLESSLQHLVNVHVATLEQDGQVTFLHKIEPGPADKSYGIHVAKIAGLPADLLARADKILTQLENQGTESPPPMRQTSAVTEQISLFDRAEEHPILAELAKLDVYNMTPMQVMNVLVELKQKL

SEQ ID NO: 4193 - protein, 181 aa, Streptococcus pneumoniae
LLSRLIFEKERQKMAIEKLSPGMQQYVDIKKQYPDAFLLFRMGDFYELFYEDAVNAAQILEISLTSRNKNADNPIPMAGVPYHSAQQYIDVLIEQGYKVAIAEQMEDPKQAVGVVKREVVQVITPGTVVDSSKPDSQNNFLVSIDREGNQFGLAYMDLVTGDFYVTGLLDFTLVCGEIRNL

SEQ ID NO: 4194 - protein, 148 aa, Streptococcus pneumoniae
MRKRDRHQLIKKMITEEKLSTQKEIQDRLEAHNVCVTQTTLSRDLREIGLTKVKKNDMVYYVLVNETEKIDLVEFLSHHLEGVARAEFTLVLHTKLGEASVLANIVDVNKDKWILGTVAGANTLLVICRDQHVAKLMEDRLLDLMKDK

SEQ ID NO: 4195 - protein, 563 aa, Streptococcus pneumoniae
MNTKELIASKLSSIIDSLDQEAILKLLETPKNSEMGDIAFPAFSLAKVERKAPQMIAAELAEKMNSQAFEKVVATGPYVNFFLDKSAISAQVLQAVTTEKEHYADQNIGKQENVVIDMSSPNIAKPFSIGHLRSTVIGDSLSHIFQKIGYQTVKVNHLGDWGKQFGMLIVAYKKWGDEEAVKAHPIDELLKLYVRINAEAENDPSLDEEAREWFRKLENGDEEALALWQWFRDESLVEFNRLYNELKVEFDSYNGEAFYNDKMDAVVDILSEKGLLLESEGAQVVNLEKYGIEHPALIKKSDGATLYITRDLAAALYRKNEYQFAKSIYVVGQEQSAHFKQLKAVLQEMGYDWSDDITHVPFGLVTKEGKKLSTRKGNVILLEPTIAEAVSRAKVQIEAKNPELENKDQVAHAVGVGAIKFYDLKTDRTNGYDFDLEAMVSFEGETGPYVQYAYARIQSILRKADFKPETSGNYSLNDTESWEIIKLIQDFPRIINRAADNFEPSIIAKFAISLAQSFNKYYAHTRILDESPERDSRLALSYATAVVLKEALRLLGVEAPEKM

SEQ ID NO: 4196 - protein, 149 aa, Streptococcus pneumoniae
KSIALKKQLANDFGKKKFHAMKAQAIVTSQGRIVSLDIAVNYCHDMKLFKMSRRNIGQAGKILADSGYQGPMKIYPQAQTPRKSSKLKPLTVEDKACNHALSKERSKVENIFAKVKTFKMFSTTYRNHRKRFGLRMNLIAGIINHELGF

SEQ ID NO: 4197 - protein, 67 aa, Streptococcus pneumoniae
LIFTSVASIIIVSSELRGVLEIVTPPLNKSYFNPLAPTDKEDLIRTLELAPHVEGGYFRQTKKLQTL

SEQ ID NO: 4198 - protein, 94 aa, Streptococcus pneumoniae
LTADEIWYFHAGSPLTVHMITADGHYEAVTLGLDISKGQQLHYCVPKGTIWGSTVDKDYALVSCLVAPGFEFEDFELFERVDLTGDLSRAQGDD

SEQ ID NO: 4199 - protein, 235 aa, Streptococcus pneumoniae
MTKQVLLVDDEEHILKLLDYHLSKEGFSTQLVTNGRKALALAETEPFDFILLDIMLPQLDGMEVCKRLRAKGVKTPIMMVSAKSDEFDKVLALELGADDYLTKPFSPRELLARVKAVLRRTKGEQEGDDSDNIADDSWLFGTLKVYPERHEVYKANKLLSLTPKEFELLLYLMKHPNMTLTRERLLERIWGYDFGQETRLVDVHIGKLREKIEDNPKAPQFIRTIRGYGYKFKEL

SEQ ID NO: 4200 - protein, 443 aa, Streptococcus pneumoniae
MKRYLQFWLVNLSVSLILIAGMALTWISKGIGLFLLALSLGQGGYWLFCLWKWEVAFETLHQPLLTNSEYFLEKGQEDLKSLAQYVSALKTKVSQQDQQYKDLPETMEVLLSHLTMGTFLVSAQGQMLLSSRSLPHYFPDVDGDISSLDDLKRMDIRNLVHQAFDQKTRLKQKVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 4201 - protein, 291 aa, Streptococcus pneumoniae
MKFKKMLTLAAIGLSGFGLVACGNQSAASKQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 4202 - protein, 271 aa, Streptococcus pneumoniae
MSATVAVVAILLICFFIFSNGLPFMANYGFARFLLGSDWSPTNIPASYGILPMIVGSLLITLGAIVIGVPTGILTSVFMVYYCPKPVYGFLKSAINLMAAIPSIVYGFFGLQLLVPWIRTFLGNGMSVLTASLLLGIMILPTIISLSESAIRTVPKTYYSGSLALGASHERSIFSVILPAARSGILSAVILGIGRAVGETMAVILVAGNQPIIPSGLFSGTRTLTTNIVLEMAYASGQHREALIATSAVLFFLILLINAYFAYLKGKSSYE

SEQ ID NO: 4203 - protein, 271 aa, Streptococcus pneumoniae
MSKYLLKLLVYCFSALTFGSLFLIIGFILIKGLPHLSLSLFSWTYTSENISLMPAIISTVILVFGALLLALPIGIFAGFYLVEYTKKDSLCVKIMRLASDTLSGIPSIVFGLFGMLFFVVFLGFQYSLLSGILTSVIMVLPVIIRSTEEALLSVSDSMRQASYGLGAGKLRTVFRIVLPVAMPGILAGVILAIGRIVGETAALMYTLGTSTNTPSSLMSSGRSLALHMYMLSSEGLHVNEAYATGVILIITVLMINTLSSLLSRKLVKGAS

SEQ ID NO: 4204 - protein, 250 aa, Streptococcus pneumoniae
MGTFSVRHLDLFYGDFQALKNISIQLPERQITALIGPSGCGKSTFLKTLNRMNDLVPSCHIEGQVLLDEQDIYSSKFNLNQLRKRVGMVFQQPNPFAMSIYDNVAYGPRTHGIRDKKQLDALVEKSLKGAAIWEEVKDDLKKSAMSLSGGQQQRLCIARALAVEPDILLMDEPTSALDPISTLKIEDLIQQLKKDYTIIIVTHNMQQASRISDKTAFFLTGEICEFGDTVDVFTNPKDQRTEDYISGRFG

SEQ ID NO: 4205 - protein, 216 aa, Streptococcus pneumoniae
MRNQFDLELHELEQSFLGLGQLVLETASKALLALASKDKEMAELIINKDHAINQGQSAIELACARLLALQQPQVSDLRFVISIMSSCSDLERMGDHMAGIAKAVLQLKENQLAPDEEQLHQMGKLSLSMLADLLVAFPLHQASKAISIAQKDEQIDQYYYALSKEIIGLMKDQETSIPNGTQYLYIIGHLERFADYIANICERLVYLETGELVDLN

SEQ ID NO: 4206 - protein, 141 aa, Streptococcus pneumoniae
LNNLSSVDSEELFQFYRERGNAENFIKERKAGFFGDKTDSSTMIKNEVRMMMGCLAYNLYLFLKQLAGDEVKALTIKRFRRLFLHIAGKYVSTARRHILKFSSLYAYSKQFQALFDTICQINLILPVPYRARGQGKTCLTE

SEQ ID NO: 4207 - protein, 72 aa, Streptococcus pneumoniae
MPNRISHLILKIEHQTKGGVYPFLGKNQDKSPQLCLEHQKLSKITRRTVFQLAFLVIFELCSSLVPDMNNLG

SEQ ID NO: 4208 - protein, 152 aa, Streptococcus pneumoniae
VRRNLIDSLIQYMLIIGVNNSGGSCRLREFGEKIKRLRLAKKISRSEFCGDESELSIRQLIRIENGESRPTLTKLKYIAERLGVEDYKLMPSYIELDKEYLELKYFLMRTPTYEDETIAQKKESVLIRFLKSIMIGYLRKKDLSSQIIHIWH

SEQ ID NO: 4209 - protein, 338 aa, Streptococcus pneumoniae
MEKQTVAVLGPGSWGTALSQVLNDNGHEVRIWGNLPEQINEINTHHTNKHYFKDVVLDENIIAYTDLAETLKDVDAILFVVPTKVTRLVAQQVAQTLDHKVIIMHASKGLEPDSHKRLSTILEEEIPEHLRSDIVVVSGPSHAEETIVRDLTLITAASKDLQTAQYVQELFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 4210 - protein, 299 aa, Streptococcus pneumoniae
MTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFTGARYDVGDKFGFMKTSIDYALKHPQVKDDLKNYLIQLGKELTEKE

SEQ ID NO: 4211 - protein, 224 aa, Streptococcus pneumoniae
MKKDKAFFEPYLFILFLLSQFFSKLDEVILQIIFDLWVFEGVVNRCFHKAKLIPNVVTSSCKFTGKNTLCFIKSIDCISKLDFISSTRSLLFENLKNFRREEVASDNSKVARSVLWSWFFNKGFNTVKTIFSFALRSNNPVSRYFVMRDWHDSDSRRVGTLVVIHELFGKWNSLFVCDIHQVITKHNDKRFISDESLGLQNSISETAWMSLADKMQTHASCFIN

SEQ ID NO: 4212 - protein, 226 aa, Streptococcus pneumoniae
LMKEIFDRRYPVTSFFLLVTTLVFLLMLVTTGGNFDRADTLFRFGAMYGPAIRLFPEQVWRLLSAIFVHIGWEHFIVNMLSLYYLGRQVEEIFGSKQFFFLYLLSGMMGNLFVFVFSPKSLAAGASTSLYGLFAAIIVLRYATRNPYIQQLGQSYLTLFVVNIIGSVLIPGISLAGHIGGAVGGAFLAVIFPVRGEKRMYNTSQRLGAVVLFVGLAILLFYKGMGM

SEQ ID NO: 4213 - protein, 181 aa, Streptococcus pneumoniae
LYMKSELRKQVLHEMKALSQEQKQAIDQALTERILQHPFYQEAKVIATYLSFSHEFQTRELIEQALKDGKKVLIPKTYPKGRMDFVVYDPQQLVKTAFALLEPQGDLEVVDVSQIDLIHVPGLAFTTDGYRIGYGGGYYDRYLEHFSGHTLSTVHPCQIQDFIPENHDIPVQEVLIDEGNL

SEQ ID NO: 4214 - protein, 376 aa, Streptococcus pneumoniae
MLDLIQTRRDLHQIPEIGLEEFKTQAYLLDVIEKLTTGKDFVQIRTWRTGILVYLQGSQPERTIGWRTDIDGLPIVEQTGLPFASQHQGRMHACGHDFHMTIALGCLERALEEQPKNNLLFLFQPAEENEAGGMLMYEDGAFGDWLPNQFYGLHVRPDLKVGQIATNTHTLFAGTCEVKIRFKGKGGHAAFPHEANDALVAASYFVTQVQSVVSRNVNPIEGAVVTFGVFQAGTTNNVITDTAFLHGTIRALTQDMSLLVQKRVKTVAEGVAAAFDMEVEVELKQGGYLPVENNPALARELMDFFDEKDGIELIDIEPAMTGEDFGYLLSKVDGVMFWLGIDSPYALHHPQMSPKEEVLAIGVAAVSSFLKKKAAE

SEQ ID NO: 4215 - protein, 232 aa, Streptococcus pneumoniae
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGAVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 4216 - protein, 152 aa, Streptococcus pneumoniae
VWASISLIIRAGTPATTTFSGTSWVTIAPAATTEPLPIWTPSITTALAPIRTLSPTRTGSALAGSITPAKTAPAPTWLFFPTMARPPRMAPMSIMVPAPISAPILITAPIMITALSPISTWSRIIAPGSIRALIARLSSKGTAELRASCSTT

SEQ ID NO: 4217 - protein, 71 aa, Streptococcus pneumoniae
MILAGLFSNVLSPVYELSFTLDIWSILICLIIAFFGTAFAFFISMKAVSLVSPLVGFPLTQCAVNLSLLLS

SEQ ID NO: 4218 - protein, 277 aa, Streptococcus pneumoniae
LLLVEVMRIIRMLGLVLWGVYQLHPAPAVQVVVLAIAVTQVLHDLLQGRDDNSLNEVANQWIATFFLSCYNKGMNQYQKKIVNGKIYSLLSGLIWGICGILGKYFFTHYQVSSGWITSMRLTLAGSLVLIWSAIQLKSQVLDIWRDKKNYLPFLAYAILGIFSVQYFFYLCVEYSNATTATILQFISPVFILFYNRLVYQKRASKSAVFYVLVAMLGVCLMATKGDLSQLSMTPLALITGLLSAMGVMFNVILPQPFAKRYGFVLTSLLGDDFGRFV

SEQ ID NO: 4219 - protein, 820 aa, Streptococcus pneumoniae
MQNQLNELKRKMLEFFQQKQKNKKSARPGKKGSSTKKSKTLDKSVIFPAILLSIKALFNLLFVLGFLGGMLGAGIALGYGVALFDKVRVPQTEELVNQVKDISSISEITYSDGTVIASIESDLLRTSISSEQISENLKKAIIATEDEHFKEHKGVVPKAVIRATLGKFVGLGSSSGGSTLTQQLIKQQVVGDAPTLARKAAEIVDALALERAMNKDEILTTYLNVAPFGRNNKGQNIAGARQAAEGIFGVDASQLTVPQAAFLAGLPQSPITYSPYENTGELKSDEDLEIGLRRAKAVLYSMYRTGALSKDEYSQYKDYDLKQDFLPSGTVTGISRDYLYFTTLAEAQERMYDYLAQRDNVSAKELKNEATQKFYRDLAAKEIENGGYKITTTIDQKIHSAMQSAVADYGYLLDDGTGRVEVGNVLMDNQTGAILGFVGGRNYQENQNNHAFDTKRSPASTTKPLLAYGIAIDQGLMGSETILSNYPTNFANGNPIMYANSKGTGMMTLGEALNYSWNIPAYWTYRMLREKGVDVKGYMEKMGYEIPEYGIESLPMGGGIEVTVAQHTNGYQTLANNGVYHQKHVISKIEAADGRVVYEYQDKPVQVYSKATATIMQGLLREVLSSRVTTTFKSNLTSLNPTLANADWIGKTGTTNQDENMWLMLSTPRLTLGGWIGHDDNHSLSRRAGYSNNSNYMAHLVNAIQQASPSIWGNERFALDPSVVKSEVLKSTGQKPGKVSVEGKEVEVTGSTVTSYWANKSGAPATSYRFAIGGSDADYQNAWSSIVGSLPTPSSSSSSSSSSSDSSNSSTTRPSSRARR

SEQ ID NO: 4220 - protein, 418 aa, Streptococcus pneumoniae
MHIFDELKDRGLIFQTTDEEALRKALEEGQVSYYTGYDPTADSLHLGHLVAILTSRRLQLAGHKPYALVGGATGLIGDPSFKDAERSLQTKDTVDGWVKSIQGQLSRFLDFENGENKAVMVNNYDWFGSISFIDFLRDIGKYFTVNYMMSKESVKKRIETGISYTEFAYQIMQGYDFFVLNQDHNVTLQIGGSDQWGNMTAGTELLRRKADKTGHVITVPLITDATGKKFGKSEGNAVWLNPEKTSPYEMYQFWMNVMDADAVRFLKIFTFLSLDEIEDIRKQFEAAPHERLAQKVLAREVVTLVHGEEAYKEALNITEQLFAGNIKNLSVKELKQGLRGVPNYQVQADENNNIVELLVSSGIVNSKRQAREDVQNGAIYVNGDRIQELDYVLSDADKLENELTVIRRGKKKYFVLTY

SEQ ID NO: 4221 - protein, 690 aa, Streptococcus pneumoniae
VNNMSFKVLHRGYQHIRLSSSFSLTLDIQDYLRSLARDEKGIESIQFYMDQQHFTLRIKEGFSVLDNAEAFLKRIDKGKVSELMTLPIRREESAYSIVSGAAVKRVLFRSFVPYPIRYIWTCYQALGYIREAYQTLARKELTMEVLDCSAILLSLFMNQSKTASNIMFMLDLGNHLDQWSLKKTATDLEQSLLAKESDVFLVQGDTVVSIKSSDVQIGDVLILSQGNEILFDGQVVSGLGMVNESSLTGESFPVEKRESDLVCANTVLETGELRIRVTDNQMNSRILQLIELMKKSEENKKTKQRYFIKMADKVVKYNFLGAGLTYLLTGSFSKAISFLLVDFSCALKISTPVAYLTVIKEGLNREMVIKDGDVLEKYLEVDTFLFDKTGTITTSYPIVEKVLPFGDYSEEDILRISACLEEHIYHPIANAIVKQAEIEGIEHEEMHGKLQYIASKGIKSHIDGQPVLIGNYVLMQDEQIHISSEQNALIEEYKSHYNLLFLAYQNELIGMFCIHTPLRKEAKTALDKLKAQGKKLILATGDTLIRTEELVKDLPFDQVYTDLKPDGKFELVEKLQKAGHTILMVGDGLNDSAALTLSDIGVVMNESADISKQMSDILLLDNRLDFFQELDSLSSSLQTLIKKNIQDTVVVNSSLIGFGLFNWFSPSNLSILHNLTTLRIVLRSLSIKNR

SEQ ID NO: 4222 - protein, 64 aa, Streptococcus pneumoniae
LKILASKEAKKGYSKALAKAYKLKDELDASVSVVKQHGDDVLQDAKYLYEQEKKEEQLDSLIGE

SEQ ID NO: 4223 - protein, 87 aa, Streptococcus pneumoniae
MNTNLKPKLQRFASATAFACPICQENLTLLETNFKCCNRHSFDLAKFGYVNLAPQIKQSANYDKENFQNRQQIRRSRLLPSYLRCCI

SEQ ID NO: 4224 - protein, 196 aa, Streptococcus pneumoniae
MTRKIFKTVNKSVEAGFYQAILDAVSDLLASSKTTITILDIGCGEGFYSRKLQESHSEKTFYAFDISKDSVQIAAKSEPNWAVNWFVGDLARLPIKDASMDILLDIFSPANYGEFRRVLSKDGILIKVIPTENHLKEIRQRVQDQLTNKEYSNQDIKEHFQEHFTILSSQTASLTKTITAEQLQALLSMNSSPLAR

SEQ ID NO: 4225 - protein, 56 aa, Streptococcus pneumoniae
LSLLFIILNLFILYKIYSLRREKSKYLIYTAYIIFGVNVVYGIQWLLKELISTISP

SEQ ID NO: 4226 - protein, 190 aa, Streptococcus pneumoniae
MNKLMKFISVFLTSIVLIVSAIPSVSAVYASEQVSQIETNMELQPVTSLTEEQINTLANEIQSFHPDVSQQWIKEVINRQLQGDYTIPPTYSPFRAAWQGITVNQMGALLDTAIALALGGTTAGLANLIKVKGKHAAKSAIRSAISRYLGSWFVNDVALEFAMNLLSPGTYLAQLWDKNDAIPNNRRINF

SEQ ID NO: 4227 - protein, 752 aa, Streptococcus pneumoniae
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAAVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGDENIYIFGEDSETVIDLYAKAAYKSSEFYAREAIKPLVDFIVSDAVLAAGNKERLERLYNELINKDWFMTLLDLEDYIKVKEQMLADYEDRDAWLDKVIVNISKAGFFSSDRTIAQYNEDIWHLN

SEQ ID NO: 4228 - protein, 505 aa, Streptococcus pneumoniae
MKKRQSGVLMHISSLPGAYGIGSFGQSAYDFVDFLVRTKQRYWQILPLGATSYGDSPYQSFSAFAGNTHFIDLDILVEQGLLEASDLEGVDFGSDASEVDYAKIYYARRPLLEKAVKRFFEVGDVKDFEKFAQDNQSWLELFAEYMAIKEHFDNLAWTEWPDADARARKASALESYREQLADKLVYHRVTQYFFFQQWLKLKAYANDNHIEIVGDMPIYVAEDSSDMWANPHLFKTDVNGKATCIAGCPPDEFSVTGQLWGNPIYDWEAMDKDGYKWWIERLRESFKIYDIVRIDHFRGFESYWEIPAGSDTAAPGEWVKGPGYKLFAAVKEELGELNIIAEDLGFMTDEVIELRERTGFPGMKILQFAFNPEDESIDSPHLAPANSVMYTGTHDNNTVLGWYRNEIDDATREYMARYTNRKEYETVVHAMLRTVFSSVSFMAIATMQDLLELDEAARMNFPSTLGGNWSWRMTEDQLTPAVEEGLLDLTTIYRRINENLVDLKK

SEQ ID NO: 4229 - protein, 423 aa, Streptococcus pneumoniae
MSSKFMKSTAVLGTVTLASLLLVACGSKTADKPADSGSSEVKELTVYVDEGYKSYIEEVAKAYEKEAGVKVTLKTGDALGGLDKLSLDNQSGNVPDVMMAPYDRVGSLGSDGQLSEVKLSDGAKTDDTTKSLVTAANGKVYGAPAVIESLVMYYNKDLVKDAPKTFADLENLAKDSKYAFAGEDGKTTAFLADWTNFYYTYGLLAGNGAYVFGQNGKDAKDIGLANDGSIVGINYAKSWYEKWPKGMQDTEGAGNLIQTQFQEGKTAAIIDGPWKAQAFKDAKVNYGVATIPTLPNGKEYAAFGGGKAWVIPQAVKNLEASQKFVDFLVATEQQKVLYDKTNEIPANTEARSYAEGKNDELTTAVIKQFKNTQPLPNISQMSAVWDPAKNMLFDAVSGQKDAKTAANDAVTLIKETIKQKFGE

SEQ ID NO: 4230 - protein, 430 aa, Streptococcus pneumoniae
MEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMVAFKKLHAFDMEDV

SEQ ID NO: 4231 - protein, 280 aa, Streptococcus pneumoniae
MNNSIKLKRRLTQSLTYLYLIGLSIVIIYPLLITIMSAFKAGNVSAFKLDTNIDLNFDNFKGLFTETLYGTWYLNTLIIALITMAVQTSIIVLAGYAYSRYNFLARKQSLVFFLIIQMVPTMAALTAFFVMALMLNALNHNWFLIFLYVGGGIPMNAWLMKGYFDTVPMSLDESAKLDGAGHFRRFWQIVLPLVRPMVAVQALWAFMGPFGDYILSSFLLREKEYFTVAVGLQTFVNNAKNLKIAYFSAGAILIALPLCILFFFLQKNFVSGLTSGGDKG

SEQ ID NO: 4232 - protein, 266 aa, Streptococcus pneumoniae
MLPYPFSFFSSIWGFRKPLSKRFELNWFQLLFTSIFLISLSMVPIAIQNSSQETYPLETFIDNVYEPLTDKVVQDLSEHATIVDGTLTYTGTVSQASSIVIGPSQIKELPKDLQLHFDTNELVISKESKELTRISYRAIQTESFKSKDSLTQAISKDWYQQNRVYISLFLVLGASFLFGLNFFIVSLGASLLLYITKKSRLFSFRTFKECYHFILNCLGLPTLITLILGLFGQNMTTLITVQNILFVLYLVTIFYKTHFRDPNYHK

SEQ ID NO: 4233 - protein, 328 aa, Streptococcus pneumoniae
MPVTIKDVAKAAGVSPSTVTRVIQNKSTISDETKKRVRKAMKELNYHPNLNARSLVSSYTQVIGLVLPDDSDAFYQNPFFPSVLRGISQVASENHYAIQIATGKDEKERLNAISQMVYGKRVDGLIFLYAQEEDPLVKLVAEEQFPFLILGKSLSPFIPLVDNDNVQAGFDATEYFIKKGCKRIAFIGGSKKLFVTKDRLTGYEQALKHYKLTTDNNRIYFADEFLEEKGYKFSKRLFKHDPQIDAIITTDSLLAEGVCNYIAKHQLDVPVLSFDSVNPKLNLAAYVDINSLELGRVSLETILQIINDNKNNKQICYRQLIAHKIIEK

SEQ ID NO: 4234 - protein, 113 aa, Streptococcus pneumoniae
LKKLDTMRFIVGRFTSFSTEIESFPKIFLYSMKIKVQTRKLAAGCSKHCFEVVDRTDEVSSKHGFEVVDETDEVSSKHGFEVADETDEVSSKHGFEVADRTDEVSNIYTVRRR

SEQ ID NO: 4235 - protein, 126 aa, Streptococcus pneumoniae
LIVFENLFKPRQRRLTVYMLLTSSVLSATSKPCFELTSSVSSATSKPCFELTSSVSSTTSKPCFELTSSVLSTTSKQCFEQPAASFLVCTLIFIEYKKILGKDSISVEKEVNLPTIKRIVSSFFNT

SEQ ID NO: 4236 - protein, 313 aa, Streptococcus pneumoniae
MKQTKRIKRWRYYLRRFAYQIKILRVLQSISREKYDEKISASLVYGFLSAVAVNFFFQPGHVYSSGATGLAQIISALSNHWFGFHIPISLTFYAINFPLMVLAWYQIGHKFTVFTFITVSMSSFFIQFVPVATLTEDPIINALFGGVVMGLGIGFALRNNISSGGTDIVSLTIRKKTGKNVGSISFLVNGTIMLIAGLTFGWKYALYSMITIFVSSRVTDAVFTKQKRMQAMIVTNHPEKVIEKIHKKLHRGATMIHDAEGTYNHERKAVLITVITRAEFNEFKQIMTQVDPSSFVSVSENVHILGRFVEIDN

SEQ ID NO: 4237 - protein, 587 aa, Streptococcus pneumoniae
MKRSMYAGRVREEHIGQEITLKGWVGRRRDLGGLIFIDLRDREGIMQLVINPEKVSAEVMATAESLRSEFVIEVTGQVAAREQANDKLPTGAVELNVTALIVLNTAKTTPFEIKDGIEANDDTRLRYRYLDLRRPEMLENLKLRAKVTHSIRNYLDELEFIDVETPFLSKSTPEGARDYLVPSRVNKGHFYALPQSPQITKQLLMNAGFDRYYQIVKCFRDEDLRGDRQPEFTQVDLETSFLTEQEIQDITEGLIARVMKETKGIEVTLPFPRMKYDDAMALYGSDKPDTRFDMLLQDLTEVVKGVDFKVFSEAPAVKAIVVKEAADNYSRKDIDKMTEVAKQYGAKGLAWVKVVDGELNGPVAKFLTGIQEELTTALALEDKDLVLFVADTLEVANATLGALRGRIAKELGLIDNDKFNFLWVVDWPMFEWSEEEGRYMSAHHPFTLPQEETVHELEGDLAKVRAIAYDIVLNGYELGGGSLRINQKDLQERMFKALGFSTEEANDQFGFLLEAMDYGFPPHGGLAIGLDRFVMLLAGEENIREVIAFPKNNKATDPMTQAPSTVALKQLEELSLQVEEDETNKTN

SEQ ID NO: 4238 - protein, 143 aa, Streptococcus pneumoniae
LLTRSDLTSHLNNKFATKAFSCCHNLCRYFFRVDNQLHDSFTVTKIDKDQTTKVTTTANPSFQGYFLSDVFLTNTTSIHTTFHYFSPLLFCYYFTIKAQALHENHQKSLPVFKSQVKALKISANTLRKSLQTTSASPYRRYCY

SEQ ID NO: 4239 - protein, 63 aa, Streptococcus pneumoniae
MKIKVQTRKLAAGCSKHCFEVVDRTDEVSSKHGFEVVDETDEVSNNTYGKATLTWFEEIFEEY

SEQ ID NO: 4240 - protein, 76 aa, Streptococcus pneumoniae
MKRVILLAVIQAVVLFFIIGALAYAFKGDFFYNYLAVVFAPIAGVLRFGTAYITEIVLPRKAAEIAEKRKAGKNSK

SEQ ID NO: 4241 - protein, 213 aa, Streptococcus pneumoniae
MKLLKNLGWFLLALLSFFFIYGFIQGLATASLALGASPYAVTLLYVVLAGVYVYGIYKWYQKAPVHIEKSGFNRFIWLPALVWFLSLVVQFFLPDDPSVNQQIATDLTLSQPLFSFFAVVIFAPLTEEIVFRGMLARYLFPKQDNSKRTLIFLLVSSLLFALIHFPGDVQQFFVYFSLGFSLGLAYISRKGLVYSISLHALNNLVGFLMILML

SEQ ID NO: 4242 - protein, 246 aa, Streptococcus pneumoniae
MNMKKKRRLLFLMSIVLGGFLGMFVGMFKARVESHEIILDVKALMPWISAICLLIGFISMFLTFNFLKKSRKFHSLYQEEMDDDLNETYYVQMYRNLEFGTIAFNITGVAIPLAIFISLSEVIILHTNPQTFFLSFLLFVVFLVAQKSLFKTIAIVRQFDLEFFATPKDVLNYINSYDEGERQANLEQSFRILFQLHQYVLPALYIFLIIISFLTGEIQLLAFLLVGAIHVYINVMQLPMVKRYFK

SEQ ID NO: 4243 - protein, 66 aa, Streptococcus pneumoniae
VMNKYKVIYYVVVIALLVSVFLLIGMDLSWFNPYQSDQFVWVYFALIPVIEWIEKKSKNLASEKGE

SEQ ID NO: 4244 - protein, 154 aa, Streptococcus pneumoniae
MIDKVVRNLLLTFFFCKMTKIINFLTTILVKKKKMCYNVSKLREKKKGAMMWVLGFILFLIFFYSNDSKKIKKLEKKIKRLERKEKGNAEMSRLLQEMIGKEPIITGVYIGPDNWEVVDVDEEWVKLRRVDNTGKEKFKLQRIEDIQTVEFDGE

SEQ ID NO: 4245 - protein, 61 aa, Streptococcus pneumoniae
SGQELTPDLFLLQNDKNHKLFDNYTCQKEKDVLQCKQVKRKEERSYDVGTRVYTISDFLLF

SEQ ID NO: 4246 - protein, 63 aa, Streptococcus pneumoniae
MKIKEQTRKLAAGCSKHCFEVVDRTDEVSSKHGFEVVDETDEVSNHTYGKVKLTWFEDILEEY

SEQ ID NO: 4247 - protein, 62 aa, Streptococcus pneumoniae
VWLLTSSVSSTTSKPCFELTSSVLSTTSKQCFEQPAASFLVCSLIFIEYKILVFQRFLRSFG

SEQ ID NO: 4248 - protein, 429 aa, Streptococcus pneumoniae
MKLQKPKGTQDILPAESAKWQYVEGFAREIFKRYNYAEVRTPIFEHYEVISRSVGDTTDIVTKEMYDFYDKGDRHITLRPEGTAPVVRSYVENKLFAPEVQKPSKFYYMGPMFRYERPQAGRLRQFHQIGVECFGSSNPATDVETISMAAYFLKEIGIQGVKLHLNTLGNPESRAAYRQALIDYLTPLKETLSKDSQRRLEENPLRVLDSKEKEDKVAVENAPSILDFLDEESQTHFDAVRQMLENLGVDYIIDTNMVRGLDYYNHTIFEFITEIEGNDLTVCAGGRYDGLVAYFGGPETAGFGFGLGVERLLLILEKQGVALPIENALDVYIAVLGDGANVKALELVQALRQQGFKAERDYLNRKLKAQFKSADVFAAKTLITLGESEVESGQVTVKNNQTREEVQVSLETISQNFSEIFEKLGFYTQ

SEQ ID NO: 4249 - protein, 306 aa, Streptococcus pneumoniae
LFFKDEKQALYTKPKTKSSSFRASKVSNQTIVATTRTDCQVIALNLCDKLENGVVVVVQTTHHIGIDDVIYSKIFQHLTHSIKMSLAFFIKKVQDRRRILYCHLVFFFLRVQDTKRIFLQATLAILRQGLLERCQIVNQGLAVGCTALRISKSVEVQFDTLNTDFLQKIGCHRDCFHIGSWIARAKTLNTNLVELAQAPCLWTLITEHRSHIVELAWLLHFWGEEFIFHIGTDNGRSSFWTEGNMTVTLVIKIVHFLGYDIRCISDRATDNLVMLKNRRAHFCIVIALENLTGKALNILPLSRFSR

SEQ ID NO: 4250 - protein, 415 aa, Streptococcus pneumoniae
MKLLFRNPAYRILTLSRFFNAFGASIFNLVFIVYASTLSQASFAVAMANIVMLLPTLFTVFAGIRADYTRAKVKWMVYSGLFQAVLFFLAALVVQQASLFAFSSLCLINVISDIISDFAGGLRMPLIKEKVAEDDLMEAYSFSQFITYISAIGGQAFGVWLLALSVNNFSLVAGINACFFLVSATILFLGKSKLSLSMSSADGEKLKNEKLSIKDQFLTIYRNLRLVFLKSGQKNFGFMLCAVLLVNALGGALGGIYNIFFLSHSLLNFSYTEALFINQVCVLLAIIISSLTGNDYFGKQSLPRLMMWETVGLSLVGLANLFNQVVLGLLFLFFTLYVSGKVQPKISAMLMKNLAPEVLARTSNFLGLLFTLSIPVGTACFSLVAVWNIQLTWMLFVGLSLLAIFLTILNLKNDI

SEQ ID NO: 4251 - protein, 132 aa, Streptococcus pneumoniae
LSVKNLPMPIILNVLSKSISTRKMRPISELFICGQKVSLIASKVESRKARKRWRMLSVFLRCLAVINLPNTIEIRPNVEYLQTKKKFEAIELLPSLRSLQKFYRFFAHFICCIYSKESFRKFISAILKLFLM

SEQ ID NO: 4252 - protein, 283 aa, Streptococcus pneumoniae
MEQIGKVFRQLRESRNISLRQATGGQFSPSMLSRFETGQSELSVEKFLFALENISASVEEILFLARGFQYDTDSELRKEITDVLEPKNIAPLEDLYRREYQKHAHSHNKQKHILNAIIIKSYMKSIDERVELTAEEGKVLHDYLFSTEIWGIYELNLFSVSSPFLSVSLFTRYVREMVRKSDFLMEMSGNRNLFHTILLNGFLASIECEEFTNAYYFKRVIEEHFYKENETYFRIVYLWAEGLLDSKQGRVKEGQKKMEDAVRIFEMLGCNKSAEYYRNTTEC

SEQ ID NO: 4253 - protein, 113 aa, Streptococcus pneumoniae
MRDDIKINDRALALQDQIIEKLEKVFDTDVELDVYNLGLIYEINLDETGLCKIVMTFTDTACDCAESLPIEIVAGLKQIEGIKDIKVEVTWSPAWKITRISRYGRIALGLPPR

SEQ ID NO: 4254 - protein, 567 aa, Streptococcus pneumoniae
MTELDKRHRSSIYDSMVKSPNRAMLRATGMTDKDFETSIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 4255 - protein, 310 aa, Streptococcus pneumoniae
MMRSTKELRHVYRDFLLEANQSYSDIVVLEADLSSSMATHNLEKDFGDRYVNVGIMEAEMVGLAAGLSIQGFRPYLHTFGPFASRRVFDQLFISLGYAQLDATVIGSDAGVTAEMNGGTHMPFEEIGLLRLIPKSIIFEATDDIQFREILNQTLDLKGLKYIRTIRKAPVPVYQGGEDFSKGYIELRHGEDLVIVASGIMVAPSIRVADELSKLGYSVSVIDLFRIKPIPEQIKTMLSGKTIFTVENHNQIGGIGSALCELFSDDGITKIHRMGVQERFGQVGKMDYLLNEYGLSESNIKEKVLEIYNAR

SEQ ID NO: 4256 - protein, 285 aa, Streptococcus pneumoniae
MILSKNREDGLRKFATNIRLNTLRTLNHLGFGHYGGSLSIVEVLAVLYGEIMPMTPEIFAARDRDYFILSKGHGGPALYSTLYLNGFFDKEFLYSLNTNGTKLPSHPDRNLTPGIDMTTGSLGQGISVATGLAYGQRIRKSPFYTYAIVGDGELNEGQCWEAIQFASHQQLSNLIVFVDDNKKQLDGFTKDICNPGDFVEKFSAFGFESIRVKGSDIREIYEGIVQLKQSHNSSPKCIVLDTIKGQGVQELEEMKSNHHLRPTVEERQMLTSVVERLSQELEETE

SEQ ID NO: 4257 - protein, 448 aa, Streptococcus pneumoniae
MMKFILDIVSTPAILVALIAILGLVLQKKKLPDIIKGGIKTFVGFLVVSGGAGIVQNSLNPFGTMFEHAFHLSGVVPNNEAIVAVALTTYGSATAMIMFAGMVFNILIARFTRFKYIFLTGHHTLYMACMIAVILSVAGFTSLPLILLGGLALGIIMSISPAFVQKYMVQLTGNDKVALGHFSSLGYWLSGFTGSLIGDKSKSTEDIKFPKSLAFLRDSTVSITLSMAVIYIIVAIFAGSEYIEKEISSGTSGLVYALQLAGQFAAGVFVILAGVRLILGEIVPAFKGISERLVPNSKPALDCPIVYTYAPNAVLIGFISSFIGGLVSMAIMIASGTVVILPGVVPHFFCGATAGVIGNASGGVRGATIGAFLQGILISFLPVFLMPVLGGLGFQGSTFSDADFGLSGIILGMLNQFGSQAGIVIGLVLILAVMFGVSFIKKPSAKEE

SEQ ID NO: 4258 - protein, 94 aa, Streptococcus pneumoniae
MLKIGTACGSGLGSSFMVQMNIESVLSDLNVSDVEVEHYDLGGADPNAADIWIVGRDLADSASHLGDVRILNSIIDMDELRELITKICEEKGLI

SEQ ID NO: 4259 - protein, 676 aa, Streptococcus pneumoniae
MFDYRALVILMTLMDHCELSLYELSVKVSLPIKEVKEGIDYLVPYLANKGIVLDKKQGRYSLSNRTKQSLTDIIKSDELVLPKSTRLALIYLYTFCRLDFISNNHYQDFLKVSKNTTLSDIQSLRKIMLDNDLELGYSRAKGYTLHGSEWNKHRLAFQMVSELLESSIGIWGLDYVLSSWGYSLTYDLIDQVVKDYYEKLQLVPIVNQLKVYLFGLVFILCRYQRDVERVCLSETLVSPVIQDITTILLDTVVDLGIIDTVFSEDDYRYITVLLSSCFEGEVDVAPVYFNQLTEAIISRMEDISLLHFKQREGLRENLRRHLIPAYYRLKFGLPSSNEYVLHVKEHYPDLFELVKDSLMPLMDAIDNPIPDSETAYFVIHFGGYLKKADTLPQKWYKAAIICPNGVSSSLMLKENLLALFPQIEFIGTSKIDDLQVKASSDYDMVFSTIKVETEKPNYLVSVMMTEEQAIQLVELVLKDFPNLEYGDFEIEQILNIVKRYGIITQELELRLALKNYLYQKNDRKEIVPVLEQLITKETYQVSSQKLGWKEAIRLAAKPLLDQDKITENYPEAMIQKVEEFGPFINLGKGVAIPHARPDEGVNEIGMSMLVLEEPIYLLDNPEQEVRLLICIAAIDNESHLKALSHLTTILRDKNHVQTLISSKNYDDIKMIIKQED

SEQ ID NO: 4260 - protein, 335 aa, Streptococcus pneumoniae
MTEKLINSKPNGVFALILIELTIVLGVFIFIMGVGSENIFGIIIGPLLIVIAALTHAGLKVVKPQEALVLTLFGNYTGTIKEPGFYFVNPFSVAVNPANHTRLGQSGDVSTKSPFLGAKSSNDNDVNLEIGKKHISLKVMTLSNSRQKINDCLGNPVEIGIAVTWRVVDTAKAVFNVDNYKEYLSLQCDSALRNIVRIYPYDVSPNVDTTGERQADERSLRGSSEIVANRIREEIQSRVEDAGLEILEARITYLAYAPEIAAVMLQRQQASAIIDARKMIVDGAVGMVEMALERLNEGELVELDEERKAAMVSNLLVVLCGNHDAQPIVNTGSLY

SEQ ID NO: 4261 - protein, 66 aa, Streptococcus pneumoniae
MAEAKKKQIPLRLSTKLYAALASWAEDDFRSVNGQIEYLLTECVKQRKKDGKYVSETIDEPFEIDI

SEQ ID NO: 4262 - protein, 60 aa, Streptococcus pneumoniae
MAVPARRTSKAKKNKRRTHYKVTAPSVNFDETTGDYSRSHRVSLKGYYKGRKITKAASAE

SEQ ID NO: 4263 - protein, 641 aa, Streptococcus pneumoniae
MKKTTILSLTTAAVILAAYVPNEPILADTPSSEVIKETKVGSIIQQNNIKYKVLTVEGNIRTVQVGNGVTPVEFEAGQDGKPFTIPTKITVGDKVFTVTEVASQAFSYYPDETGRIVYYPSSITIPSSIKKIQKKGFHGSKAKTIIFDKGSQLEKIEDRAFDFSELEEIELPASLEYIGTSAFSFSQKLKKLTFSSSSKLELISHEAFANLSNLEKLTLPKSVKTLGSNLFRLTTSLKHVDVEEGNESFASVDGVLFSKDKTQLIYYPSQKNDESYKTPKETKELASYSFNKNSYLKKLELNEGLEKIGTFAFADAIKLEEISLPNSLETIERLAFYGNLELKELILPDNVKNFGKHVMNGLPKLKSLTIGNNINSLPSFFLSGVLDSLKEIHIKNKSTEFSVKKDTFAIPETVKFYVTSEHIKDVLKSNLSTSNDIIVEKVDNIKQETDVAKPKKNSNQGVVGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWFTVSGKWYYTYNSGDLLVNTTTPDGYRVNANGEWVG

SEQ ID NO: 4264 - protein, 75 aa, Streptococcus pneumoniae
VLSFENKTPSTEANDSFPSSTSTCFKLVVSLNRLLPNVLTDFGNVSFSKFDKLAKASCDINSNFELEEKVSFFNF

SEQ ID NO: 4265 - protein, 191 aa, Streptococcus pneumoniae
MDLKFEGVDLEYKKAKNNLPESFWETYSAFANTNGGKIILGIDEKNIDTYQRVNRLPAKQNYEASKQLTDARFKRLVGVQRTTFEEMLAVLKTAYQLKHAKGGRKPKLSLEDLLMATLQYVREYRTYEEIAADFGIHESNLIRRSQWVEVTLVQSGVTISRTLLSSEDTVMIDATEVKINRPKKTISESFW

SEQ ID NO: 4266 - protein, 125 aa, Streptococcus pneumoniae
KSIALKKQLANHSGKKKFHAMKAQAIVTSQGRIVSLDITVNYCHDMKLFKMSCRNIGQAGKILADSGYQGLMKIYPQAQTPRKSSKLKPLTAEDKAYNHALSKERSKVENIFAKVKTFKMFSTTY

SEQ ID NO: 4267 - protein, 108 aa, Streptococcus pneumoniae
VILWSFDFVNAHAHAFFMDNVEWSHADSYFLSFVSDDVEERYTENVYLDSLSVKQKFKFLFDFGDEWRFECQVLREIETEDEEAYLVRSVGTSPEQYPDYDGFDYEEW

SEQ ID NO: 4268 - protein, 626 aa, Streptococcus pneumoniae
MVRFTGLSPKQTQAIEVLKGHISLPDVEVAVTQSDQASISIEGEEGHYQLTYRKPHQLYRALSLLVTVLAEADKVEIEEQAAYEDLAYMVDCSRNAVLNVASAKQMIEILALMGYSTFELYMEDTYQIEGQPYFGYFRGAYSAEELQEIEAYVQQFDMTFVPCIQTLAHLSAFVKWGVKEVQELRDVEDILLIGEEKVYDLIDGMFATLSKLKTRKVNIGMDEAHLVGLGRYLILNGVVDRSLLMCQHLERVLDIADKYGFHCQMWSDMFFKLMSADGQYDRDVEIPEETRVYLDRLKDRVTLVYWDYYRDSEEKYNRNFRNHHKISHDLAFAGGAWKWIGFTPHNHFSRLVAIEANKACRANQIKEVIVTGWGDNGGETAQFSILSSLQIWAELSYRNDLDSLSAHFKTNTGLTVEDFMQIDLANLLPDLPGNLSGINPNRYVFYQDVLCPILDRHMTPEQDKPHFAQAAETLANIKEKAGNYAYLFETQAQLNAILSSKVDVGRRIRQAYQEDDKESLQQIARQELPELRSQIEDFHALFSHQWLKENKVFGLDTVDIRMGGLLQRIKRAESRIEVYLAGQLDRIDELEVEILPFTDFYADKDFAATTANQWHTIATASTIYTT

SEQ ID NO: 4269 - protein, 289 aa, Streptococcus pneumoniae
MTIATIDIGGTGIKFASLTPDGKILYKTSISTPENLEDLLAWLDQRLSEQDYSGIAMSVPGAVNQETGVIDGFSAVPYIHGFSWYEALSSYQLPVHLENDANCVGLSELLAHPDLENAACVVIGTGIGGAMIINGRLHRGRHGLGGEFGYMTTLAPAEKLNNWSQLASTGNMVRYVIEKSGHTDWDGRKIYQEAAAGNALCQEAIERMNRNLAQGLLNIQYLIDPDVISLGGSISQNPDFIQDVKKAVDNFVDTYEEYTVAPVIQTCTYHADANLYGALVNWLQEEKQW

SEQ ID NO: 4270 - protein, 886 aa, Streptococcus pneumoniae
MRFYFMENVVVHIISHSHWDREWYLPFESHRMQLVELFDNLFDLFENDPEFKSFHLDGQTIVLDDYLQIRPENRDKVQRYIDEGKLKIGPFYILQDDYLISSEANVRNTLIGQQEAAKWGKSTQIGYFPDTFGNMGQAPQILQKSGIHVAAFGRGVKPIGFDNQVLEDERFTSQFSEMYWQGVDGSRVLGILFANWYSNGNEIPVDKDEALIFWKQKLSDVRAYASTNQWLMMNGCDHQPVQKNLSEAIRVANELFPDVIFVHSSFDEYVQAVEGALPEHLSTVTGELTSQETDGWYTLANTSSSRIYLKQAFQENSNLLEQVVEPLTIITGGHNHKDQLTYAWKTLLQNAPHDSICGCSVDEVHREMETRFAKVNQVGNFVKSNLLNEWKGKIATDKAQSDYLFTVINTGLHDKVDTVSTVIDVATCDFKELHPTEGYKKMAALILPSYRVEDLDGRPVEATIEDLGANFEYDLPKDKFRQARIARQVRVTIPVHLAPLSWTTFQLLEGKQEHREGIYQNGVIDTPFVTVSVDDNITVYDKTTHEAYEDFIRFEDRGDIGNEYIYFQPKGTEPIFAELKGHEVLENTACYAKILLKHELTVPVSADEKLEEEQQGIIEFMKREAGRSEELTNIPLETELTVFVDNPQIRFKTRFTNTAKDHRIRLLVKTHNTRPSNDSESIYEVVTRPNKPAASWENPENPQHQQAFVSLYDDEKGVTVSNKGLNEYEILGDNTIAVTILRASGELGDWGYFPTPEAQCLREFEVEFALECHQAQERFSAYRRAKALQTPFTSLQLARQEGSVVATGSLLSHSVLSIPQVCPTAFKVAENEEGYVLRYYNMSQENVRISEHQQTILDLLERPYPVHSGLLAPQEIRTEFIKKEEI

SEQ ID NO: 4271 - protein, 434 aa, Streptococcus pneumoniae
LFERGNCTMIYSKEIVREWLDEVAERAKDHPEWVDVFERCYTDTLDNTVEILEDGSTFVLTGDIPAMWLRDSTAQLRPYLHVAKRDALLRQTIAGLVKRQMTLVLKDPYANSFNIEENWKGHHETDHTDLNGWIWERKYEVDSLCYPLQLAYLLWKETGETSQFDEIFVVATKEILHLWTVEQDHKNSPYRFVRDTDRKEDTLVNDGFGPDFAVTGMTWSAFRPSDDCCQYSYLIPSNMFAVVVLGYVQEIFAALNLADSQSVIADAKRLQDEIQEGIENYAYTTNSKGEKIYAFEVDGLGNASIMDDPNVPSLLAAPYLGYCSIDDEVYQATRRTILSSENSYFYQGEYASGLGSSHTFYRYIWPIALSIQGLTTRDKAEKKFLLDQLVACDGGTGVMHESFHVDDPTLYSREWFSWANMMFCELVLDYLDIR

SEQ ID NO: 4272 - protein, 694 aa, Streptococcus pneumoniae
MKPLLETIDTRFGTTNKHAFSRGNTLPYTGVPFGMNYFVPQTSDQDGAWFFDPHLPIFQGIRLTHQPSPWIGDYSWLLLTPVTSQLGEDSLFHRQSSYNRDKASFQPHYLKIFSLRYQIETQLTPTCYGASIRLKQKQGKALSLYLHATDELTVEQVDKRTLALRQEGKTETNKNSLTMFTALQMNTDILAISQEAGDWRIDLVSSQTEMQLATSFISPSQALINLPQEDFDSCKASAQADWENLLHRFDVIETGEANRTFFDHCLYRLFLFPQTFYEVDESGQAIHMDLATGTVKPGVLFSNNGFWDTFRTTFPLFALIIPEHYQRFLEGFLNSYRDTGFLPKWLAPDERGMMPGTLLDGIIADSACKDMAPDLEGELFQAMLETASKADPLGINGRHGLAQYQELGYLSTDHHESVSHTLDYAYSDFCIASCAKKLENIEIAETYKAASQNYRQLFDAETGYMRARDNQGNFHPDFSPYSWGRDYAECSAIQATLGVLHDIPGLIQLMGGKETFSNYLLKACQDAPLFETTGYGYEIHEMSEMATAPFGQIAISNQPSFHIPYLFRYSDYPDYTALLIKTLRQKAFHPSWEAYPGDEDNGSLSAWYIWSALGFYPTCPGKPSYDLGIPLFDHLRVYLAKEDKWLDIHTKQNHNHFNFVKECRLDKTLVSTIQHQDLLKAEQLTFTLSWLPSH

SEQ ID NO: 4273 - protein, 559 aa, Streptococcus pneumoniae
MKKIKPHGPLPSQTQLAYLGDELAAFIHFGPNTFYDQEWGTGQEDPERFNPSQLDAREWVRVLKETGFKKLILVVKHHDGFVLYPTAHTDYSVKVSPWRRGKGDLLLEVSQAATEFDMDMGVYLSPWDAHSPLYHVDREADYNAYYLAQLKEILSNPNYGNAGKFAEVWMDGARGEGAQKVNYEFEKWFETIRDLQGACLIFSTEGTSIRWIGNERGYAGDPLWQKVNPDKLGTEAELNYLQHGDPSGTIFSIGEADVSIRPGWFYHEDQDPKSLEELVEIYFHSVGRGTPLLLNIPPNQAGLFDAKDIERLYEFATYRNELYKEDLALGAEVSGPALSADFACRHLTDGLETSSWANDAALPIQLELDLGSPKTFDVIELREDLKLGQRIAAFHVQVEVDGVWQEFGSGHTVGYKRLLRGAVVEAQKIRVVITESQVLPLLTKISLYKTPRLSQTVAVQGLAFAEKSLAVAKGETLHFRIERSESSSSLEAKISIQPGTGVHGVAYQDEIQVLQFQAGESKKDLHLPTLYFAGDKTLDFYLNLTVDGQLVDQLQVQVS

SEQ ID NO: 4274 - protein, 409 aa, Streptococcus pneumoniae
MSSHPIQVFSEIGKLKKVMLHRPGKELENLLPDYLERLLFDDIPFLEDAQKEHDAFAQALRDEGIEVLYLEQLAAESLTSPEIRDQFIEEYLDEANIRDRQTKVAIRELLHGIKDNQELVEKTMAGIQKVELPEIPDEAKDLTDLVESEYPFAIDPMPNLYFTRDPFATIGNAVSLNHMFADTRNRETLYGKYIFKYHPIYGGKVDLVYNREEDTRIEGGDELILSKDVLAVGISQRTDAASIEKLLVNIFKKNVGFKKVLAFEFANNRKFMHLDTVFTMVDYDKFTIHPEIEGDLHVYSVTYENEKLKIVEEKGDLAELLAQNLGVEKVHLIRCGGGNIVAAAREQWNDGSNTLTIAPGVVVVYDRNTVTNKILEEYGLRLIKIRGSELVRGRGGPRCMSMPFEREEV

SEQ ID NO: 4275 - protein, 338 aa, Streptococcus pneumoniae
MTNSVFQGRSFLAEKDFTRAELEYLIGLSAHLKDLKKRNIQHHYLAGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVQENFGRLEGLTLVYCGDGRNNVANSLLVTGAILGVNVHIFSPKELFPEKEIVELAEGFAKESGAHVLITEDADEAVKDADVLYTDVWVSMGEEDKFAERVALLKPYQVNMDLVKKAGNENLIFLHCLPAFHDTHTVYGKDVAEKFGVEEMEVTDEVFRSKYARHFDQAENRMHTIKAVMAATLGNLYIPKV

SEQ ID NO: 4276 - protein, 315 aa, Streptococcus pneumoniae
MANRKIVVALGGNAILSSDPSAKAQQEALVETAKHLVKLIKNGDDLIITHGNGPQVGNLLLQHLASDSEKNPAFPLDSLVAMTEGSIGFWLKNALQNALLDEGIEKNVASVVTQVIVDKNDPAFVNLSKPIGPFYSEEEAKAEAEKSGATFKEDAGRGWRKVVASPKPVDIKEIETIRTLLNNGQVVVAAGGGGIPVVKENNGHLTGVEAVIDKDFASQRLAELVDADLFIVLTGVDYVFVNYNKPNQEKLEHVNVAQLEEYIKQDQFAPGSMLPKVEAAIAFVNGRPEGKAVITSLENLGALIESESGTIIEKG

SEQ ID NO: 4277 - protein, 503 aa, Streptococcus pneumoniae
MSEKAKKGFKMPSSYTVLLIIIAIMAVLTWFIPAGAFIEGIYETQPQNPQGIWDVLMAPIRAMLGTHPEEGSLIKETSAAIDVAFFILMVGGFLGIVNKTGALDVGIASIVKKYKGREKMLILVLMPLFALGGTTYGMGEETMAFYPLLVPVMMAVGFDSLTGVAIILLGSQIGCLASTLNPFATGIASATAGVGTGDGIVLRLIFWVTLTALSTWFVYRYADKIQKDPTKSLVYSTRKEDLKHFNVEESSSVESTLSSKQKSVLFLFVLTFILMVLSFIPWTDLGVTIFDDFNAWLTGLPVIGNIVGSSTSALGTWYFPEGAMLFAFMGILIGVIYGLKEDKIISSFMNGAADLLSVALIVAIARGIQVIMNDGMITDTILNWGKEGLSGLSSQVFIVVTYIFYLPMSFLIPSSSGLASATMGIMAPLGEFVNVRPSLIITAYQSASGVLNLIAPTSGIVMGALALGRINIGTWWKFMGKLVVAIIVVTIALLLLGTFLPFL

SEQ ID NO: 4278 - protein, 443 aa, Streptococcus pneumoniae
MKIDITNQVKDEFLISLKTLISYPSVLNEGENGTPFGQAIQDVLEKTLEICRDIGFTTYLDPKGYYGYAEIGQGAELLAILCHLDVVPSGDEADWQTPPFEATIKDGWVFGRGVQDDKGPSLAALYAVKSLLDQGIQFKKRVRFIFGTDEETLWRCMARYNTIEEQASMGFAPDSSFPLTYAEKGLLQVKLHGPGSDQLELEVGGAFNVVPDKANYQGPLYEQVCNDLKEAGYDYQSTEQTVTVLGVPKHAKDASQGINAVIRLATILAPLQEHPALSFLATQAGQDGTGRQIFGDIADEPSGHLSFNVAGLMINHERSEIRIDIRTPVLADKEELVKLLTRCAQNYQLRYEEFDYLAPLYVAKDSKLVSTLMQIYQEKTGDNSPAISSGGATFARTMPNCVAFGALFPGAKQTEHQANECAVLEDLYRAMDIYAEAVYRLAT

SEQ ID NO: 4279 - protein, 63 aa, Streptococcus pneumoniae
FQHTIKSGNTTAKKFEFIEIPVQKLKKAIYKAHLKDSDDFRPETSTPNLFESCLKLCPCFLSS

SEQ ID NO: 4280 - protein, 78 aa, Streptococcus pneumoniae
YKNQAEEDKPLSDKYIFEKILGKTYAAFKKDQINERVEKLGKLKPITINYNGKSEVIDSKEKLQELMNKAVKDEVAQI

SEQ ID NO: 4281 - protein, 88 aa, Streptococcus pneumoniae
MMGDGMKEFQFERKQRFSLRPYAIGACSVLLGTSLFFAGMGAQPVQDTETSSALISSHYLDEQDLSEKLKSELQWLELENKLLNLWEH

SEQ ID NO: 4282 - protein, 51 aa, Streptococcus pneumoniae
LRLLRKTKNIDIHLTKNYCMLSPLIRNDKGITRKICEYKLFLIYKIYSNNE

SEQ ID NO: 4283 - protein, 71 aa, Streptococcus pneumoniae
TNTLRKSLQTTSASPCRISATSKQCFELTSSVLSTTSKRCFEQPVASFLVCSLIFIEYKELGNRLFLYCVY

SEQ ID NO: 4284 - protein, 54 aa, Streptococcus pneumoniae
LPSSLYSMKIKEQTRKLATGCSKHRFEVVDKTDEVSSKHCFEVADIRQGDADVV

SEQ ID NO: 4285 - protein, 299 aa, Streptococcus pneumoniae
MAIFFMIFLIVCVLLLVIVTLSTVYVVRQQSVAIIERFGKYQKVANSGIHIRLPFGIDSIAARIQLRLLQSDIVVETKTKDNVFVMMNVATQYRVNEQSVTDAYYKLIRPESQIKSYIEDALRSSVPKLTLDELFEKKDEIALEVQHQVAEEMTTYGYIIVKTLITKVEPDAEVKQSMNEINAAQRKRVAAQELAEADKIKIVTAAEAEAEKDRLHGVGIAQQRKAIVDGLAESITELKEANVGMTEEQIMSILLTNQYLDTLNTFASKGNQTIFLPNTPNGVDDIRTQILSALRAEKK

SEQ ID NO: 4286 - protein, 63 aa, Streptococcus pneumoniae
HFRKNRSKNGTAFFKCAIILEKYLWRFHYGNIFHDFSDCLCAPIGDSHTEYSLCGSSAVGGDY

SEQ ID NO: 4287 - protein, 383 aa, Streptococcus pneumoniae
MATFYVPAVNLIGKGVVNEVGPYIKELGYKKALLVTDKYIEGSDILPKVLKPLDTEGIEYVIFSDVEPNPTCKNVTDGVAALQEHGCDFIISLGGGSPQDAASCISIMATNGGKPQDYEGLHKSAKKGLPVVAINTTAGTSAEITINYVITDEERKVKMVMVDKNSLALISVNDPELMLSKPKGLTAATGMDALTHAVEALVTPGAYDVTKKLSIGAIELIKEYLPRAVENGHDIEAREGMVNAIFLGGMSFNNAGLGYVHSMAHQLGAVYNLPHGVCCAMLLPVIERENAKRVPEAFRNVAKALGLHVEGKSDQECADYAIVEIEKLSETVGIPKKLTELGIEEKDFDFEYLSKNALIDACAPGNPFMPTLEETIAFYKELF

SEQ ID NO: 4288 - protein, 588 aa, Streptococcus pneumoniae
MIQHPRIGIRPTIDGRRQGVRESLEVQTMNMAKSVADLISSTLKYPDGEPVECVISPSTIGRVPEAAASHELFKKSNVCATITVTPCWCYGSETMDMSPDIPHAIWGFNGTERPGAVYLAAVLASHTQKGIPAFGIYGRDVQEANDTAIPEDVKEKLLRYARAALATGLMRDTAYLSMGSVSMGIGGSIVNPDFFQEYLGMRNESVDMTEFTRRMDRGIYDPEEFERALKWVKENVKEGFDHNREDLVLSREEKDRQWEFVIKMFMIGRDLMVGNPRLAELGFEEEAVGHHALVAGFQGQRQWTDHFPNGDFMETFLNTQFDWNGIRKPFVFATENDSLNGVSMLFNYLLTNTPQIFADVRTYWSPEAVERVTGYTLEGRAAAGFLHLINSGSCTLDGTGQATRDGKPVMKPFWELDESEVQAMLENTDFPPANREYFRGGGFSTRFLTKGDMPVTMVRLNLLKGVGPVLQIAEGYTLELPEDVHHTLDNRTDPGWPTTWFAPRLTGKGAFKSVYDVMNNWGANHGAITYGHIGADLITLASMLRIPVNMHNVPEEDIFRPKNWSLFGTEDLESADYRACQLLGPLHK

SEQ ID NO: 4289 - protein, 242 aa, Streptococcus pneumoniae
MSQDEKLIREQICDVCHKMWQLGWVAANDGNVSVRLDEDTILATPTGISKSFITPEKLVKLNLKGEILEAEGDYCPSSEIKMHIRCYEEREDVRSVVHAHPPIATGFALAHIPLDTYSLIESAIVVGAIPITPFGVPSTMEVPEAITPYLPDHDVMLLENHGALTVGSDVITAYYRMETLELVAKTTFHGRMLLSTKGIEEQEIARPTLERLFSMRENYKVTGRHPGYRKYNGDGSIKETKK

SEQ ID NO: 4290 - protein, 1028 aa, Streptococcus pneumoniae
VFQNILQNYLLLRKLYVNNEEIKMENKKIAKQILIATAVLTSFLGSNLVYADVVQSNSNNRASTETARVTGNNLEKLITKDKEIDKEMTYLSDMDWSSATHGDIDKTKTVQKDAPFTTGNKGEHTKISLLTSDDKVKYFDKGIGTVADSPSVISYDISGQGFEKFETYIGIDQSANSSRSDHAVVDRIEIEIDGKVVYSSSVTNPEGFRYNTQAQFISVTIPQNAKKISLKSFAGEHTWGDEVVFADAKLIKTVSTQTITPDLLNKGINGGVYLSDLEWVDATHGDDDKSKTVQKDKPFTPGNNGSNNKIKLLIDGKEVEFNKGLGTVASNPSSIKYDVSGANVTRFISYVGIDRSANHLNSDYADIQKFEVVADGKVIYSSDSKYPKGIKYDISAFLVDVEIPKDTQTIELKSYSGKYTWADELVLGGALFMANGKFKNPNDWSEVDKRREINNEHPLLMMPLYANGEEFNQGKYTFWGGDTLTGKWENIPDDLKPYTVIQLHPDDLPKRDGAARDFYEHMLEEAAKYVNPKTGKNEPIPVILTVYTAGNMPYYTSAHWLSTSWIDKMYQKYPNLHGIFSTENYWIWANDIENKAADYLKVSAKNGGYFIWAEQNNGSAIEKAFGKNGKIAFQKSVDKYWKNLIFMFKNTPAAEGNDSTTESYMKGLWLSNHTYQWGGLMDTWKWYETGKWKLFASGNIGKSQGDRQWLTEPESMLGEEALGVYLNGGVVYNFEHPAYTYGVNNKESLLFSEVIKEFFRYVIAHPAPSKEKVLEDTKVFIHGDYSNKGNGKFFVNVNTDREQTPLYMTGRYNVIPAIPGVLKTDKLKESVSGSRIQIKEITSPEFSSTQARKEYLNKLYPMNYEGDIFAQKLDNRWFVYNYKVNENVKQTGKLKFNSLEMDVEFEPHTYGIFERISNGLKVNLNNFRTNKDSLWSNAQDANQAKKLPQLTKKGAIKWIEEHYIKDTQFGEKRVTKIVLRGIDKLPTIHSLSGTNNSYDQPSLNFDQKNHMVTITINSNGNLEFELHF

SEQ ID NO: 4291 - protein, 737 aa, Streptococcus pneumoniae
MTIYINKDETVFHLAMKDSSYIFRILENGELQHLHFGKRIHVKENYNQLMAYEKRGFEVSFSEEFEDIQQSMIQNEYSSYGKGDFRHPAFQVQGMNGSRITTLKYQGFELEKGKNRLNSLPSTFDDIGQCAETLTIILTDSILDLTVRLNYTIFPEYNVLVRNTEFLNNSNNKLTLLKAMSLQLDLPDSQYDFIQFSGAWLRERQLYRTSLRPGIQAIDSLRYSSSPQQNPFFMLSRRETTEHSGEVYGFNFIYSGNFQNMIEVDHFDTARVTVGINPVEFRFLLNPAESFVTPEAIVIYSDQGMNQMSQQLSDFYRHHLVNPNFSQASRPIILNSWETFYFDLGTEKILDLAKAAKDLGIELFVLDDGWFGHRKDDKSSLGDWVTDRSRLPEGIGFLADEIHKIGLQFGLWFEPEMISIDSDLYKNHADWTIHLLDREKSVGRNQYVLDLTRQEVVDYLFDSISKIIIKTNLDYIKWDMNRHITDIYSIELDSEQQMEFGHRYILGLYQLLDRLITKFPSVLFESCSSGGGRFDLGLMYYAPQAWTSDDTDPIERLKIQHGTSYGYSPSMMTAHVSISPNEQSRRQTSLDTRTNVAYFSSFGYELDVTRLSVEEKEQVREQIQFYKKYRSLFQYGDFYRINSPFSCDSASWQVVSKDKCQSILLYAQLNSKLNPGYTRVYFSGLDKDKCYSVSGFDEFFYGDELMNAGIKVSLSNLALCVPEYLTKLFVIEEVVCK

SEQ ID NO: 4292 - protein, 623 aa, Streptococcus pneumoniae
MKIENKNVRRNFFWGDGRFYTTDIVNKRAGVMIENVSKEEFTITLENGIRLSSNHFSAIVREEGDTRIQVSFVCPSIRLRLIFESRDDVLSKQLVLESSTEVIKSVEVESFEFETEDNIFYPKRQDCIKEMANFSGHYVELGQPVYANSLFLGMEFPMSENKVDGRHYVSRYYLGTVVNQEKSLWSCIIGGACSYKKEEIQEAFFEYVEGIAQPSYFRKQYNSWYDHMTDITEEGILKSFSEIRDGFENHGVHLDAYVVDDGWTNYQSVWEFNHKFPNGLRNIKHLVNGFGSSLGLWIGPRGGYNGTEIIMSDWLEAHPELNIGSKNLISNDVNVADFNYLNQMKKKMLEYQKEFDISYWKIDGWLLQPDKPDKSGPHGMYTMTAVYEFLIQLLIDLRKERGGKDCWLNLTSYVNPSPWFLQWVNSLWIQISQDVGFTENAGNDINRMITYRDSQYQEFLEKREIQLPMWSLYNHEPIYAVSANTWYMDHQMFASIPDFEAYLLFISTRGNAFWEFHYSFDMFDEERWKANARAVKWIEENYQTLKYSKKIGGSPEKFEIYGYKCHNQKTSTEILSLRNPAQIKQKIKIENLSIENFTRVIGDFTIQEDEIELAPYSIVILKK

SEQ ID NO: 4293 - protein, 439 aa, Streptococcus pneumoniae
MKHTLETINSRTQWFREARFGMFIHWGLYSIPGKGEWIRSHQKLSIEDYEPYFRAFDPKEYNPREWAKQAKAAGMKYMVLTAKHHDGFCLFDSKFTDYKATNTPAGRDLVKEFVDAVRAEGLKVGLYFSLIDWHHPDFPKYADLNHPMRGNEAYRDEKINFDSYLEYLHNQVKEIVTGYGQIDILWFDYSYEDMVGEKWGASKLIDMVRHYQPNVIVDNRLETSGEGFGSIVTDEITSYAGDFVSPEQIVPHEGIRNFKGEPVPWELCLTMNNNWAYNPTDYLYKSSQTLIRKLVECVSKNGNMILNVGPDALGRINDSSKKILDNFHRWMSRNGEAIYGCSGDENLPKPDWGYYTRNGNTVYAHVFEQPIGPLALLGISKENVKRMSFLHDGSEVKISESWTTNAYKGICFAQFGEVPHFTYPLPDLIDSVIKIELRE

SEQ ID NO: 4294 - protein, 61 aa, Streptococcus pneumoniae
MNEHPKSCFSKPLSSTIDSFKCMFHPFTAPPPKASMKYLLVNANRMIGGNTITTIAENRPL

SEQ ID NO: 4295 - protein, 294 aa, Streptococcus pneumoniae
YFIQRKKKTERWEMIMNTHINGISKKGKVLIYGYMLLTILISIFPIAWIFLSSLKADPMKNPGISLPTDFTLEGYINVFTKLHVFTYFWNSFKVVSISVIISIVMISMSSYVIARMEFRGKKLVTSMLYSTLFIPATAMTFPVYRLVNELGIYNTPVALILVYSCSGIAMSFFIIKNYFEIIPKELEEAAEIDGATYAQTFWKVMLPIARPGILTAAVLAFINNWNEYYWASMLVIDKNELTVPALLGQFTTSFNTNYNGLFSAIVVIVLPPIILFAFTSKYFIEALGGGAVKG

SEQ ID NO: 4296 - protein, 309 aa, Streptococcus pneumoniae
MAQKIMSLQNRKNQKRRFIFLFLLPTLICFFLFYFYSVVTIFLTSFAKWDYTNLNTPEFLGFDKLFENYRYVFKEYPFFTEALINSVRWAVIGVIIQVPLAVSVAITLSKKLKGWKISRNLYIVPSIISSAAMGLIFLQIYNPNYGVVNQIIHLFNPSFKDSVLLTPGLNIVAMTGAYIFFAGASTIMILGQIFAIPEEVQEAAILDNITGWRKEWYITIPMIKGTIKTVSIMAATSGFLLYNEVFFLTNGAAGTKSISFVIRELAVASSRTQYARANTIGVIQILGGMLIIVCINILFRERKRLKGGK

SEQ ID NO: 4297 - protein, 430 aa, Streptococcus pneumoniae
MNKKSLLKCAVIGLVATFGLAACGTSKDASGGSSSGKEVLEFYHGYHHSEDEWPVAKTMRDLYDKFAEEHKDSGVEFKPTPVNGDLKDIMNNKVASGEFPDVIDLAGNAVSLAAIEQKLVLDLKPYIDSNKLEKNVGLNYKQNQKDGKIYTVHEQLFTMGLWYNKDIFAKAGAKTPDQWNTWDDFTQAMASIRKQDGVYAFGAGEPSIRLFNTVLGTTENGRKLLDKPLTKEGIESKEFADALKMVMKEIQANGSKNAGGDANAYSKDFQEGKSAVFFNGVWASGEMSKNPSLAPGIYPAGVAISSSGGGITISSKMSEAKQKLALEFLKYMTSDDVQKVIFEKVGANPSNENVNVKELSEKSSEATTKILGQAITQVKNAKAVVPTVSDVWGGDVHTAIINALTESAAENVDVDQKVKSTQDVLKSLIG

SEQ ID NO: 4298 - protein, 467 aa, Streptococcus pneumoniae
MEAVLAIDLGATSGRAIVGYLSENKLVMEEINRFSNLPIRVKGHLSWDIDFLLAKILESIRLANTSYKILSIGIDTWGVDFGLIDNEGKLLLQPVHYRDERTKGVLKEISEMTELEKLYSETGNQIMEINTLFQLFKARQESPDSFYKTNKILLMPDLFNYLLTGKFATEKSIASTTQLFDPRSQNWNQNILKLFELDSSLLPEIVSEGNVLGRIKEEYGLGDIPVVNVCSHDTASAIVSVPKTEGSLFISSGTWSLVGVELTSPILTTESFSYGFTNEVGKDGVITFLKNCTGLWIIEELRRSFERRGKAYSFDDIRTMVEKEKENLPLIDTESTEFATESDMHKTLTEYLAYHHETREWTDGQLFKIVYESLAETYRKAIELLEELTHKVYKRIYVIGGGARASYFNQMIADRTGKEVLTGSTEGTAVGNIVVQLLSQGKINEDTELKDIMTNIADTQYYYPQLS

SEQ ID NO: 4299 - protein, 58 aa, Streptococcus pneumoniae
MNIGLTFEHYSSKRSHIEKIKRGDYNKVNQGRREKKNGSGFSNRFRCDFWKSNRWLPF

SEQ ID NO: 4300 - protein, 257 aa, Streptococcus pneumoniae
MIKDERVLELIEIIIKKKRIAVKELAEITFSSTSTLRRDLIFLENQGLIKRKHGYVTLSSMNTIELSHQIREGESTRQKRLIASLAKDFIRSGMCIYLDSSTTVYELCPYLSELDNLIIFTNGLHTAQTLSETVKDSSKIFITSGEVKHQSCSVVNYDKENSLLDHFNIDLAFCSARGIDDQYVYEASLSQAISKKNIIDKAHETILLIDSSKFYKTGFFKINPLSKYTTFISDTLPDQKLLDAVELFDGEWVSDIQ

SEQ ID NO: 4301 - protein, 72 aa, Streptococcus pneumoniae
RLCRLDPIFQELSDLDDLNVLWYTIFVIGYRLRSYGFVRGGETNEPYHRARSYYYSGCYSWNYLVFRLQMAR

SEQ ID NO: 4302 - protein, 68 aa, Streptococcus pneumoniae
STIVQVLSEVDDLNLVWYTIFVIGYRLRSYGFVRGGETNEPYTRACSYYYSRCYSWNYLVFRLQMARW

SEQ ID NO: 4303 - protein, 501 aa, Streptococcus pneumoniae
VKKISLLLASLCALFLVACSNQKQVDGKLNIVTTFYPVYEFTKQVAGDTANVELLIGAGTEPHEYEPSAKAVAKIQDADTFVYENENMETWVPKLLDTLDKKKVKTIKATGDMLLLPGGEEEEGDHDHGEEGHHHEFDPHVWLSPVRAIKLVEHIRDSLSADYPDKKETFEKNAAAYIEKLQSLDKAYAEGLSQAKQKSFVTQHAAFNYLALDYGLKQVAISGLSPDAEPSAARLAELTEYVKKNKIAYIYFEENASQALANTLSKEAGVKTDVLNPLESLTEEDTKDGENYISVMEKNLKALKQTTDQEVPAIEPEKAEDTKTVQNGYFEDAAVKDRTLSDYAGNWQSVYPFLEDGTFDQVFDYKAKLTGKMTQAEYKAYYTKGYQTDVTKINITDNTMEFVQGGQSKKYTYKYVGKKILTYKKGNRGVRFLFEATDADAGQFKYVQFSDHNVAPVKAEHFHIFFGGTSQEALFEEMDNWPTYYPDNLSGQEIAQEMLAH

SEQ ID NO: 4304 - protein, 268 aa, Streptococcus pneumoniae
MLSLLSYDFIQRAFLAVIAMSLFSPVLGTFLILRRQSLMSDTLSHVSLSGVAFGLVLGISPTVSTIAIVLIAAVFLEYLRTVYKSFMEIGTAILMSTGLAVSLIVMSKGKSSSSMSLDQYLFGSIVTISEEQVISLFVIAAVVLILTFLFLRPMYILTFDEDTAFVDGLPVRTMSILFNMVTGVAIALMIPAAGALLVSTIMVLPASIALRLGKNFKSVMLLASAIGFLGMVAGLYISYYAETPASASITIIFVTVFILISLVRRFIK

SEQ ID NO: 4305 - protein, 234 aa, Streptococcus pneumoniae
MRYITVEDLSFYYDKEPVLEHINYCVDSGEFVTLTGENGAAKTTLIKASLGILQPRIGKVAISKTNTQGKKLRIAYLPQQIASFNAGFPSTVYEFVKSGRYPRKGWFRRLNAHDEEHIKASLDSVGMWEHRDKRLGSLSGGQKQRAVIARMFASDPDVFILDEPTTGMDAGSKNEFYELMHHSAHHHGKAVLMITHDPEEVKDYADRNIHLVRNQDSPWRCFNVHENGQEVGHA

SEQ ID NO: 4306 - protein, 63 aa, Streptococcus pneumoniae
NSFLLPASIPVVGSSRINTSGSEANIRAITARCFCPPDRDPKRLSRCSHMPTESRLALICSSS

SEQ ID NO: 4307 - protein, 166 aa, Streptococcus pneumoniae
MSKNSIFLLKKRSLKGKESDMRQLAKDINAFLNEVILQAENQHEILIGHCTSEVALTNTQEHILMLLSEESLTNSELARRLNVSQAAVTKAIKSLVKEGMLETSKDSKDARVIFYQLTDLARPIAEEHHHHHEHTLLTYEQVATQFTPNEQKVIQRFLTALVGEIK

SEQ ID NO: 4308 - protein, 427 aa, Streptococcus pneumoniae
LWSYKMLKRLWMIFGPVLIAGLLVFLLIFFYPTEMHHNLGAEKRSAVATTIDSFKERSQKVRALSDPNVRFVPFFGSSEWLRFDGAHPAVLAEKYNRSYRPYLLGQGGAASLNQYFGMQQMLPQLENKQVVYVISPQWFSKNGYDPAAFQQYFNGDQLTSFLKHQSGDQASQYAATRLLQQFPNVAMKDLVQKLASKEELSTADNEMIELLARFNERQASFFGQFSVRGYVNYDKHVAKYLKILPDQFSYQAIEDVVKADAEKNTSNNEMGMENYFYNEQIKKDLKKLKDSQKSFTYLKSPEYNDLQLVLTQFSKSKVNPIFIIPPVNKKWMDYAGLREDMYQQTVQKIRYQLESQGFTNIADFSKDGGEPFFMKDTIHLGWLGWLAFDKAVDPFLSNPTPAPTYHLNERFFSKDWATYDGDVKEFQ

SEQ ID NO: 4309 - protein, 79 aa, Streptococcus pneumoniae
MDIKSEVIEIIDELFMEDVSDMMDEDLFDAGVLDSMGTVELIVEIENRFDIRVPVTEFGRDDWNTANKIIAGIVELQNA

SEQ ID NO: 4310 - protein, 414 aa, Streptococcus pneumoniae
MMEFFQQLPHLEPYGNPQYFVYVIAATLPIFIGLFFKKRFAWYEVLVSLFFIVTMLVGGKTNQLAALGIYLCWEILLLLFYKHYRKSKDGKWVFYLVSFLSLLPIIFVKVQPAINGTQSLLGFLGISYLTFRSVGIIIELRDGVIKDFTLWEFLRFLLFMPTFSSGPIDRFKRFNENYQAIPERDELMDMLDESVRYIMRGFLYKFILAHVLGETLLPPLKNLALQSGGFFNLYALAVMYTFGLELFFDFAGYSMFALAISNLMGIRSPINFNKPFLSRDLKEFWNRWHMSLSFWFRDFVFMRMVMVLTRKKVFKNRNVTSSMAYIVNMLIMGFWHGVTWYYIAYGLFHGLGLVINDAWVRKKKTLNKKRKKAGKAALPENRWIQFLGMVVTFHVVMLSFLIFSGFLNNLWFKK

SEQ ID NO: 4311 - protein, 516 aa, Streptococcus pneumoniae
VSNKPIADMIETIEHFAQTQPSYPVYNVLGQEHTYGDLKADSDSLAAVIDQLGLPEKSPVVVFGGQEYEMLATFVALTKSGHAYIPIDSHSALERVSAILEVAEPSLIIAISAFPLEQVSTPMINLAQVQEAFAQGNNYEITHPVKGDDNYYIIFTSGTTGKPKGVQISHDNLLSFTNWMITDKEFATPSRPQMLAQPPYSFDLSVMYWAPTLALGGTLFTLPSVITQDFKQLFAAIFSLPIAIWTSTPSFADMAMLSEYFNSEKMPGITHFYFDGEELTVKTAQKLRERFPNARIINAYGPTEATVALSAVAVTDEMLATLKRLPIGYTKADSPTFIIDEEGNKLPNGEQGEIIVSGPAVSKGYMNNPEKTAEAFFEFENLPAYHTGDVGTMTDEGLLLYGGRMDFQIKFNGYRIELEDVSQNLNKSRFIESAVAVPRYNKDHKVQNLLAYVILKDGVREQFERDIDITKAIKEDLTDIMMSYMMPSKFLYRDSLPLTPNGKIDIKGLINEVNKR

SEQ ID NO: 4312 - protein, 65 aa, Streptococcus pneumoniae
KNKLVRITLILAKNYRNEWFFLMKQRKELYLFLGRTALYFLIFLGLLYFFSYLGQGQGSFIYNEF

SEQ ID NO: 4313 - protein, 173 aa, Streptococcus pneumoniae
LEIFSNTIWVSSIILVFVTELLNKTESYWGYSNTAYSIGIIISGLIAFRLSEKFLAAKWESILFPLVAMAIVTLTILYFPNAQMFLLFSALVGMLSQLKEVPESVFLQETVEENHLVNVYSVLEVISTLAFSVFVLLMSYITESFGISISFWLSAICLMIEAILIYIRRDYFK

SEQ ID NO: 4314 - protein, 236 aa, Streptococcus pneumoniae
MSNSFVKLLVSQLFANLADIFFRVTIIANIYIISKSVIATSLVPILIGISSFVASLLVPLVTKRLALNRVLSLSQFGKTILLAILVGMFTVMQSVAPLVTYLFVVAISILDGFAAPVSYAIVPRYATDLGKANSALSMTGEAVQLIGWGLGGLLFATIGLLPTTFIILVLYIISSFLMLFLPNAEVEVLESETNLEILLKGWKLVARNPRLRLLYQQIYWKFFQIRFGFLPLYLFL

SEQ ID NO: 4315 - protein, 61 aa, Streptococcus pneumoniae
GFIFISIWKDYIIGDTGRNVYRNAIRSAFGDLSICCCNFHTRWFCSTRFLCYCATLCDRFG

SEQ ID NO: 4316 - protein, 62 aa, Streptococcus pneumoniae
DKDKTLFSANLLVTNGTKRLATKEDIPIKIGTSDVAITDFEIMYMLAMIVTLKKISAKFANN

SEQ ID NO: 4317 - protein, 330 aa, Streptococcus pneumoniae
MSPICEPHFSDTSYGFRPNRSCEKAIMKLLEYLNDGYEWIVDIDLEKFFDTVPQDRLMSLVHNIIEDGDTESLIRKYLHSGVIINGQRYKTLVGTPQGGNLSPLLSNIMLNELDKELEKRGLRFVRYADDCVITVVSEAAAKRMMYSVSRFIEKRLGLKVNMTKTKITRPRELKYLGFGFWKSSDGWKSRPHQDSVRRFKLKLKKLTQRKWSIDLTRRIEQLNLSIRGWINYFSLGNMKSIVASIDERLRTRLRVIIWKQWKKKSRRLWGLLKLGVPKWIADKVSGWGDHYQLVAQKSVLKRAISKPVLEKRGLVSCLDYYLERHALKVS

SEQ ID NO: 4318 - protein, 93 aa, Streptococcus pneumoniae
MSKLLDKILSRENMLEAYNQVKSNKGSAGIDGMTIEEMDNYLRQNWRLTKELIKQRKYKPQPVLRVEIPKPDGGIRQLGIPTVMDRMIQQAIV

SEQ ID NO: 4319 - protein, 81 aa, Streptococcus pneumoniae
SLLIRYIRLTITFLFVEPRFRYPFLSLLPHDSQAWESLLGSPVAGAHRGLTPQIYDMPVVLQKNDDLNRRFAKINMHFFFF

SEQ ID NO: 4320 - protein, 65 aa, Streptococcus pneumoniae
MLNAKIFYIFLCLIVIETTGLLLLKRGLEMGYLDTEAIILAVFSFAFYNLCSFAWVCSTIKNNKK

SEQ ID NO: 4321 - protein, 195 aa, Streptococcus pneumoniae
LFVFADDSLSANSKVVSGEAQFENGSSVRFGDTQVNILSDEVLEVVNPDGSVDTIERRADGVYINGAFYMAYQKNEIDLNISFRSYDPNVWNYVNTIHGNKQANTFANFMTGAGISYMIGRIGALLGGPWGAIIGGAYFGIQAYQSYLDSQSPYPYYITSTYIHVAQRKWKFITEYYRNSNYTGYVKTVTTYVNF

SEQ ID NO: 4322 - protein, 67 aa, Streptococcus pneumoniae
VPKWSNPDYVNELDPKIVDMLVEFHKSQGTLETPEAQAEIAQKREEIEQRRAELEGKKQELLNRLNK

SEQ ID NO: 4323 - protein, 252 aa, Streptococcus pneumoniae
VEGSIPCRPSLLFNGDRKMMNELFGEFLGTLILILLGNGVVAGVVLPKTKSNSSGWIVITMGWGIAVAVAVFVSGKLSPAHLNPAVTIGVALKGGLPWASVLPYILAQFAGAMLGQILVWLQFKPHYEAEENAGNILATFSTGPAIKDTVSNLISEILGTFVLVLTIFALGLYDFQAGIGTFAVGTLIVGIGLSLGGTTGYALNPARDLGPRIMHSILPIPNKGDGDWSYAWIPVVGPVIGAALAVLVFSLF

SEQ ID NO: 4324 - protein, 608 aa, Streptococcus pneumoniae
MEFSKKTRELSIKKMQERTLDLLIIGGGITGAGVALQAAASGLETGLIEMQDFAEGTSSRSTKLVHGGLRYLKQFDVEVVSDTVSERAVVQQIAPHIPKPDPMLLPVYDEDGATFSPFRLKVAMDLYDLLAGVSNTPTANKVLSKKEVLERQPNLKKEGLVGGGVYLDFRNNDARLVIENIKRANQDGALIANHVKAEGFLFDESGKITGVVARDLLTDQVFEIKARLVINTTGPWSDKVRNLSNKGTQFSQMRPTKGVHLVVDSSKIKVSQPVYFDTGLGDGRMVFVLPRENKTYFGTTDTDYTGDLEHPKVTQEDVDYLLGIVNNRFPESNITIDDIESSWAGLRPLIAGNSASDYNGGNNGTISDESFDNLIATVESYLSKEKTREDVESAVSKLESSTSEKHLDPSAVSRGSSLDRDDNGLLTLAGGKITDYRKMAEGAMERVVDILKAEFDRSFKLINSKTYPVSGGELNPANVDSEIEAFAQLGVSRGLDSKEAHYLANLYGSNAPKVFALAHSLEQAPGLSLADTLSLHYAMRNELALSPVDFLLRRTNHMLFMRDSLDSIVEPVLDEMGRFYDWTEEEKATYRADVEAALANNDLAELKN

SEQ ID NO: 4325 - protein, 99 aa, Streptococcus pneumoniae
QIFTVQMHRRSLHLLTAWNKRQDSAWQILCPFTMQCATSWLLAQLTSFFVVPTICSLCVIAWIASLSQFWMKWDDSMTGQKKKKQLTVLMSKQLSLTTI

SEQ ID NO: 4326 - protein, 502 aa, Streptococcus pneumoniae
MSQEKYIMAIDQGTTSSRAIIFNKKGEKVSSSQKEFTQIFPQAGWVEHNANEIWNSVQSVIAGAFIESGVKPNQIEAIGITNQRETTVVWDKKTGLPIYNAIVWQSRQTAPLAEQLKSQGYVEKFHEKTGLIIDAYFSATKVRWILDHVEGAQERAEKGELLFGTIDTWLVWKLTDGAAHVTDYSNAARTMLYNIKELKWDDEILEILNIPKAILPEVRSNSEIYGKTAPFHFYGGEVPISGMAGDQQAALFGQLAFEPGMVKNTYGTGSFIIMNTGEEMQLSENNLLTTIGYGINGKVYYALEGSIFIAGSAIQWLRDGLRMVENSPESEKYARDSHNNDEVYVVPAFTGLGAPYWNQNARGSVFGLTRGTSKEDFIKATLQSIAYQVRDIIDTMQVDTQTAIQVLKVDGGAAMNNFLMQFQADILGIDIARAKNLETTALGAAFLAGLSVGYWKNLDELKLLNETGELFEPSMNESRKEQLYKGWKKAVKATQVFAEVDD

SEQ ID NO: 4327 - protein, 475 aa, Streptococcus pneumoniae
MYLGDLMEKAECGQFSILSFLLQESQTTVKAVMEETGFSKATLTKYVTLLNDKALDSGLELTIHSEDENLRLSIGAATKGRDIRSLFLDSAVKYQILVYLLYHQQFLAHQLAQELVISEATLGRHLAGLNQILSEFDLSIQNGRWRGPEHQIRYFYFCLFRKVWSSQEWEGHMQKPERKQEIANLEEICGASLSAGQKLDLVLWAHISQQRLRVNACQFQVIEEKMRGYFDNIFYLRLLRKVPSFFAGQHIPLGVEDGEMMIFFSFLLSHRILPLHTMEYILGFGGQLADLLTQLIQEMKKEELLGDYTEDHVTYELSQLCAQVYLYKGYILQDRYKYQLENRHPYLLMEHDFKETAEEIFHALPAFQQGTDLDKKILWEWLQLIEYMAENGGQHMRIGLDLTSGFLVFSRMAAILKRYLEYNRFITIEAYDPSRHYDLLVTNNPIHKKEQTPVYYLKNDLDMEDLAGIRQLLFT

SEQ ID NO: 4328 - protein, 65 aa, Streptococcus pneumoniae
YSFNNFIHSYYFSIKMPKGGAVCLLIFRIMDQEISMKIKRETDYFSICKIYAMLKVENERGNKCI

SEQ ID NO: 4329 - protein, 290 aa, Streptococcus pneumoniae
MDKIIKTISESGAFRAFVLDSTETVRTAQEKHQTQASSTVALGRTLIASQILAANEKGNTKLTVKVLGSSSLGAIITVADTKGNVKGYVQNPGVDIKKTATGEVLVGPFVGNGQFLVITDYGTGNPYNSITPLISGEIGEDLAFYLTESQQTPSAVGLNVLLDEEDKVKVAGGFLVQVLPGAKKEEIARFEKRIQEMPAISTLLESDDHIEALLKTIYGDEAYKRLSEEEIRFQCDCSHERFMNALASLPSSDLQEMKEEDHGVEITCQFCQTTYNFDEKDLEELIRDKS

SEQ ID NO: 4330 - protein, 326 aa, Streptococcus pneumoniae
VTNLNTPFMIGNVEIPNRTVLAPMAGVTNSAFRTIAKELGAGLVVMEMVSDKGIQYNNEKTLHMLHIDEGENPVSIQLFGSDEDSLARAAEFIQENTKTDIVDINMGCPVNKIVKNEAGAMWLKDPDKIYSIINKVQSVLDIPLTVKMRTGWADPSLAVENALAAEAAGVSALAMHGRTREQMYTGHADLETLYKVAQALTKIPFIANGDIRTVQEAKQRIEEVGADAVMIGRAAMGNPYLFNQINHYFETGEILPDLTFEDKMKIAYEHLKRLINLKGENVAVREFRGLAPHYLRGTSGAAKLRGAISQASTLAEIEALLQLEKV

SEQ ID NO: 4331 - protein, 62 aa, Streptococcus pneumoniae
DKSIILNIKSEQNQLSDTQNSVLFAFLSNLSILKIYNKEFLKSKSFYPRLFSFKPNTFYKHF

SEQ ID NO: 4332 - protein, 221 aa, Streptococcus pneumoniae
INHYFILFLARMVAPAKVRRPAISSARFEIDPVDGNDFFGLFVAFSFVEAWLEGCLSLLKLFVVDGFLSSACGLLLSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSSCGLTSG

SEQ ID NO: 4333 - protein, 450 aa, Streptococcus pneumoniae
MKAVSEYVGKMVRDAYVKSDRKRHKNTVALVNQLGNIKNRYLNEIVHSTSKSQLQELMMKSQSEVDEAVSKFEKDSFSSSSSGSSTKPETPQPENPEHQKPTTPSPDTKPSPQPEGKKPSVPDINQEKEKAKLAVVTYMSKILDDIQKHHLQKEKHRQIVALIKELDELKKQALSEIDNVNTKVEIENTVHKIFADMDAVVTKFKKGLTQDTPKEPGNKKPSAPKPGMQPSPQPEVKPQLEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPDNSKPQADDKKPSTTNNLSKDKQPSNQASTNEKATNKPKKSLPSTGSISNLALEIAGLLTLAGATILAKKRMK

SEQ ID NO: 4334 - protein, 182 aa, Streptococcus pneumoniae
QKNQVTKNHLLQNQVCNQVLNQRLNRSWKNQNQRLNRNQKNQNQRLNRSRKNQNQRLNRSRKNQNQRLNRSRKNQNQRLNRSRKNQNQRLNRSRKNQNQRLNRSRKNQNQRLNRSRKNQNQRLNRSRKNQNQRLNRSRKNQNQRLNRNQKNQNQRLNRNQKNQNQIIASHKQMIRSHQLQII

SEQ ID NO: 4335 - protein, 175 aa, Streptococcus pneumoniae
LWLAIIWFWFFWLRFNLWFWFFWLRFNLWFWFFRLRFNLWFWFFRLRFNLWFWFFRLRFNLWFWFFRLRFNLWFWFFRLRFNLWFWFFRLRFNLWFWFFRLRFNLWFWFFRLRFNLWFWFFRLRFNLWFWFFWLRFNLWFWFFQLRFNLWLRTWLHTWFWSRWFFVTWFFWCVLS

SEQ ID NO: 4336 - protein, 181 aa, Streptococcus pneumoniae; identical to SEQ ID NO: 3390

SEQ ID NO: 4337 - protein, 250 aa, Streptococcus pneumoniae; identical to SEQ ID NO: 3931

SEQ ID NO: 4338 - protein, 64 aa, Streptococcus pneumoniae; identical to SEQ ID NO: 3389

SEQ ID NO: 4339 - protein, 54 aa, Streptococcus pneumoniae
MFKSNHERRMRYSIRKFSVGVASVAVASLFMGSVVHATEKEGSTQAANVIKLVI

SEQ ID NO: 4340 - protein, 418 aa, Streptococcus pneumoniae; identical to SEQ ID NO: 2954

SEQ ID NO: 4341 - protein, 231 aa, Streptococcus pneumoniae
MWYFYNTDGSMATGWLQNNGSWYYLNSNGAMATGWLQNNGSWYYLNANGSMATGWLQNNGSWYYLNANGSMATGWLQNNGSWYYLNANGDMATGWLQYNGSWYYLNANGDMATGWLQYNGSWYYLNANGDMATGWLQYNGSWYYLNSNGAMVTGWLQNNGSWYYLNANGSMATGWVKDGDTWYYLEASGAMKASQWFKVSDKWYYVNGSGALAVNTTVDGYGVNANGEWVN

SEQ ID NO: 4342 - protein, 109 aa, Streptococcus pneumoniae
MNHCFGAILSPLNHQYCRSTTYRFLVSSLFLVQELVALVFAVAVESIDYILHLIYQHSLLQLVDHLFFLLLVVQLASLVLVRELDSQALQLVFLVEEPALVVVVQLVFL

SEQ ID NO: 4343 - protein, 104 aa, Streptococcus pneumoniae
KKSRQIVKKQKKKLNEKQQKKIKLKKNQLNNHNQRRLLNQKNQLKSLRIQLPHQNQRSQLNNQKQKKQMINKLKKTMLVDQMKNIIDRLNSNRKNQSNQLLHQK

SEQ ID NO: 4344 - protein, 216 aa, Streptococcus pneumoniae
TKGGGENEEFLREQATPDKKENDAKSSDSSVGEEALPSPSLKPEKKVAEAEKKVAEAEKKAKAQKEEDRRNYPTNTYKTLELEIAESDVKVKEAELELVKEEAKESRNEEKVNQAKAKVESKKAEATRLEKIKTDRKKAEEEAKRKAAEEDKVKEKPAEQPQPAPAPQPEKPTEEPENPAPAPKPEKPAEQPKAEKTDDQQAEEDYAGRSDEEYNR

SEQ ID NO: 4345 - protein, 72 aa, Streptococcus pneumoniae
LLIICFFCFWLFSWLLWFWCGSWILRLFSWFFWLRSRRWLWLFSWFFFNFIFFCCFSFSFFFCFFTICLDFF

SEQ ID NO: 4346 - protein, 104 aa, Streptococcus pneumoniae
LLALSETLRFLRPFGLSCSEVATFFSTASFNLASALRLASSSAFSRSVLMFSNLVASAFLLSTFASACLIFSSSRDSLASSFTSSSSAFLTSTSDSAISSSSVL

SEQ ID NO: 4347 - protein, 275 aa, Streptococcus pneumoniae
MFASKSERKVHYSIRKFSIGVASVAVASLVMGSVVHATEKEVTTQVATSSNRANESQAGHRKAAEQFDEYIKTMIQLDRRKHTQNFALNIKLSRIKTEYLRKLNVLEEKSKAELPSETKKEIDAAFEQFKKDTNRTKKTVAEAEKKVEEAKKKAKAQKEEDHRNYPTNTYKTLELEIAESDVEVKKAELELVKEEAKESRDDEKIKQAEAKVESKKAEATRLENIKTDREKAEEEAKRRAEAKLKEAVEKNVATSEQDKPKGRRKRRVSERASNT

SEQ ID NO: 4348 - protein, 175 aa, Streptococcus pneumoniae
MVLAIILVTFLIRLIFLKRSIENEKRILSNGGKEFGVENTKRLTLAHIVFYLSCLVEAMVHKTMFDGMSMVGLVLLIFSMLMLMLVIHLLGDIWTVKLMLVNNHKYVDHILFRTVKHPNYFLNILPELIGLTLLSHAYMTFVLVFPVYAVILYRRIAEEEKLLHEVIIPNGSIKR

SEQ ID NO: 4349 - protein, 446 aa, Streptococcus pneumoniae
MIKNPKLLTKSFLRSFAILGGVGLVIHIAIYLTFPFYYIQLEGEKFNESARVFTEYLKTKTSDEIPSLLQSYSKSLTISAHLKRDIVDKRLPLVHDLDIKDGKLSNYIVMLDMSVSTADGKQVTVQFVHGVDVYKEAKNILLLYLPYTFLVTIAFSFVFSYFYTKRLLNPLFYISEVTSKMQDLDDNIRFDESRKDEVGEVGEVGKQINGMYEHLLKVIHELESRNEQIVKLQNQKVSFVRGASHELKTPLASLRIILENMQHNIGDYKDHPKYIAKSINKIDQMSHLLEEVLESSKFQEWTECRETLTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVSNILESYQMDYSFLPYEHGMEFKISL

SEQ ID NO: 4350 - protein, 217 aa, Streptococcus pneumoniae
MNILVADDEEMIREGIAAFLTEEGYHVIMAKDGQEVLEKFQDLPIHLMVLDLMMPRKSGFEVLKEINQKHDIPVIVLSALGDETTQSQVFDLYADDHVTKPFSLVLLVKRIKALIRRYYVIEDLWRYQDVTVDFTSYKAHYKNEEIDLKPKELLVLKCLIQHKNQVLSREQILEEISKDVADLPCDRVVDVYIRTLRKKLALDCIVTVKNVGYKISL

SEQ ID NO: 4351 - protein, 74 aa, Streptococcus pneumoniae
LIFIEFHSTVTYGQMLILLFFYAISNFNWPALTPILSVLPATKSPLRRSSANLSSTSVCRVLRSGRAPISGSYP

SEQ ID NO: 4352 - protein, 810 aa, Streptococcus pneumoniae
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVFYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLQLDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATAFRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 4353 - protein, 173 aa, Streptococcus pneumoniae
MRKFRYNSQTRSRFKERGGFVMRFKNTSDHIEAYIKAILDQSGIVELQRSQLADTFQVVPSQINYVIKTRFTESRGYLVESKRGGGGYIRIGRIEFSSHHEMLRELLYSIGERVSQEIYEDILQLLVEQELMTKQEMNLLESVALDRVLGEEAPVVRANMLRQIIQEVDRKGK

SEQ ID NO: 4354 - protein, 242 aa, Streptococcus pneumoniae
MTEIRLEHVSYAYGQERILEDINLQVTSGEVVSILGPSGVGKTTLFNLIAGILEVQSGRIVLDGEENPKGRVSYMLQKDLLLEHKTVLGNIILPLLIQKVDKAEAISRADKILATFQLTAVRDKYPHELSGGMRQRVALLRTYLFGHKLFLLDEAFSALDEMTKMELHAWYLEIHKQLQLTTLIITHSIEEALNLSDRIYILKNRPGQIVSEIKLDWSEDEDKEVQKIAYKRQILAELGLDK

SEQ ID NO: 4355 - protein, 335 aa, Streptococcus pneumoniae
MKKTWKVFLTLVTALVAVVLVACGQGTASKDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 4356 - protein, 135 aa, Streptococcus pneumoniae
LISSFLFQKRSILSTFPFNHIFFTDIDQLHTQKTDNRHQNNNGKHGIILKQFFRLNHINTKTFKTSQPLRYHSCDKGVGDTDPQTCIKVRQANRDFKMPQDLPRVCSHQTKQSQHILVTMPKTVQNTNDDGKGCC

SEQ ID NO: 4357 - protein, 249 aa, Streptococcus pneumoniae
LKSILRRHISLLGFLGVLSIWQLAGFLKLLPKFILPTPLEILQPFVRDREFLWHHSWATLRVALLGLILGVLIACLMAVLMDSLTWLNDLIYPMMVVIQTIPTIAIAPILVLWLGYGILPKIVLIILTTTFPIIVSILDGFRHCDKDMLTLFSLMRANPWQILWHFKIPVSLPYFYAGLRVSVSYAFITTVVSEWLGGFEGLGVYMIQSKKLFQYDTMFAIIILVSIISLLGMKLVDISEKYVIKWKRT

SEQ ID NO: 4358 - protein, 96 aa, Streptococcus pneumoniae
MKASIALQVLPLAQGIDRIAVIDQVIAYLQTQEVTMVVTPFETVLEGEFDELMRILKEALEVAGQEADNVFANVKINVGEILSIDEKLEKYTETTH

SEQ ID NO: 4359 - protein, 283 aa, Streptococcus pneumoniae
MTGFIHFKDLDGASVGNSHPSTSPGGTHYFKTKSAIKTEPLASGTVIDYYYPGEKVHYDQILEKDGYKWLSYTAYNGSYRYVQLEAVNKNPLGNSVLSSTGGTHYFKTKSAIKTEPLVSATVIDYYYPGEKVHYDQILEKDGYKWLSYTAYNGSRRYIQLEGVTSSQNYQNQSGNISSYGSNNSSTVGWKKINGSWYHFKSNGSKSTGWLKDGSSWYYLKLSGEMQTGWLKENGSWYYLGSSGAMKTGWYQVSGKWYYSYSSGALAVNTTVDGYRVNSDGERV

SEQ ID NO: 4360 - protein, 137 aa, Streptococcus pneumoniae
MKILPFIARGTSYYLKMSVKKLVPFLVVGLMLAAGDSVYAYSRGNGSIARGDDYPAYYKNGSQEIDQWRMYSRQCTSFVAFRLSNVNGFEIPAAYGNANEWGHRARREGYRVDNTPTIGSITCSTPGTNVHGAWVSK

SEQ ID NO: 4361 - protein, 88 aa, Streptococcus pneumoniae
MSDAFTDVAKMKKIKEEIKAHEGQVVEMTLENGRKRQKNRLGKLIEVYPSLFIVEFGDVEGDKQVNVYVESFTYSDILTEKNLIHYLD

SEQ ID NO: 4362 - protein, 450 aa, Streptococcus pneumoniae
MAEVEELRVQPQDILAEQSVLGAIFIDESKLVFVREYIESRDFFKYAHRLIFQAMVDLSDRGDAIDATTVRTILDNQGDLQNIGGLSYLVEIVNSVPTSANAEYYAKIVAEKAMLRRLIAKLTESVNQAYEASQPADEIIAQAEKGLIDVSENANRSGFKNIRDVLNLNFGNLEARSQQTTDITGIATGYRDLDHMTTGLHEEELIILAARPAVGKTAFALNIAQNIGTKLDKTVAIFSLEMGAESLVDRMLAAEGLVESHSIRTGQLTDEEWQKYTIAQGNLANASIYIDDTPGIRITEIRSRSRKLAQETGNLGLIVIDYLQLITGTGRENRQQEVSEISRQLKILAKELKVPVIALSQLSRGVEQRQDKRPVLSDIRESGSIEQDADIVAFLYRDDYYERGGEEEEGIPNNKVEVIIEKNRSGARGTVELIFQKEYNKFSSISKREA

SEQ ID NO: 4363 - protein, 150 aa, Streptococcus pneumoniae
MKVIFLADVKGKGKKGEIKEVPTGYAQNFLIKKNLAKEATAQAVGELRGKQKSEEKAHAEMIAEGKAIKAQLEAEETVVEFVEKVGPDGRTFGSITNKKIAEELQKQFGIKIDKRHIQVQAPIRAVGLIDVPVKIYQDITSVINLRVKEG

SEQ ID NO: 4364 - protein, 657 aa, Streptococcus pneumoniae
MKKFYVSPIFPILVGLIAFGVLSTFIIFVNNNLLTVLILFLFVGGYVFLFKKLRVHYTRSDVEQIQYVNHQAEESLTSLLEQMPVGVMKLNLSSGEVEWFNPYAELILTKEDGDFDLEAVQTIIKASVGNPSTYAKLGEKRYAVHMDASSGVLYFVDVSREQAITDELVTSRPVIGIVSVDNYDDLEDATSESDISQINSFVANFISEFSEKYMMFSRRVSMDRFYLFTDYTVLEGLMNDKFSVIDAFREESKQRQLPLTLSMGFSYGDGNHDEIGKVALLNLNLAEVRGGDQVVVKENDETKNPVYFGGGSAASIKRTRTRTRAMMTAISDKIRSVDQVFVVGHKNLDMDALGSAVGMQLFASNVIENSYALYDEEQMSPDIERAVSFIEKEGVTKLLSVKDAMGMVTNRSLLILVDHSKTALTLSKEFYDLFTQTIVIDHHRRDQDFPDNAVITYIESGASSASELVTELIQFQNSKKNRLSRMQASVLMAGMMLDTKNFTSRVTSRTFDVASYLRTRGSDSIAIQEIAATDFEEYREVNELILQGRKLGSDVLIAEAKDTKCYDTVVISKAADAMLAMSGIEASFVLAKNIQGFISISARSRSKLNVQRIMEELGGGGHFNLAAAQIKDVTLSEAGEKLTEIVLNEIKEKEKEE

SEQ ID NO: 4365 - protein, 182 aa, Streptococcus pneumoniae
MIKYSIRGENLEVTEAIRDYVVSKLEKIEKYFQPEQELDARINLKVYREKTAKVEVTIPLGSITLRAEDVSQDMYGSIDLVTDKIERQIRKNKTKIERKNKNKVATGQLFTDALVEDSNVVQSKVVRSKQIDLKPMDLEEAILQMDLLGHDFFIYVDVEDQTTNVIYRREDGEIGLLEVKES

SEQ ID NO: 4366 - protein, 220 aa, Streptococcus pneumoniae
MKCLLCGQTMKTVLTFSSLLLLRNNDSCLCSDCDSTFERIGEENCPNCMKTELSTKCQDCQLWCKEGVEVSHRAIFTYNQAMKDFFSRYKFDGDFLLRKVFASFLSEELKKYKEYQFVVIPLSPDRYANRGFNQVEGLVEAAGFEYLDLLEKREERASSSKNRSERLGTELPFFIKSGVTIPKKILLIDDIYTTGATINRVKKLLEEAGAKDVKTFSLVR

SEQ ID NO: 4367 - protein, 432 aa, Streptococcus pneumoniae
MKVNLDYLGRLFTENELTEEERQLAEKLPAMRKEKGKLFCQRCNSTILEEWYLPIGAYYCRECLLMKRVRSDQTLYYFPQEDFPKQDVLKWRGQLTPFQEKVSEGLLQAVDKQKPTLVHAVTGAGKTEMIYQVVAKVINAGGAVCLASPRIDVCLELYKRLQQDFSCGIALLHGESEPYFRTPLVVATTHQLLKFYQAFDLLIVDEVDAFPYVDNPMLYHAVKNSVKENGLRIFLTATSTNELDKKVRLGELKRLNLPRRFHGNPLIIPKPIWLSDFNRYLDKNRLSPKLKSYIEKQRKTAYPLLIFASEIKKGEQLAEILQEQFPNEKIGFVSSVTEDRLEQVQAFRDGELTILISTTILERGVTFPCVDVFVVEANHRLFTKSSLIQIGGRVGRSMDRPTGDLLFFHDGLNASIKKAIKEIQMMNKEAGL

SEQ ID NO: 4368 - protein, 211 aa, Streptococcus pneumoniae
MEFRTIKEDGQVQEEIKKSRFICHAKRVYSEEEARDFITAIKKEHYKATHNCSAFIIGERSEIKRTSDDGEPSGTAGVPMLGVLENHNLTNVCVVVTRYFGGIKLGAGGLIRAYAGSVALAVKEIGIIEIKEQAGIAIQMSYAQYQEYSNFLKEHDLMELDTNFTDQVDTMIYVDKEEKETIKAALVEFFNGKVTLTDQGLREVEVPVNLV

SEQ ID NO: 4369 - protein, 308 aa, Streptococcus pneumoniae
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVYAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEFEV

SEQ ID NO: 4370 - protein, 346 aa, Streptococcus pneumoniae
MAEITAKLVKELREKSGAGVMDAKKALVETDGDIEKAIELLREKGMAKAAKKADRVAAEGLTGVYVNGNVAAVIEVNAETDFVAKNAQFVELVNTTAKVIAEGKPANNEEALALIMPSGETLEAAYVSATATIGEKISFRRFALIEKTDAQHFGAYQHNGGRIGVISVVEGGDEALAKQLSMHIAAMKPTVLSYKELDEQFVKDELAQLNHVIDQDNESRAMVNKPALPHLKYGSKAQLTDDVIAQAEADIKAELAAEGKPEKIWDKIIPGKMDRFMLDNTKVDQAYTLLAQVYIMDDSKTVEAYLESVNASVVEFARFEVGEGIEKAANDFEAEVAATMAAALNN

SEQ ID NO: 4371 - protein, 128 aa, Streptococcus pneumoniae
LSVFCNEVSFSVYFNNCCNITVNINTSQTFCSNTVSFLSCLSHTFFTKQFNRFFDVTVCFYKRFFSVHNTGTRFFTQLFYKFSCNFCHFNSPIFFENRRAGLSPALLGNYYLYKLSVVTFYNFNDFFN

SEQ ID NO: 4372 - protein, 287 aa, Streptococcus pneumoniae
LMNCEAVALGSFCELKSRRGKKQKGEILMAVISMKQLLEAGVHFGHQTRRWNPKMAKYIFTERNGIHVIDLQQTVKYADQAYDFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAASETQADSIEEIVEVVEGDNA

SEQ ID NO: 4373 - protein, 74 aa, Streptococcus pneumoniae
LLQLLNQQHVSKYQNQIMQVIVQLEITVDGSIQQQLLKVLLHIFMQINLQRDSNRALFSGFTVTIPIKNYIKIA

SEQ ID NO: 4374 - protein, 392 aa, Streptococcus pneumoniae
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQRADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 4375 - protein, 79 aa, Streptococcus pneumoniae
FYYLEQQFCHQSFLHAQLLKQLLEKPLLYLIKVTLRFFSSYYVDTPSFKDNTSIPKKGLINITPLLHLYVVLIDNIFQK

SEQ ID NO: 4376 - protein, 164 aa, Streptococcus pneumoniae
MRQLKRVGVFLLLPFFVLIDAHISQLLGSFFPHVHLASHFLFLFLLFETIEVSEYLYLVYCFVIGLVYDVYFFHLIGITTLLFILLGAFLHKLNSVILLIRWTRMLAMIVLTFLFEMGSYLLAFMVGLTVDSMSIFIVYSLVPTMILNFLWITVFQFIFEKYYL

SEQ ID NO: 4377 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEEKSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 4378 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 4379 - protein, 56 aa, Streptococcus pneumoniae
VDPIGEQSNPLGYNALKSYYPFSDSLNSSILTGNRLNDTPLSANRLQKAVILGTPN

SEQ ID NO: 4380 - protein, 279 aa, Streptococcus pneumoniae
MGIALENVNFTYQEGTPLASAALSDVSLTIEDGSYTALIGHTGSGKSTILQLLNGLLVPSQGSVRVFDTLITSTSKNKDIRQIRKQVGLVFQFAENQIFEETVLKDVAFGPQNFGVSEEDAVKTAREKLALVGIDESLFDRSPFELSGGQMRRVAIAGILAMEPAILVLDEPTAGLDPLGRKELMTLFKKLHQSGMTIVLVTHLMDDVAEYANQVYVMEKGRLVKGGKPSDVFQDVVFMEEVQLGVPKITAFCKRLADRGVSFKRLPVKIEEFKESLNG

SEQ ID NO: 4381 - protein, 115 aa, Streptococcus pneumoniae
AYSATSSIKCVTKTMVIPDWWSFLNRVINSFLPRGSRPAVGSSKTNIAGSMASMPAMATRLICPPDSSNGLRSKSDSSIPTRASFSRAVFTASSSETPKFCGPKATSFKTVSSKI

SEQ ID NO: 4382 - protein, 261 aa, Streptococcus pneumoniae
MKSIIDVKNLSFRYKENQNYYDVKDITFHVKRGEWLSIVGHNGSGKSTTVRLIDGLLEAESGEIVIDGQRLTEENVWNIRRQIGMVFQNPDNQFVGATVEDDVAFGLENQGLSRQEMKKRVEEALALVGMLDFKKREPARLSGGQKQRVAIAGVVALRPAILILDEATSMLDPEGRRELIGTVKGIRKDYDMTVISITHDLEEVAMSDRVLVMKKGEIESTSSPRELFSRNDLDQIGLDDPFANQLKKSLTRMAMIYLKII

SEQ ID NO: 4383 - protein, 74 aa, Streptococcus pneumoniae
SFRIPFTVPISSLRPSGSNILVASSKIKIAGLRATTPAMATRCFWPPDRRAGSLFLKSNMPTKARASSTLFFIS

SEQ ID NO: 4384 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 4385 - protein, 276 aa, Streptococcus pneumoniae
MTSMRKKTIGEVLRLARINQGLSLDELQKKTEIQLDMLEAMEADDFDQLPSPFYTRSFLKKYAWAVELDDQIVLDAYDSGSMITYEEVDVDEDELTGRRRSSKKKKKKTSFLPLFYFILFALSILIFVTYYVWNYIQTQPEEPSLSNYSVVQSTSSTSSVPHSSSSSSSSIESAISVSGEGNHVEIAYKTSKETVKLQLAVSDVTSWVSVSESELEGGVTLSPKKKSAEATVATKSPVTITLGVVKGVDLTVDNQTVDLSKLTAQTGQITVTFTKN

SEQ ID NO: 4386 - protein, 427 aa, Streptococcus pneumoniae
MTKVVFEEKYYPAVKEMVYRTRLANGLTVALLPKKEFKEVYGSVTVQFGSVDTFVTEVDGDVKQYPGGIAHFLEHKLFEREDSSDLMSAFTSLGADSNAFTSFTKTNYLFSATDYFLENLDLLDELVTSAHFTEASILTEQDIIQQEREMYQDDPDSCLFFSTLANLYPGTPLATDIVGSEESISQINLTNLQENFTKFYKPVNMSLFLVGNFDVERVQDYFESKELKDSDFQEVAREKLFLQPVKLTDSMRMEVSSPKLAIGVRGKREVSEADCYRHHILLKLLFAMMFGWTSDRFQKCYESGKIDASLSLEVEITSRFHFVMLTMDTKEPVALSHQFRKAIRNFTKDLDITEEHLDIIKREMFGEFFSSMNSLEFIATQYDAFENGETIFDLPKILQEITLEDVLDAGHHLIDDGDIVDFTIFPS

SEQ ID NO: 4387 - protein, 416 aa, Streptococcus pneumoniae
MELVHGISTHFIQSKKFKTNKITVRFTAPLSLDTIAGHMLSASMLETANQMYPTSQDLRRHLASLYGTDMSTNCFRRGQSHIIELTFTYVRDEFLSRKNVLTSQILELVKETLFSPVVVDNGFDPALFEIEKKQLLASLAADMDDSFYFAHKELDKLFFHDERLQLEYSDLRNRILAETPQSSYSCFQEFLANDRIDFFFLGDFNEVEIQNVLESFGFKGRKGDVKVQYCQPYSNILQEGMVRKNVGQSILELGYHYRSKYGDEQHLPMIVMNGLLGGFAHSKLFTNVRENAGLAYTISSELDLFSGFLRMYAGINRENRNQARKMMNNQLLDLKKGYFTEFELNQTKEMIRWSLLLSQDNQSSLIERAYQNALFGKSSADFKSWIAKLEQIDKDAICRVANNVKLQAIYFMEGIE

SEQ ID NO: 4388 - protein, 122 aa, Streptococcus pneumoniae
MEYKLFEEFITLQALLKELGITHSGGAIKSFLSEHSVYFNRELESRRGKKLRIGDKVDIPDMNIDILLTQPTSEEQDEYQADKVEKERIAKLVKKMNKGVKKDKSKPASSPKSQQAPRFPGR

SEQ ID NO: 4389 - protein, 365 aa, Streptococcus pneumoniae
MWLQHLSLKTFRNYKETKIDFNPKLNVFLGRNAQGKTNMLEAIYFLALTRSHRTRTDKNLIHFDEEQLHLSGLVQKKTGSIPLEIELTQKGRVTKVNHLKQARLSDYVGHMNVVLFAPEDLQLIKGAPSIRRKFIDMELGQIKPIYLSDLTNYNHILKQRNTYLKSAQKIDETFLSVLDDQLVDYGCRVMNHRLDFIKKLESFGRKKHFELSNQIEELSISYQSSVNITDKQNLSESFKIALEKSRSRDLFKKNTGVGPHRDDISFYINGMDASFGSQGQHRSLVLSIKLAEIELMESITTESPILLLDDVMSELDNTRQLKLLETISQSIQTFITTTSLDHLQNLPENLSIFTIQDGKAAVNGN

SEQ ID NO: 4390 - protein, 492 aa, Streptococcus pneumoniae
MSNWDTKFLKKGFTFDDVLLIPAESHVLPNDADLTTKLADNLTLNIPIITAAMDTVTESQMAIAIARAGGLGVIHKNMSIAQQADEVRKVKRSENGVIIDPFFLTPEHTIAEADELMGRYRISGVPVVETLENRKLVGILTNRDLRFISDYNQPISNHMTSENLVTAPVGTDLATAESILQEHRIEKLPLVDEEGSLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVIAGVGVPQVTAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMIGGIRSGMGYCGAANLKELHDNAQFIEMSGAGLKESHPHDVQITNEAPNYSM

SEQ ID NO: 4391 - protein, 48 aa, Streptococcus pneumoniae
TAPATRRRPNSSLAAFGNSITFSISLIVIKPERLPSSSTNGSFSIRCS

SEQ ID NO: 4392 - protein, 341 aa, Streptococcus pneumoniae
MTKPIILTGDRPTGKLHIGHYVGSLKNRVLLQEEDKYDMFVFLADQQALTDHAKDPQTIVESIGNVALDYLAVGLDPNKSTIFIQSQIPELAELSMYYMNLVSLARLERNPTVKTEISQKGFGESIPTGFLVYPIAQAADITAFKANYVPVGTDQKPMIEQTREIVRSFNNAYNCDVLVEPEGIYPDNERAGRLPGLDGNAKMSKSLNNGIYLADDADTLRKKVMSMYTDPDHIRVEDPGKIEGNMVFHYLDVFGRPEDAQEIADMKERYQRGGLGDVKTKRYLLEILERELGPIRERRIEFAKDMGEVYNMIQKGSERAREVAGQTLSEVKGAMGLHYFN

SEQ ID NO: 4393 - protein, 540 aa, Streptococcus pneumoniae
LLTVSDVSLRFSDRKLFDDVNIKFTEGNTYGLIGANGAGKSTFLKILAGDIEPTTGHISLGPDERLSVLRQNHFDYEDERAIDVVIMGNEKLYSIMKEKDAIYMKEDFSDEDGVRAAELEGEFAELGGWEAESEASQLLQNLNIPEELHYQNMSELANGEKVKVLLAKALFGKPDVLLLDEPTNGLDIQSITWLEDFLIDFDNTVIVVSHDRHFLNKVCTHMADLDFGKIKLYVGNYDFWKESSELAAKLLADRNAKAEEKIKQLQEFVARFSANASKSRQATSRKKMLDKIELEEIVPSSRKYPFINFKAEREIGNDLLTVENLTVKIDGETILDNISFILRPDDKTALIGQNDIQTTALIRAIMGDIDYEGTVKWGVTTSQSYLPKDNSADFAGGESILDWLRQFASKEDDDNTFLRGFLGRMLFSGDEVNKPVNVLSGGEKVRVMLSKLMLLKSNVLVLDDPTNHLDLESISSLNDGLKNFKESIIFASHDHEFIQTLANHIIVLSKNGVIDRIDETYDEFLENAEVQAKVKELWKD

SEQ ID NO: 4394 - protein, 850 aa, Streptococcus pneumoniae
MKSFLKTYRTYFISFIIPVVIMSGVYLSQGIYWNSDNSPLLGDGFHQYVIFDIALRNILHGNSSLFYTFTSGLGLNFYALSSYYLGSFLAPLVYFFDLTNMPDAIYLTTLLKFGLIGLSTFFSLNKLFQSIPQTLKLALSTSYALMSFTVSQLEIKTWLDVFILIPLIITGLHLLITEKKLLLYFTSLSILFIQNYYFGYMTVLFLIFWYLCQISWDFKTRKSSVLDFIVISFLAGMASLIMTLPTLFDLQTHGEKLTEVTKFQTESSWYLDLFAKQFIGSFDTTKYGAIPMIFVGLLPFILTILFFTLKSIKFHVKLIYVIFFAFLIASFYIEALDLFWQGMHTPNMFLHRYAWIFSTLLIYTAAEVLKRLKELKVWNFLVSLFLVVAGFLATIYLKSHYSFLTDLNILLTLEFLVVYSLLLLAVIKKFISVNLFAILISLFILVEMSLNASSQMDGIAKEWGFASRSAYSRDIPAMESFSTYIGNQFTRTEKLQTQTGNDSMKFNYNGISQFSSVRNRSSSSTLDKLGFKSSGTNLNLRYANNSILADSLFGIQYNISDSPIDKYGFKDIYQKDNLTLYENQYSLPIAVASQSVYNDVKFNEHTLDNQASFLNQLANVNFDYFSPIPYEKTEKIENTNDLISVTSSSNEDAAIQYQIEVPENSQVYLSFINLHFSNDKQKKVDILVNGEKKTFTTDNVFSFFNLGYTKEKKTFNINVSFPGNSQVSFESPTFYRLDTKTFTEAIQKIKEQPVTVSTSKNKVFATYDVQQDTSIFFTIPYDKGWSAYQDGKKIEIKQAQTGFMKVDIPKGKGTITLSFIPYGFITGAICSFTSLLLFGIYNHRRKSSKA

SEQ ID NO: 4395 - protein, 104 aa, Streptococcus pneumoniae
LAGILVYGGVQLIGLTANHEMRIFILIILTSLVFMSMVTTLATWNSRIGAFFSLILLLLQLASSAGTYPLALTNDFFRSINPWLPMSYSVSGLRQTISINKSFS

SEQ ID NO: 4396 - protein, 112 aa, Streptococcus pneumoniae
LADGSRKLAEGGTKLTSGLEDLQTGLASLGQGLGNASDQLKSVSTESKNAEILSNPLNLSKTDNDQVPVNGIAIAPYMISVALFVAAISTNMIFAKLPSGRHPESRWAWLKS

SEQ ID NO: 4397 - protein, 255 aa, Streptococcus pneumoniae
MIGISLIPDLYNIIFLSSMWDPYGQLSDLPVAVVNNDKEASYNGNTMAIGKDMVSNLKENKTLDFHFVDEEEGKKGLEDGDYYMVVTLPSDLSDKTTTLSNIQSTAAYQSLTSEQQTEISDSVSQNSTDSIQSAQSIVALVQDLQGSLENLQNQSSNLSTLKNQANQVSPITSTSLIGLSSGLTEIQGDVTSKLVPASQSIASGVNAYTTGVDKVSQGASQLSEKNATLTGSLDKLVSGSNTLTQKSSRLTAGVG

SEQ ID NO: 4398 - protein, 180 aa, Streptococcus pneumoniae
MQESNKRLKTKRTIENAMVQLLMEQPFDKISTVKLVEKAGISRSSFYTHYKDKYDMIEHYQSKLFHTFEYIFQKHAHHKRDAILEVFEYLESEPLLAVLLSENGTKEIQNFLRNKLHIMLSTDLQKRFMQLNLNTTELEYSSIYLTHALFGVCQTWIAHGKKESSQEITDFLMKMLGDTN

SEQ ID NO: 4399 - protein, 250 aa, Streptococcus pneumoniae
MKVLILEDVIEHQVRLERILDEISKESNIPISYKTTGKVREFEEYIENDEVNQLYFLDIDIHGIEKKGFEVAQLIRHYNPYAIIVFITSRSEFATLTYKYQVSALDFVDKDINDEMFKKRIEQNIFYTKSMLLENEDVVDYFDYNYKGNDLKIPYHDILYIETTGVSHKLRIIGKNFAKEFYGTMTDIQEKDKHTQRFYSPHKSFLVNIGNIREIDRKNLEIVFYEDHRCPISRLKIRKLKDILEKKSQK

SEQ ID NO: 4400 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 4401 - protein, 159 aa, Streptococcus pneumoniae
MKIKVVTVGKLKEKYLKDGIAEYSKRISRFAKFEMIELSDEKTPDKASESENQKILEIEGQRILSKIADRDFVIVLAIEGKTFFSEEFSKQLEETSIKGFSTLTFIIGGSLGLSSSVKNRANLSVSFGRLTLPHQLMRLVLVEQIYRAFTIQQGFPYHK

SEQ ID NO: 4402 - protein, 397 aa, Streptococcus pneumoniae
MEANMKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 4403 - protein, 252 aa, Streptococcus pneumoniae
MEKFEMISITDIQKNPYQPRKEFDREKLDELAQSIKENGVIQPIIVRQSPVIGYEILAGERRYRASLLAGLRSIPAVVKQISDQEMMVQSIIENLQRENLNPIEEARAYESLVEKGFTHAEIADKMGKSRPYISNSIRLLSLPEQILSEVENGKLSQAHARSLVGLNKEQQDYFFQRIIEEDISVRKLEALLTEKKQKKQQKTNHFIQNEEKQLRKLLGLDVEIKLSKKDSGKIIISFSNQEEYSRIINSLK

SEQ ID NO: 4404 - protein, 453 aa, Streptococcus pneumoniae
LKEKQFWNRILEFAQERLTRSMYDFYAIQAELIKVEENVATIFLPRSEMEMVWEKQLKDIIVVAGFEIYDAEITPHYIFTKPQDTTSSQVEEATNLTLYNYSPKLVSIPYSDTGLKEKYTFDNFIQGDGNVWAVSAALAVSEDLALTYNPLFIYGGPGLGKTHLLNAIGNEILKNIPNARVKYIPAESFINDFLDHLRLGEMEKFKKTYRSLDLLLIDDIQSLSGKKVATQEEFFNTFNALHDKQKQIVLTSDRSPKHLEGLEERLVTRFSWGLTQTITPPDFETRIAILQSKTEHLGYNFQSDTLEYLAGQFDSNVRDLEGAINDITLIARVKKIKDITIDIAAEAIRARKQDVSQMLVIPIDKIQTEVGNFYGVSIKEMKGSRRLQNIVLARQVAMYLSRELTDNSLPKIGKEFGGKDHTTVIHAHAKIKSLIDQDDNLRLEIESIKKKIK

SEQ ID NO: 4405 - protein, 378 aa, Streptococcus pneumoniae
MIHFSINKNLFLQALNTTKRAISSKNAIPILSTVKIDVTNEGITLIGSNGQISIENFISQKNEDAGLLITSLGSILLEASFFINVVSSLPDVTLDFKEIEQNQIVLTSGKSEITLKGKDSEQYPRIQEISASTPLILETKLLKKIINETAFAASTQESRPILTGVHFVLSQHKELKTVATDSHRLSQKKLTLEKNSDDFDVVIPSRSLREFSAVFTDDIETVEIFFANNQILFRSENISFYTRLLEGNYPDTDRLIPTDFNTTITFNVVNLRQSMERARLLSSATQNGTVKLEIKDGVVSAHVHSPEVGKVNEEIDTDQVTGEDLTISFNPTYLIDSLKALNSEKVTISFISAVRPFTLVPADTDEDFMQLITPVRTN

SEQ ID NO: 4406 - protein, 64 aa, Streptococcus pneumoniae
MYQVGNFVEMKKSHACTIKSTGKKANRWEITRVGADIKIKCSNCEHVVMMGRYDFERKMNKIID

SEQ ID NO: 4407 - protein, 374 aa, Streptococcus pneumoniae
MRNMALTAGIVGLPNVGKSTLFNAITKAGAEAANYPFATIDPNVGMVEVPDERLQKLTEMITPKKTVPTTFEFTDIAGIVKGASKGEGLGNKFLANIREVDAIVHVVRAFDDENVMREQGREDAFVDPLADIDTINLELILADLESVNKRYARVEKMARTQKDKESVAEFNVLQKIKPVLEDGKSARTIEFTDEEQKVVKGLFLLTTKPVLYVANVDEDVVSEPDSIDYVKQIREFAATENAEVVVISARAEEEISELDDEDKKEFLEAIGLTESGVDKLTRAAYHLLGLGTYFTAGEKEVRAWTFKRGMKAPQAAGIIHSDFEKGFIRAVTMSYEDLVKYGSEKAVKEAGRLREEGKEYIVQDGDIMEFRFNV

SEQ ID NO: 4408 - protein, 189 aa, Streptococcus pneumoniae
MTKLLVGLGNPGDKYFETKHNVGFMLIDQLAKKQNVTFTHDKIFQADLASFFLNGEKIYLVKPTTFMNESGKAVHALLTYYGLDIDDLLIIYDDLDMEVGKIRLRAKGSAGGHNGIKSIIQHIGTQVFNRVKIGIGRPKNGMSVVHHVLSKFDRDEYIGILQSVDKVDDSVNYYLQEKNFEKTMQRYNG

SEQ ID NO: 4409 - protein, 1169 aa, Streptococcus pneumoniae
MVTLLDLFSENDQIKKWHQNLTDKKRQLILGLSTSTKALAIASSLEKEDRIVLLMSTYGEAEGLVSDLISILGEELVYPFLVDDAPMVEFLMSSQEKIISRVEALRFLTDSSKKGILVCNIAASRLILPSPNAFKDSIVKISVGEEYDQHAFIHQLKENGYRKVTQVQTQGEFSLRGDILDIFEISQLEPCRIEFFGDEIDGIRSFEVETQLSKENKTELTIFPASDMLLREKDYQRGQSALEKQISKTLSPILKSYLEEILSSFHQKQSHADSRKFLSLCYDKTWTVFDYIEKDTPIFFDDYQKLMNQYEVFERELAQYFTEELQNSKAFSDMQYFSDIEQIYKKQSPVTFFSNLQKGLGNLKFDKIYQFNQYPMQEFFNQFSFLKEEIERYKKMDYTIILQSSNSMGSKTLEDMLEEYQIKLDSRDKTNICKESVNLIEGNLRHGFHFVDEKILLITEHEIFQKKLKRRFRRQHVSNAERLKDYNELEKGDYVVHHIHGIGQYLGIETIEIKGIHRDYVSVQYQNGDQISIPVEQIHLLSKYISSDGKAPKLNKLNDGHFKKAKQKVKNQVEDIADDLIKLYSERSQLKGFAFSADDDDQDAFDDAFPYVETDDQLRSIEEIKRDMQASQPMDRLLVGDVGFGKTEVAMRAAFKAVNDHKQVVILVPTTVLAQQHYTNFKERFQNFAVNIDVLSRFRSKKEQTATLEKLKNGQVDILIGTHRVLSKDVVFADLGLMIIDEEQRFGVKHKETLKELKKQVDVLTLTATPIPRTLHMSMLGIRDLSVIETPPTNRYPVQTYVLEKNDSVIRDAVLREMERGGQVYYLYNKVDTIVQKVSELQELIPEASIGYVHGRMSEVQLENTLLDFIEGQYDILVTTTIIETGVDIPNANTLFIENADHMGLSTLYQLRGRVGRSNRIAYAYLMYRPEKSISEVSEKRLEAIKGFTELGSGFKIAMRDLSIRGAGNLLGKSQSGFIDSVGFELYSQLLEEAIAKRNGNANANTRTKGNAELILQIDAYLPDTYISDQRHKIEIYKKIRQIDNRVNYEELQEELIDRFGEYPDVVAYLLEIGLVKSYLDKVFVQRVERKDNKITIQFEKVTQRLFLAQDYFKALSVTNLKAGIAENKGLMELVFDVQNKKDYEILEGLLIFGESLLEIKESKEENSI

SEQ ID NO: 4410 - protein, 98 aa, Streptococcus pneumoniae
LPKRISTWSLTFKSVELLAKIPLTLILPLSATSFATVRRLIIRDTFKYLSNLILITSIYYCTIFIYFIEEKYQMEFSSLDSFISNKLSPKISKPSKIS

SEQ ID NO: 4411 - protein, 88 aa, Streptococcus pneumoniae
MRLDKYLKVSRIIKRRTVAKEVADKGRIKVNGILAKSSTDLKVNDQVEIRFGNKLLLVKVLEMKDSTKKEDAAGMYEIISETRVEENV

SEQ ID NO: 4412 - protein, 122 aa, Streptococcus pneumoniae
MSKNIVQLNNSFIQNEYQRRRYLMKERQKRNRFMGGVLILIMLLFILPTFNLAQSYQQLLQRRQQLADLQTQYQTLSDEKDKETAFATKLKDEDYAAKYTRAKYYYSKSREKVYTIPDLLQR

SEQ ID NO: 4413 - protein, 73 aa, Streptococcus pneumoniae
MKIMLLNIHERSTIILSRGKKFIRFLTCFKGDKMENLLDVIEQFLSLSDEKLEELADKNQLLRLQEEKERKNA

SEQ ID NO: 4414 - protein, 445 aa, Streptococcus pneumoniae
MKSWKNWLIKINYCVYKKKRKGRMRKFLIILLLPSFLTISKVVSTEKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 4415 - protein, 425 aa, Streptococcus pneumoniae
MREPDFLNHFLKKGYFKKHAKAVLALSGGLDSMFLFKVLSTYQKELEIELILAHVNHKQRIESDWEEKELRKLAAEAELPIYISNFSGEFSEARARNFRYDFFQEVMKKTGATALVTAHHADDQVETILMRLIRGTRLRYLSGIKEKQVVGEIEIIRPFLHFQKKDFPSIFHFEDTSNQENHYFRNRIRNSYLPELEKENPRFRDAILGIGNEILDYDLAIAELSNNINVEDLQQLFSYSESTQRVLLQTYLNRFPDLNLTKAQFAEVQQILKSKSQYRHPIKNGYELIKEYQQFQICKISPQADEKEDELVLHYQNQVAYQGYLFSFGLPLEGESIQQIPVSRETSIHIRHRKTGDVLIQNGHRKKLRRLFIDLKIPMEKRNSALIIEQFGEIVSILGIATNNLSKKTKNDIMNTVLYIEKIDR

SEQ ID NO: 4416 - protein, 180 aa, Streptococcus pneumoniae
MLENDIKKVLVSHDEITEAAKKLGAQLTKDYAGKNPILVGILKGSIPFMAELVKHIDTHIEMDFMMVSSYHGGTASSGVINIKQDVTQDIKGRHVLFVEDIIDTGQTLKNLRDMFKAREAASVKIATLLDKPEGRVVEIEADYTCFTIPNEFVVGYGLDYKENYRNLPYIGVLKEEVYSN

SEQ ID NO: 4417 - protein, 652 aa, Streptococcus pneumoniae
MKKQNNGLIKNPFLWLLFIFFLVTGFQYFYSGNNSGGSQQINYTELVQEITDGNVKELTYQPNGSVIEVSGVYKNPKTSKEGTGIQFFTPSVTKVEKFTSTILPADTTVSELQKLATDHKAEVTVKHESSSGIWINLLVSIVPFGILFFFLFSMMGNMGGGNGRNPMSFGRSKAKAANKEDIKVRFSDVAGAEEEKQELVEVVEFLKDPKRFTKLGARIPAGVLLEGPPGTGKTLLAKAVAGEAGVPFFSISGSDFVEMFVGVGASRVRSLFEDAKKAAPAIIFIDEIDAVGRQRGVGLGGGNDEREQTLNQLLIEMDGFEGNEGIIVIAATNRSDVLDPALLRPGRFDRKVLVGRPDVKGREAILKVHAKNKPLAEDVDLKLVAQQTPGFVGADLENVLNEAALVAARRNKSIIDASDIDEAEDRVIAGPSKKDKTVSQKERELVAYHEAGHTIVGLVLSNARVVHKVTIVPRGRAGGYMIALPKEDQMLLSKEDMKEQLAGLMGGRVAEEIIFNVQTTGASNDFEQATQMARAMVTEYGMSEKLGPVQYEGNHAMLGAQSPQKSISEQTAYEIDEEVRSLLNEARNKAAEIIQSNRETHKLIAEALLKYETLDSTQIKALYETGKMPEAVEEESHALSYDEVKSKMNDEK

SEQ ID NO: 4418 - protein, 207 aa, Streptococcus pneumoniae
RPTASISSIKMIAGAAFLASSKRERTRLAPTPTNISTKSEPEILKNGTPASPATALASKVLPVPGGPSKRTPAGIRAPSFVNRFGSFKNSTTSTSSCFSSSAPATSENLTLISSLFAALALLRPKLIGLRPLPPPIFPIIENRKKNRIPNGTMDTSRLIHIPLELSCLTVTSALWSVASFCNSDTVVSAGRIVLVNFSTLVTDGVKN

SEQ ID NO: 4419 - protein, 35 aa, Streptococcus pneumoniae
MTIIPSFPSKPSISIKSWFKVCSRSSLPPPRPTPR

SEQ ID NO: 4420 - protein, 159 aa, Streptococcus pneumoniae
MIKELYEEVQGTVYKCRNEYYLHLWELSDWDQEGMLCLHELISREEGLADDIPRLRKYFKTKFRNRILDYIRKQESQKRRYDKEPYEEVGEISHRISEGGLWLDDYYLFHETLRDYRNKQSKEKQEELERVLSNERFRGRQRVLRDLRIVFKEFTIRTH

SEQ ID NO: 4421 - protein, 81 aa, Streptococcus pneumoniae; identical to SEQ ID NO: 3696

SEQ ID NO: 4422 - protein, 49 aa, Streptococcus pneumoniae; identical to SEQ ID NO: 3697

SEQ ID NO: 4423 - protein, 61 aa, Streptococcus pneumoniae; identical to SEQ ID NO: 3698

SEQ ID NO: 4424 - protein, 86 aa, Streptococcus pneumoniae; identical to SEQ ID NO: 3699

SEQ ID NO: 4425 - protein, 135 aa, Streptococcus pneumoniae
FIGIRSLSEIGNPGWTPHPNSALPPRISNVDASPKAISERTSYLQVRLEFLRYPQVIQALFNVPWFGPPVRLTAPSTCSWVGHMVSGLRHDTKAPYSDSVSLRLRLFNLTSHHNVTRRFILQKARSHPLTGSNLL

SEQ ID NO: 4426 - protein, 51 aa, Streptococcus pneumoniae
MRSSTPHGIPSSHIERSPTIPIKVSTASVNCFSPGTFSAQGHSTSELLRTL

SEQ ID NO: 4427 - protein, 51 aa, Streptococcus pneumoniae; identical to SEQ ID NO: 2933

SEQ ID NO: 4428 - protein, 81 aa, Streptococcus pneumoniae; identical to SEQ ID NO: 2934

SEQ ID NO: 4429 - protein, 77 aa, Streptococcus pneumoniae; identical to SEQ ID NO: 2935

SEQ ID NO: 4430 - protein, 68 aa, Streptococcus pneumoniae
MDNARFHRMGKLELLCEEFGHKLLPLLPYSPEYNPIEKTWAHIKKNLKKVLPRCHTFYEALLSCSCFN

SEQ ID NO: 4431 - protein, 81 aa, Streptococcus pneumoniae
NTTIISISSCFSTLFKTFLKDKEKIVNALQLPYSNAKLEATNNLIKLIKHNAFGFRNFENFKKERTKFVLSRSSLSSTHYS

SEQ ID NO: 4432 - protein, 47 aa, Streptococcus pneumoniae
MSFIAQDFDKLNIITVLESRTQAIIRNPMNTRLSSDTESSFNKIVRN

SEQ ID NO: 4433 - protein, 90 aa, Streptococcus pneumoniae
YKKIQTRILLRKGRFKCYHCSKMEVAETSIVKKNHQIPCIINQKIDQKLIEKTSMTDIDHQLSISTSTVIRKINDFHFEHDFSRLPEIMS

SEQ ID NO: 4434 - protein, 80 aa, Streptococcus pneumoniae
LIMLQKIYEQMTNFYDSIEEEYGPTFGDNFDWEHVHFKFLIYYLVRYGIGCRKDFIVYHYRVAYRLYLEKLVMNRGFISC

SEQ ID NO: 4435 - protein, 442 aa, Streptococcus pneumoniae
MYVRKEEPEGSDKIMTSVVVVGTQWGDEGKGKITDFLSANAEVIARYQGGDNAGHTIVIDGKKFKLHLIPSGIFFPEKISVIGNGMVVNPKSLVKELSYLHEEGVTTDNLRISDRAHVILPYHIELDRLQEEAKGDNKIGTTIKGIGPAYMDKAARVGIRIADLLDKDIFRERLERNLAEKNRLFEKLYDSKAIVFDDIFEEYYEYGQQIKKYVIDTSVILNDALDNGKRVLFEGAQGVMLDIDQGTYPFVTSSNPVAGGVTIGSGVGPSKIDKVVGVCKAYTSRVGDGPFPTELFDEVGERIREVGHEYGTTTGRPRRVGWFDSVVMRHSRRVSGITNLSLNSIDVLSGLDTVKICVAYDLDGQRIDYYPASLEQLKRCKPIYEELPGWSEDITGVRNLEDLPENARNYVRRVSELVGVRISTFSVGPGREQTNILESVWS

SEQ ID NO: 4436 - protein, 140 aa, Streptococcus pneumoniae
LREAEIALEHDEIPIGCVIVKDGEIIGRGHNAREELQRAVMHAEIMAIEDANLSEESWRLLDCTLFVTIEPCVMCSGAIGLARIPNVVYGAKNQKFGGAGSLYNILTDERLNHRVEVEIGILEDECAAIMQDFFRNRRKK

SEQ ID NO: 4437 - protein, 147 aa, Streptococcus pneumoniae
MKIRGFELVSSFTDENLLPKRETAHAAGYDLKVAVRTVVAPGEIVLVPTGVKAYMQPTEVLYLYDRSSNPRKKGLVLINSVGVIDGDYYGNPGNEGHIFAQMKNITDQEVVLEVGERIVQAVFATFLIADGDAADGVRTGGFGSTGH

SEQ ID NO: 4438 - protein, 185 aa, Streptococcus pneumoniae
MAFELVDLDRQGTRMKIIFVRHGEPDYRELEERSYIGFGIDLAPLSEMGRQQVQKLSKNPLLSSAEIIVSSAVTRALETASYVVCATGFPLRVEPLLHEWQVYKTGIENFETARRLFLENKGELLPNSPIQYETATEMKSRFLECMSKYREHQTVVVVAHRMLMRQFVPNEKIDFCQVIECELEI

SEQ ID NO: 4439 - protein, 67 aa, Streptococcus pneumoniae
TCHSCNKGSTLKGKPVAQTTYEAVSKALVTAEDTIISADESKGFLLNFWTCCRPISDKGAKSIPNPI

SEQ ID NO: 4440 - protein, 454 aa, Streptococcus pneumoniae
VIAKKKATFVCQNCGYNSPKYLGRCPNCGSWSSFVEEVEVAEVKNARVSLTGEKTKPMKLAEVTSINVNRTKTEMEEFNRVLGGGVVPGSLVLIGGDPGIGKSTLLLQVSTQLSQVGTVLYVSGEESAQQIKLRAERLGDIDSEFYLYAETNMQSVRAEVERIQPDFLIIDSIQTIMSPEISGVQGSVSQVREVTAELMQLAKTNNIAIFIVGHVTKEGTLAGPRMLEHMVDTVLYFEGERHHTFRILRAVKNRFGSTNEIGIFEMQSGGLVEVLNPSQVFLEERLDGATGSSIVVTMEGTRPILAEVQALVTPTMFGNAKRTTTGLDFNRASLIMAVLEKRAGLLLQNQDAYLKSAGGVKLDEPAIDLAVAVAIASSYKDKPTNPQECFVGELGLTGEIRRVNRIEQRINEAAKLGFTKIYVPQNSLTGITLPKEIQVIGVTTIQEVLKKVFA

SEQ ID NO: 4441 - protein, 206 aa, Streptococcus pneumoniae
LHKLFKIRHDSLLENLIVKYFSYLIIFKRICHGLCKDLFQDFLNRCHANDLNFLRQSDSCQGILRYINLSKAQFSSFVDALLNTIHAPNLSCQAQFSDKTFLRISWLVFVARSNSNCNSQVNGRFIQFNTTSRFEIGILILQEKPCPFFQNSHNQASTVKIKSCRSTLGISKHGRCYQSLNLRQNRTRPFHGYNDGGTSRPIQTLF

SEQ ID NO: 4442 - protein, 165 aa, Streptococcus pneumoniae
VSYFEQFMQANQAYVALHGQLNLPLKPKTRVAIVTCMDSRLHVAQALGLALGDAHILRNAGGRVTEDMIRSLVISQQQMGTREIVVLHHTDCGAQTFENEPFQEYLKEELGVDVSDQDFLPFQDIEESVREDMQLLIESPLIPDDVIISGAIYNVDTGSMTVVEL

SEQ ID NO: 4443 - protein, 263 aa, Streptococcus pneumoniae
VYEEKQYFIFILLLCIGLQYETIYYTDGSRSGAEYGLMGVSIFLALFYMIPALYFLFRIGKKWELPKKVLILSLLGGMFLAGWLSSFANTYIHDLLGVLFPDSPFLNAFESAIVAPLVEEPLKLLPLVFVLALIPVRKLKFLFLLGIASGLGFQMIEDIGYIRTDLPEGFDFTISRILERIISGIASHWTFSGLAVVGVYLLYRAYKGQKVGKKQGLIFLGLALGTHFLFNSPFCGVGNRVAFSDSSGYGYCSLWFLSCLLLC

SEQ ID NO: 4444 - protein, 322 aa, Streptococcus pneumoniae
MSFSDLKLFALSSNKELAERVAQEIGIELGKSSVRQFSDGEIQVNIEESIRGKHVFILQSTSSPVNDNLLEILIMVDALKRASAESVNVVMPYYGYARQDRKARAREPITSKLVANMLEVAGVDRLLTIDLHAAQIQGFFDIPVDHLMGAPLIADYFERRGMVGSDYVVVSPDHGGVTRARKLAEFLKTSIAIIDKRRSVDKMNTSEVMNIIGKVEGKTCILIDDMIDTAGTICHAADALAEAGAVEVYASCTHPVLSGPATDNIQKSAIKKLVVLDTIYLPEERLIDKIEQISIAHLLGDAIVRIHEKRPLSPLFDIEKKI

SEQ ID NO: 4445 - protein, 159 aa, Streptococcus pneumoniae
MEQLHFITKLLDIKDPNVQILNIINKDTHKEIIAKLDYDAPSCPECGNQLKKYDFQKPSKIPYLETTGIPTRILLRKRRFKCYHCSKMMVAETSDDVQSYFFSFYYITVLNLALLDSPLLSIYSEKRRKNLRIISGLVIKFFSQYRKVEKVVVFHEYVR

SEQ ID NO: 4446 - protein, 112 aa, Streptococcus pneumoniae
LEFFGNKPFTQQPQRAISQANQLLDYKSWSEEDRKMFSQLHMREEQVLLAQDYALETARAEDLEQGLERGKVEGRAERKLFAFLDIVRQGLLTSEVASQQLGMSVSEFEALL

SEQ ID NO: 4447 - protein, 121 aa, Streptococcus pneumoniae
IYKHIAPVYVIAIVDSNYFSDDLAFHSFSMREDTTGEVLAITNNGQENHLVKMAFLELKNTEKPAKTRFASHGWSFSATSPLPSNRNEPLAKQINCWTTRAGPRRTGKCLVNYICEKNKSC

SEQ ID NO: 4448 - protein, 130 aa, Streptococcus pneumoniae
VFVDLVSITFSLMNFFKILINLTAQVSPQVIDEKILMMDLNLNNYLSTVIQLRQDVYTGIKILHRVGHGRQDMNVTSLQNSHIFGWQVQHIADKLTSDFWVAENFLSNQVIGRANSQMSENHPFPPSIVN

SEQ ID NO: 4449 - protein, 117 aa, Streptococcus pneumoniae
MILRHLGISPTNDLVAKKIFSNPEITCQFIRDMLDLPAKNVTILEGSNIHVLPSMPYSVQDFYTSIDVLAELDNGTQVIIEIQVHHQNFFINHLWAYLCSQVNQNLEKIHQREGDTH

SEQ ID NO: 4450 - protein, 889 aa, Streptococcus pneumoniae
MVFFDSFLYNGCMDKKKLLLIDGSSVAFRAFFALYQQLDRFKNAAGLHTNAIYGFQLMLSHLLERVEPSHILVAFDAGKTTFRTEMYADYKGGRAKTPDEFREQFPFIRELLDHMGIRHYELAQYEADDIIGTLDKLAEQDGFDITIVSGDKDLIQLTDEHTVVEISKKGVAEFEAFTPDYLMEEMGLTPAQFIDLKALMGDKSDNIPGVTKVGEKTGIKLLLEHGSLEGIYENIDGMKTSKMKENLINDKEQAFLSKTLATIDTKAPIAIGLEDLVYSGPDVENLGKFYDEMGFKQLKQALNVSSADVAKGLDFTIVDQISQDMLSEESIFHFELFGENYHTDNLVGFAWSCGDKLYATDKLELLQDPIFKDFLEKTSLRVYDFKKVKVLLQRFGVDLQAPAFDIRLAKYLLSTVEDNEIATIASLYGQTYLVDDETFYGKGVKKAIPEREKFLEHLACKLAVLVETEPILLEKLSENGQLELLYDMEQPLAFVLAKMEIAGIVVKKETLLEMQAENELVIEKLTQEIYELAGEEFNVNSPKQLGVLLFEKLGLPLEYTKKTKTGYSTAVDVLERLAPIAPIVKKILDYRQIAKIQSTYVIGLQDWILADGKIHTRYMQDLTQTGRLSSVDPNLQNIPARLEQGRLIRKAFVPEWEDSVLLSSDYSQIELRVLAHISKDEHLIKAFQEGADIHTSTAMRVFGIERPDNVTANDRRNAKAVNFGVVYGISDFGLSNNLGISRKEAKAYIDTYFERFPGIKNYMDEVVREARDKSYVETLFKRRRELPDINSRNFNIRGFAERTAINSPIQGSAADILKIAMIQLDKALVAGGYQTKMLLQVHDEIVLEVPKSELVEMKKLVKQTMEEAIQLSVPLIADENEGATWYEAK

SEQ ID NO: 4451 - protein, 123 aa, Streptococcus pneumoniae
LLWWVCLTVKKTTSNRVTKEMQARGYKIIPVNPKTAGGEILGEKAYASLAEIPFPVDIVNVYRRSEFLPDVARDFLKADAKIFWAQLGLESLEAKEILRDGGCDDIVMNRCIKREHTRLIEEA

SEQ ID NO: 4452 - protein, 136 aa, Streptococcus pneumoniae; identical to SEQ ID NO: 4068

SEQ ID NO: 4453 - protein, 104 aa, Streptococcus pneumoniae
LRKHKKKVADGLPFVLYSMKIKEQTRKLAAGCSKHCFEVADRTDEVSSKHRFEVVDRTDEVSSKHRFEVVDRTDEVSSKHCFEVADRTDEAYPPHLRQSESEVV

SEQ ID NO: 4454 - protein, 238 aa, Streptococcus pneumoniae
MKVFQHVNIVTCDQDFHVYLDGILAVKDSQIVYVGQDKPAFLEQAEQIIDYQGAWIMPGLVNCHTHSAMTGLRGIRDDSNLHEWLNDYIWPAESEFTPDMTTNAVKEALTEMLQSGTTTFNDMYNPNGVDIQQIYQVVKTSKMRCYFSPTLFSSETETTAETISRTRSIIDEILKYKNPNFKVMVAPHSPYSCSRDLLEASLEMAKELNIPLHVHVAETKEESGIILKRYCKRPPCFS

SEQ ID NO: 4455 - protein, 170 aa, Streptococcus pneumoniae
LLTGSNLNEREIERLASSQVAIAHNHISNLKLASGIAPIIQLQKAGVAVGIATDSVASNNNLDMFEEERIAVLLQKIKSGNASQFPIETALKVLTIEGAKVFGMKNQIESLKVGKQADFLVIQPQGKIHLQPQENMLSHLVYAVKSSDVDDVYIAGEQVVKQGQVLTVEL

SEQ ID NO: 4456 - protein, 125 aa, Streptococcus pneumoniae
MQDFCKLFLKFFVIFLLKFYCQDLTLLNNLFSGDINIIYITRFNCINQVRQHIFLRLEMNFPLWLNDQKICLLADFQTFYLIFHSKDLSPFDCQYLESCFDWKLAGIPTFYLLKKNCNPFFLKHI

SEQ ID NO: 4457 - protein, 166 aa, Streptococcus pneumoniae
MSEAIIAKKAELVDVVAEKMKAAASIVVVDARGLTVEQDTVLRRELRGSEVEYKVIKNSILRRAAEKAGLEDLASVFVGPSAVAFSNEDVIAPAKILNDFSKNAEALEIKGGAIEGAVASKEEILALATLPNREGLLSMLLSVLQAPVRNVALAVKAVAESKEDAA

SEQ ID NO: 4458 - protein, 122 aa, Streptococcus pneumoniae
MALNIENIIAEIKEASILELNDLVKAIEEEFGVTAAAPVAVAAADAADAGAAKDSFDVELTSAGDKKVGVIKVVREITGLGLKEAKELVDGAPALVKEGVATAEAEEIKAKLEEAGASVTLK

SEQ ID NO: 4459 - protein, 114 aa, Streptococcus pneumoniae
LISSASAVATPSLTSAGAPSTSSLASLRPRPVISRTTLITPTFLSPADVNSTSNESLAAPASAASAAATATGAAAVTPNSSSIAFTRSFNSRIEASLISAIMFSMFNAIVISSK

SEQ ID NO: 4460 - protein, 195 aa, Streptococcus pneumoniae
MKRIIPVYIFQQVNVLLVSLYLLKFLCIGELTILQILYGSSLISFLWMYGQRKQAHKVNMKSRMKWLGIGFVSLLIISLCFSLIHAQESTNQANLIGLQHQVPWFSFLLFLINASMVEEFLYREILWNLVRKLDIRVALTSVLFALAHHPGTIIAWCLYVSLGMFLGLVRYKLDLWGSMGLHLVWSLLVYSLLLF

SEQ ID NO: 4461 - protein, 504 aa, Streptococcus pneumoniae
MDYNFNLEHPFFFTNNDYSTDTSIKYQVSLPFNWHEVMNNDEWVYQYPIGKFVERQGWKIHISSEYNSSHELLQDVAKICHEMRIPFKHLSTEDKFIMRNGKLVSRGFSGKFITCYPNQNELESVLQRLESALKQYNGPYILSDKRWDEAPIYLRYGVFRPSRDDEKKVAIDELIVGDEVVKDERLPVFKIPKGIVPPDFLNKWLDKKDKKQGDFPFIIDNAIRFSNSGGIYNARLKEDGKKIILKEARPYTGLGFDGTYSSEKLASECKALKILNEWSETPKIYWHGKIWEHTFLGIEHMKGVPLNRWVTNNFPLYEVVDKTKDYLLRVSKIVEKLIDLTNKFHSENVYHQDLHLGNILVKDEDEISIIDWEQAVFSNDEKVVHKVAAPGFRAWRETLPSEIDWYGIRQIAHYLYMPLVTTSDLTYNYVSQTRIEGKKLFESLGYTREHIDYVESLLSYLDSKCPQIENISRKKVLKPMHEIRTIESEQDIQDFIIKAFLLVN

SEQ ID NO: 4462 - protein, 197 aa, Streptococcus pneumoniae
VIHMKDVVYSITPENKLSIDFSFKSPFRVLLTGTSGSGKTTILNLINGSLKPQKGYVNLLSHGKKSSDSIPTVDQTPYIFDTTIRENVTLFQNEYFSDDQIIEVLKKVNLYEELEKIDILNYQCGENGSNLSGGQKQKIALARALIRNNKVYLFDEISANLDNDNSNSIHDILFNLGISFIEVSHHYDLNDKRYTDI

SEQ ID NO: 4463 - protein, 96 aa, Streptococcus pneumoniae
PFCGFKEPLIKFKIVVFPLPEVPVNNTLNGDLNEKSILNLFSGVIEYTTSFMCITSIDEVYSPLLSCSASIKFFSPLKYFKNGFLKSLVVFILFNE

SEQ ID NO: 4464 - protein, 246 aa, Streptococcus pneumoniae
MDKDYILKVKGLYHQFLLGNNKTLQVLKNVSLSASRGEFISILGISGSGKSTLLKCISSLLEPTSGEVILNGINPYKIRNAKLSSIRRNEVSFIFQAYNLIPSLPVIENIALPLRLSQKKLTIKNVENLLKRMKFNAGLNDFVGTLSGGEQQKVAIARAVIADSDIIFADEPTGALDSVSREVIFELLRELVGAGKCVIMVTHDIELASKTDRALILKDGKIFKELHRPSGEELYKILEVQSTTEE

SEQ ID NO: 4465 - protein, 60 aa, Streptococcus pneumoniae
GLIPFKITSPLVGSSKLEIHFNKVDFPEPLIPRILINSPLEAERETFFSTCNVLLFPSKN

SEQ ID NO: 4466 - protein, 128 aa, Streptococcus pneumoniae
LKIFPSFNINARSVFEANSISCVTIITHLPAPTNSLNNSKITSRETLSKAPVGSSANIISLSAITALAIATFCCSPPDRVPTKSFKPALNFILLSKFSTFLIVNFFCDNRKGSAIFSITGREGIKLYA

SEQ ID NO: 4467 - protein, 439 aa, Streptococcus pneumoniae
MLRLVYYQFLHNKKQWLGVSPVIFVSSLVMGLAVNGVINVENNSQVFVGLPDPKPIFMFPIVFGGVTLFFVLSNIINMLVEIFRDDYELLEVLGASRLQLSFLVGGQIFIISSIISFIAYLCSIFVTSNYYYFLQYFFGENILPDIQFQMSAVGCIITVVLISFLAFLSGCFYTFKKIRNRKSSKIRHVLSIVKRILLLAGFSVIWLLSLQQIFQDSTILAKAQIIFNIVILDIVIIYQLSPFIQSCFIKLLSIIIFRNNFMFIVSKWNLLYRKPYIKSISAAITGAILLISSFQMISQNILSQFQDDSDLELKVAFIVYVGAPILIVLANIISIAFLSSHQERIEIQQFEILGTSNYQMVKIKVGEAIFLTFVTSLIAFLLNIKIMVLIYYSLEDILIDDMNLLGLILPNFIVSIILFILIFITKSSYFIFKNAKIIS

SEQ ID NO: 4468 - protein, 59 aa, Streptococcus pneumoniae
VSGIKVSFSLFSTNLTGQDLYTGGVFGAERSILILCVVFILTVVLLQRACREELAHKGD

SEQ ID NO: 4469 - protein, 73 aa, Streptococcus pneumoniae
MKVVNLYDLKQMGNKGGCTIQLIHHFPFGMGLGHLKKDYIEFKRVGIFDGKAVEVTLREPYSRDLLQVVKSIK

SEQ ID NO: 4470 - protein, 45 aa, Streptococcus pneumoniae
MIIFYSLWTMLMDNAIWHKSSALKIPTNIGFAFIPPYTPEMNPIE

SEQ ID NO: 4471 - protein, 87 aa, Streptococcus pneumoniae
LADSGYQGLMKIYLQAQTPRKSSKLKPLTAEDKAYNHALSKGRSKVENIFAKVKTFKMFSTTYRNHRKRFGLRMNLIADIINHELGF

SEQ ID NO: 4472 - protein, 232 aa, Streptococcus pneumoniae
MSQISKEALIEQIKDGIIVSCQALPHEPLYTEAGGVIPLLVKAAEQGGAVGIRANSVRDIKEIKEVTKLPIIGIIKRDYPPQEPFITATMKEVDELAELDIEVIALDCTKRERYDGLEIQEFIRQVKEKYPNQLLMADTSIFEEGLAAVEAGIDFVGTTLSGYTSYSPKVDGPDFELIKKLCDAGVDVIAEGKIHTPEQAKQILEYGVRGIVVGGAITRPKEITERFVAGLK

SEQ ID NO: 4473 - protein, 307 aa, Streptococcus pneumoniae
MKIDVINHLDSPGLAGMICRRINNRILVYGGSYFPNNDPLKSSKVQSNKIRVYDEKFNLLYEQDGKISPDKGITIEVENEIYYILGSSIYRITIGESVEETCIGNFDFQLESGYGCYFDGHLFFGFQESYLFNIETQELFKKSDFPVSGRGQGLSVKYQNELYYLGGANNEAYLDGYKYSLKKDKWEKLEFELPSSVLGASSIQINESGLLILGGFNEIVYNKAVIDLATPGYREEYFSKGRDFFNWNRSMRILDLETGKVKIIANDERFALCGAGFLKTDNGYYVVSGECSPGRRTSDILLLEEEM

SEQ ID NO: 4474 - protein, 542 aa, Streptococcus pneumoniae
MKKIVKLALTAAAVLIAVVGLVACSSGSKKSDFSESGKEKVFYLSGLLQGTGDRIPYVWQNGDGLVPYLLYRTLLMADSKYEKSTPDLAKDWKKSDDEKTYEFTLKDGLKWSDGEALTASDVEFSVKLALKASVINGIFPSTFTKIEGAKDFKDDKADKISGLTVDGNKVTFKLTAPVGDFEQMMTQFFILPKHKLESENPLELNNSSFWTAPVTSGMYKVKEISAGNFLEYDKNENYENEKPKFDKVVFNYISDPVLALQDGKSYFYSTNKPQEISQLDAVSTLTKKPIDILFYRYFIANLAGVEGNGDSLIANPKVREAILYAINRDELAKSVFSGIADVNNTGVPSSLEAHLKSANKFEYNPEKAKQLLKEAKYDNSRNLILAYYYKDQASQDFMQAVSYQLNEVGIKNEVVQITSDATTGLFKTRKYDLAYKGLSSFGYETWYGEYSSTNTNFKNITNGETSFDELSKKLSETSDVKERNKILASLQKLEQEKLLKLNLFTFKNFLYLNTEKVLIPDDVQFGNPFYKFDYKFEKWDAK

SEQ ID NO: 4475 - protein, 316 aa, Streptococcus pneumoniae
MKKYILKKVLFMIPMLLIISFLVFIALDLTPADPLTYMVSPDMASSAEQIEKLRQQLGLNDPVLVRYGRWLWQLLHGDFGYSIVNGNPISKIVGQALPATFELAFVSLIISTIVGIVIGVISAVKQNGIIDNVARFLAVIGTAIPQFFFGILILNFFAIQLRILPIGGRFASGDFTFINRVEHLILPVMAMSIALVAALMRYTRNSMLDVFNADYVKTARAKGVPEWKVYFKHIFRNAMRPILVLLIFRLPMLIGGSVIIESVFSWPGIGSIILSSVTAGDYPVIMITTLMISVVVLFASLLVDIMAAILDPRIRY

SEQ ID NO: 4476 - protein, 295 aa, Streptococcus pneumoniae
THVFVIRKEVNVMKPMPLWKRNLKKFYNNKLAFIGFICFMLILLACILAPLLTTYSPDVVDLGSMNRPPSAKHILGTDKLGRDVFARILYGGRVSIQVGMYGAICGAVIGTVLGGIAGYFGGKIDALLVRLAELFLTFPNMIVILLLSSIFGQGVFNLIFVFSVMGWMTTFRMVRNEFMSLKQETYVDVCRAFGFSDSRIIFNNILRNAISPVIVSLSLNVAGFILSEAGLSFLGVGVPSDIPTWGNIINAAKTADVIKNSWWLWLVPGSIITLFVLSINFIGDGLRDIMDPKQQ

SEQ ID NO: 4477 - protein, 203 aa, Streptococcus pneumoniae
LSTSYCCFGSIISRNPSPIKLIERTKRVMIDPGTNHNHQLFLITSAVLAAFMIFPQVGISEGTPTPKKLRPASLRMKPATFKDNDTITGEIAFLKILLKIIRLSEKPKALHTSTYVSCFKDMNSLRTIRNVVIQPITENTKIRLNTPCPKILESKRMTIIFGNVKNNSARRTRRASIFPPKYPAIPPSTVPITAPQIAPYIPT

SEQ ID NO: 4478 - protein, 660 aa, Streptococcus pneumoniae
MNQTVLDVKNLKTEFITDKKAFPIIKDVNFTLERGKVLGIVGESGCGKSVTVNTVLNLLPKNGRIAEGEITYFDEDKPIELQKLKQYGKEFRKLRGENISMIFQDPMSALNPVYTIGNQITEVLHEHYDISKEEANKRAIEMLEKLGIHNAAERMNDYPHQFSGGQRQRIVIAIAMVCNPDILIADEPTTALDVTIQAQILDLLDDLRKEHGTSIILITHDLGVIAQIADEVAVMYAGEVVEVGTVAQIFDQPKHPYTRSLLRSIPNPENMDKKLHVIQGSVPSISEISEKGCRFANRIPWLEKEHHEEEPQLHDLGDGHFVRCSCYKHFFFEDKEEETLAEKHVGNVVLEVKNIKKYYYPKKQLFKPLGSPLKALDDVSLELRKGTTIGIVGESGSGKSTIAKSLMKLHDITDGEINIDLNGKTQNIYGIKRKEDLDFRKKVQMVFQDPYASLNPTKKIYNSFDEPMIVHNIGNKEERFERMKEALKMVNVPVEYLERYPHEFSGGQRQRLCIARALCMKPEILILDEPVSALDLSVQAQVLNYLVEIQNKEDLTYVFISHDLGVVKYMCDYLYVIHKGRIVEAGSREDIYNNPMHIYTKKLLAAIPEVDYHFKEALATKRKENEVEFKAQYHEFYDEDGRAYDLKQVSPTHFVALKPE

SEQ ID NO: 4479 - protein, 65 aa, Streptococcus pneumoniae
VFPFKSILISPSVISWSFINDFAIVLLPLPDSPTIPIVVPFLNSRDTSSSAFNGEPSGLNSCFLG

SEQ ID NO: 4480 - protein, 469 aa, Streptococcus pneumoniae
MKLNKKIYFFDKGIFNPYRMSNVKLKVNQAVKDKEIFFTEEKPWEIRFDNSYPNVFFDDLAGVYRCYYSTFTDDEESEKYSLEERKERQYLPRAKRIVSLCYAESKDGVNWVKPNLGITEFRGSTENNIIGHFLHGTSVFLDKHDADENRRYKMFTKIDYGNGVHFIAVAFSKDGLHFDEYIKVPNFNPRADTHNHIIYDEALNRYVLITRTWRDSLRLPCVSTSADFINWTPIQEILNVCDYENQIYSMPIFKRGDYILGLASVFHEGDQLNKNYDTVDLQLTYSYRHVGWHYLNTDTPLIPRGKGQYGDGEFDCGCIYSSAPVTIGDRTYFYYMGGNGQHTNFRETSLSRAYIEKDHFAYWDTKRPEYPGVLYTNGFIFLNDQVYLDADIAAGGFVTIELFENNHTPMEITASLEKIEDGRYQVLFSEPLPRTQTRLKISFKNAKIYAIEGNLDIFRIESDNALLRG

SEQ ID NO: 4481 - protein, 162 aa, Streptococcus pneumoniae
MKYDLYDNCIELLKEREVTIEDMAALVIFSQQKYYPELTLDDASYAIQRVLKKREVQNVIMTGIELDKLAEAQKLSPEFQKIMEKDNPLYGIDEVIVLSILNLYGSIAFTNYGYLDKLKPLILERLNENHEGVCNVFLDDIVGAIAAAACSKIAHNHASDEI

SEQ ID NO: 4482 - protein, 135 aa, Streptococcus pneumoniae
MTVINKFVLMEQAKKVLKNAYCPYSKFPVGAAILFKDGKVITGANIENVSFGVTNCAERSAIFYGASQGYRKGDILAIAVAGETEDYLPPCNICRQVMVEFCEPDTLVFLLNGKGNILELRLEELVPYSFSSLEM

SEQ ID NO: 4483 - protein, 94 aa, Streptococcus pneumoniae
MASKFHTIFSIIASNMGNNGQFTFGYRHDFFQNQLAIFNALVDTFTRRTIDIKTLNTFINEVLNLGTRTLWTYFSLLIITCVEGWNDTFVFFQI

SEQ ID NO: 4484 - protein, 273 aa, Streptococcus pneumoniae
VQYFIDKGVQGLYVNGSSGECIYQSVEDRKLILEEVMAVAKGKLTIIAHVACNNTKDSMELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGGRLMGARAGIGGTYGAMPELFLKLNQLIADKDLETARELQYAINAIIGKLTSVHGNMYGVIKEVLKINEGLTIGSVRSPLTPVTEEDRPVVEEAAALIRETKERFL

SEQ ID NO: 4485 - protein, 67 aa, Streptococcus pneumoniae
MTHYVANPEVVILEGGIMGQEAILKPKIRAALKEVLVPSLAENTRLEFAHHQNTAGMLGAYYHFKIK

SEQ ID NO: 4486 - protein, 172 aa, Streptococcus pneumoniae
MHIHYNTNQTTLPLEINSFLPQDHLVFTIEKVVNTDEKEVNHLIKYAMFDKEQKRGYKQSARNLANWHYNDKEDSYTHPDGWYYRFHHTKYQKTQTDFQQEIKVYYADEPESAPQKGLYMNERYQNLKAKECQALLSPQGRQIFAQRKIDVEPVFGQIKASLGYKRCNLRGK

SEQ ID NO: 4487 - protein, 213 aa, Streptococcus pneumoniae
LTIEPGQRIALVGQSGSGKSTLSKIPSGLYKIDTGKVLFDGVNINQIDKKILSQNLGVVPQDSFLLNRSILDNITLKHEVTSQKIEEVCKAVQIYDEIMAMPMKFNTIISEMGSNISGGQRQRIALARALINNPSIVILDEATSALDTINEKRITKYIQSQGCTQIIIAHRLSTIKDADIIFVMKGGKIVESGNHKYLMTLGGEYYSLYTKRK

SEQ ID NO: 4488 - protein, 62 aa, Streptococcus pneumoniae
TISEPNTIPFNKPKEIPYSTGKSKKIANTIPIITPSEAIVKITYSFSFFIFFTPHFLFVYKL

SEQ ID NO: 4489 - protein, 448 aa, Streptococcus pneumoniae
MTSAKEYIQSVFETVKARNGHEAEFLQAVEEFFNTLEPVFEKHPEYIEENILARITEPERVVSFRVPWVDRDGKIQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGTVWTYAGNYDIALPCATQNEINGEAAKRLVAQGVICVSEGANMPSDLDAIKVYKENGILYGPAKAANAGGVAVSALEMSQNSLRLSWTREEVDDRLKDIMTNIFNTAKTTSETYGLDKDYLAGANIAAFENVANAMIAQGIV

SEQ ID NO: 4490 - protein, 137 aa, Streptococcus pneumoniae; identical to SEQ ID NO: 3410

SEQ ID NO: 4491 - protein, 56 aa, Streptococcus pneumoniae
MDNAIWHKSSTLNIPTNIDFTFIPPYTPEMNPLNKCGKRFVNVDLRIKPFELWKIS

SEQ ID NO: 4492 - protein, 217 aa, Streptococcus pneumoniae; identical to SEQ ID NO: 2811

SEQ ID NO: 4493 - protein, 72 aa, Streptococcus pneumoniae
MSISPRFETLEQAIASKDLEKVREAFKKMNSTWTINESVVRDNSTAHYGRVETAISFLPSSMETEPTDESGT

SEQ ID NO: 4494 - protein, 94 aa, Streptococcus pneumoniae
MARKETMAERKYCKMKKDIHPEYRPVVFMDTTTGYQFLSGSTKRSNETVEFEGETYPLIRVEISSDSHPFYTGRQKFTQADGRVDRFNKKYGLK

SEQ ID NO: 4495 - protein, 311 aa, Streptococcus pneumoniae
MEICQQILEKIKEYDTIIIHRHMKPDPDALVSQVGLKALLEHHFPEKTIKAVGFDEPTLTWMAEMDLVEDRAYQGALVIVCDTANTARIDDKRYSQGDFLIKIDHHPNDDVYGDLSWVDTSSSSASEMITLFAQTTQLALADRDAELLFAGIVGDTGRFLYPSTTARTLRLAAYLREHNFDFAALTRKMDTMSYKIAKLQGYIYNHLEVDENGAARVILSQKILKQYNVTDAETATIVGAPGRIDRVSLWGIFVHRADGHYRVRLRSKVHPINEIAKEHDGGGHPLASGANSYSLKENEIIYQKLKNLLKN

SEQ ID NO: 4496 - protein, 144 aa, Streptococcus pneumoniae
MALAKIVFASMTGNTEEIADIVADKLRDLGLDVDVDECTTVDASDFLEADIAIVATYTYGDGELPDEMMDFYEDLADLNLNGKIYGVVGSGDTFYDEFCKAVDDFDRVFVSTGAEKGSECVKVDLSAEEEDIERLEQFSEKLVA

SEQ ID NO: 4497 - protein, 88 aa, Streptococcus pneumoniae
VDLDIIRQEIDQIDDQIVKLLEERMHLVEGVVAYKKASGKPILDTKREAVIFEKVRSRVEDKRYQETIVATFSDILKRSRDYQDQNIK

SEQ ID NO: 4498 - protein, 124 aa, Streptococcus pneumoniae
MKKEQFYPLGIFLAAMLGGLVRYLVSTWLPASPDFPWGTLFVNYLGIFCLIYLVKGYLVYKGTSKGLILALGTGFCGGLTTFSSLMLDTVKLLDTGRYLSLILYLLLSIGGGLLLAYYLGRKKW

SEQ ID NO: 4499 - protein, 109 aa, Streptococcus pneumoniae
MVIVYLAIACGLGALVRYFFSRYNQASKLPLGTLIANLLGCFLIGVFYNHVESKEVYAILATGFCGGLTTFSTLNDELQRLLSDKKVFYSYLTLTYIGGLVAIFLGILL

SEQ ID NO: 4500 - protein, 115 aa, Streptococcus pneumoniae
MNPLIQSLTEGQLRTDIPSFRPGDTVRVHAKVVEGNRERIQIFEGVVIARKGAGISENYTVRKISNGVGVERIFPIHTPRVEKIEVVRYGKVRRAKLYYLRALQGKAARIKEIRR

SEQ ID NO: 4501 - protein, 268 aa, Streptococcus pneumoniae
MSIKLIAVDIDGTLVNSQKEITPEVFSAIQDAKEAGVKVVIATGRPIAGVAKLLDDLQLRDQGDYVVTFNGALVQETATGHEIISESLTYEDYLDMEFLSRKLGVHMHAITKDGIYTANRNIGTYTVHESTLVSMPIFYRTPEEMAGKEIVKCMFIDEPEILDAAIEKIPAEFYERYSINKSAPFYLELLTKNVDKGSAITHLAEKLGLTKDETMAIGDEENDRAMLEVVGNPVVMENGNPEIKKIAKYITKTNDESGVAHAIRTWVL

SEQ ID NO: 4502 - protein, 447 aa, Streptococcus pneumoniae
MLPKRAGFCYNGHMNEKVFRDPVHNYIHVNNQIIYDLINTKEFQRLRRIKQLGTSSYTFHGGEHSRFSHCLGVYEIARRITEIFEEKYPEEWNPAESLLTMTAALLHDLGHGAYSHTFEHLFDTDHEAITQEIIQNPETEIHQVLLQVAPDFPEKVASVIDHTYPNKQVVQLISSQIDADRMDYLLRDSYFTGASYGEFDLTRILRVIRPVENGIAFQRNGMHAIEDYVLSRYQMYMQVYFHPATRAMEVLLQNLLKRAKELYPEDKNFFARTSPHLLPFFEKNVTLTDYLALDDGVMNTYFQLWMTSPDKILADLSQRFVNRKVFKSITFSQEDQDQLTSMRKLVEDIGFDPDYYTAIHKNFDLPYDIYRPESQNPRTQIEILQKNGELAELSSLSPIVQSLAGSRHGDNRFYFPKEMLDQNSIFASITQQFLHLIENDHFTPNKN

SEQ ID NO: 4503 - protein, 125 aa, Streptococcus pneumoniae
VKIRMRNTIQFDEQLEVIDQLYDVEVHEKGDYSYLLFYNEEKEKVVIKFHGQELVMSRFSNPKTIMRFLKDSDSLAYIPTPMGMQEFIIQTSRYQVDRQKIELAYQLQNQEGHPFASYQLEITWG

SEQ ID NO: 4504 - protein, 110 aa, Streptococcus pneumoniae
MEIEKTNRMNALFEFYAALLTDKQMNYIELYYADDYSLAEIAEEFGVSRQAVYDNIKRTEKILEDYEMKLHMYSDYIVRSQIFDQILERYPKDDFLQEQIEILTSIDNRE

SEQ ID NO: 4505 - protein, 184 aa, Streptococcus pneumoniae
LSLLANLPAKVVLPAPCKPTIMMMVGILGDLIISAVSEPKTAVSSSSTILIICCAGLSVSMTSCPTARSRTFLIKSFTTGKATSASSKAKRISLVASWTSDSEIFPFLRRFLKTFCKRSVKLSNAIFLPLILYYQCLLKFLSAPAENHPWDSAPRFGQKSDYGQCSPSTCAISSHNLPESFLFA

SEQ ID NO: 4506 - protein, 523 aa, Streptococcus pneumoniae
MAFESLTERLQNVFKNLRKKGKISESDVQEATKEIRLALLEADVALPVVKDFIKKVRERAVGHEVIDTLNPAQQIIKIVDEELTAVLGSDTAEIIKSPKIPTIIMMVGLQGAGKTTFAGKLANKLKKEENARPLMIAADIYRPAAIDQLKTLGQQIDVPVFALGTEVPAVEIVRQGLEQAQTNHNDYVLIDTAGRLQIDELLMNELRDVKTLAQPNEILLVVDAMIGQEAANVAREFNAQLEVTGVILTKIDGDTRGGAALSVRHITGKPIKFTGTGEKITDIETFHPDRMSSRILGMGDMLTLIEKASQEYDEQKALEMAEKMRENTFDFNDFIDQLDQVQNMGPMEDLLKMIPGMANNPALQNMKVDERQIARKRAIVSSMTPEERENPDLLNPSRRRRIAAGSGNTFVEVNKFIKDFNQAKQLMQGVMSGDMNKMMKQMGINPNNLPKNMPNMGGMDMSALEGMMGQGGMPDLSALGGAGMPDMSQMFGGGLKGKIGEFAMKQSMKRMANKMKKAKKKRK

SEQ ID NO: 4507 - protein, 162 aa, Streptococcus pneumoniae
LSYLRFFFAFFILLAIRFMDCFIANSPILPFKPPPNIWLISGIPAPPRADKSGIPPCPIIPSRADISIPPIFGIFLGRLFGLIPICFIILFISPDITPCMSCLAWLKSLMNLLTSTNVFPEPAAIRRRRLGFNKSGFSRSSGVIEDTMARLRAIWRSSTFMF

SEQ ID NO: 4508 - protein, 256 aa, Streptococcus pneumoniae
LLPLSIQKGKGFLRIIPFLFAIIGGYLFALTLGLVDFTPVLKANWFESPGFYLPFSTGGAFKEYNLYFGPEAIAILPIAIVTISEHIGDHTVLGQICGRQFLKEPGLHRTLIGDGIATSVSAFLGGPANTTYGENTGVIGMTRIASVSVIRNAAFIAIALSFLGKFTALISTIPNAVLGGMSILLYGVIASNGLKVLIKERVDFAQMRNLIIASAMLVLGLGGAILKLGPVTLSGTALSAMTGIILNLILPYENKD

SEQ ID NO: 4509 - protein, 146 aa, Streptococcus pneumoniae
  UNSURE (139): Xaa at each above location is unknown.
MTQESTVDLLLDVNQGPSDGKGILLSFLHVFAMFGATILVPLILGMPVSVALFASGVGTLIYMIATGFKVPVYLGSSFAFITAMSLAMKEMGGDVSAAQTGVILTGLVYVLVATSIRFVGPKCLDKLLPPIIIGPMIIXIGLGLAR

SEQ ID NO: 4510 - protein, 237 aa, Streptococcus pneumoniae
MKPETFYNLLAEQNLPLSNQQKEQFERYFELLVEWNEKINLTAITDKEEVYLKHFYDSIAPILQGLIPNETIKLLDIGAGAGFPSLPMKILYPELDVTIIDSLNKRINFLQLLAQELDLNGVHFYHGRAEDFAQDKNFRAQYDFVTARAVARMQVLSELTIPYLKVGGKLLALKASNAPEELLEAKNALNLLFSKVEDNLSYALPNRDPRYITVVEKKKETPNKYPRKAGMPNKRPL

SEQ ID NO: 4511 - protein, 186 aa, Streptococcus pneumoniae
MTWIILGVIALIVIFVIVSYNGLVKNRMQTKEAWSQIDVQLKRRNDLLPNLIETVKGYAKYEGSTLEKVAELRNQVAAATSPAEAMKASDALTRQVSGIFAVAESYPDLKASANFVKLQEELTNTENKISYSRQLYNSVVSNYNVKLETFPSNIIAGMFGFKAADFLQTPEEEKSVPKVDFSGLGD

SEQ ID NO: 4512 - protein, 302 aa, Streptococcus pneumoniae
VTKMLFDQIASNKRKTWILLLVFFLLLALVGYAVGYLFIRSGLGGLVIALIIGFIYALSMIFQSTEIVMSMNGAREVDEQTAPDLYHVVEDMALVAQIPMPRVFIIDDPALNAFATGSNPQNAAVAATSGLLAIMNREELEAVMGHEVSHIRNYDIRISTIAVALASAITMLSGMAGRMMWWGGAGRRRSDDDRDGNGLEIIMLVVSLLAIVLAPLAATLVQLAISRQREFLADASSVELTRNPQGMINALDKLDNSKPMSRHVDDASSALYINDPKKGGGFQKLFYTHPPISERIERLKQM

SEQ ID NO: 4513 - protein, 519 aa, Streptococcus pneumoniae
MHYEHSRKGNHMIKINHLTITQNKDLRDLVSDLTMTIQDGEKVAIIGEEGNGKSTLLKILMGEALSDFTIKGNIQSDYQSLAYIPQKLPEELKKKTLHDYFFLDSIDLDYSILYRLAEELHFDSNRFASDQEIGSLSGGEALKIQLIHELAKPFEILFLDEPSNDLDLETVDWLKGQIQKTRQTVIFISHDEDFLSETADTIVHLRLVKHRKEAETLVEHLDYDSYSEQRKANFAKQSQQAANNQRAYDKTMEKHRRVKQNVETALRATKDSTAGRLLAKKMKTVLSQEKRYEKTAQSMTQKPLEEEQIQLFFSDIQPLPASKVLVQLEKENLSIDDRVLVQKLQLTVRGQEKIGIIGPNGVGKSTLLAKLKQLLNDKREISLGFMPQDYHKKLQLDLSPIAYISKTGEKEELQKIHSHLASLNFSYPEMQHQIRSLSGGQQGKLLLLDLVLRKPNFLLLDEPTRNFSPTSQPQIKKLFATYPGGLITVSHDRRFLKEVCSIIYRMTEHGLELVNLEDL

SEQ ID NO: 4514 - protein, 91 aa, Streptococcus pneumoniae
CITKSSTLPSRAQSLCQKNSINMPEKEHKRAHKKRQKQDLLNKGSLFDRLSCSCLPYLRVLVSLYYTFKEILSTENWKFYALKSKNRSIET

SEQ ID NO: 4515 - protein, 121 aa, Streptococcus pneumoniae
VLYYRERVHQIKEDAHMEDKKLIQLLSKLNKSYQNCKQGTADDIRLQELLNTTMQELKKTEQLNNSILIDLEKFYQPTSPLIGLGSLKLNNQARTAWRNYDKIHYEHVKHVLSLYGPVFGF

SEQ ID NO: 4516 - protein, 180 aa, Streptococcus pneumoniae
MKLNIQEIRKQSEGLNFEQTLDLVDDLRARNQEILDVKDILAVGKVQYEDRMYFLDYQLSYTIVLASSRSMEPVELVESYPVTEVFMEGATNHLNQEILDDDLVLPIENGALDLAESVSDNILLNIPIKVLTAEEEAGQGFVSGNDWQIMTEEEYQAQQAVKKEENSPFAGLQGLFDGDE

SEQ ID NO: 4517 - protein, 61 aa, Streptococcus pneumoniae
LVKSRLGLASGKRAMISSSTFRARFFDKTIIHLRQIVLVSQQKDCFLLSLLLVELGILPLS

SEQ ID NO: 4518 - protein, 209 aa, Streptococcus pneumoniae
MVLSKKRARKVLEEIIALFPDAKPSLDFTNHFELLVAVMLSAQTTDAAVNKATPGLFVAFPTPQAMSVATESEIASHISRLGLYRNKAKFLKKCAQQLLDDFDGQVPQTREELESLAGVGRKTANVVMSVGFGIPAFAVDTHVERICKHHDIVKKSATPLEVEKRVMDILPPEQWLDAHQAMIYFGRAICHPKNPECDQYPQLYDFSNL

SEQ ID NO: 4519 - protein, 173 aa, Streptococcus pneumoniae
MKTKEVVDELTVKRAITRITYEIIERNKDLNKIVLAGIKTRGVFIAHRIQERLKQLENLSVPVVELDTKPFRDDVKSGEDTSLVSVDVTDREVILVDDVLYTGRTIRAAIDNIVGHGRPARVSLAVLVDRGHRELPIRPDYVGKNIPTSRSEEIIVEMTELDDQDRVLITEEA

SEQ ID NO: 4520 - protein, 307 aa, Streptococcus pneumoniae
MSENQQALNHVVSMEDLTVDQVMKLIKRGIEFKNGAQLPYEDHPIVSNLFFEDSTRTHKSFEVAEIKLGLERLDFDVKTSSVNKGETLYDTILTLSALGVDVCVTRHPEVDYYRELIDSPTITTSIINGGDGSGQHPSQSLLDLMTIYEEFGHFEGLKVAIAGDLDHSRVAKSNMQILKRLGAELFFAGPEEWRSQEFADYGKFVTIDEIIDQVDVMMFLRVQHERHDSGAVFSKEDYHAQHGLTQERYDRLKETAILMHPAPINRDVEIADHLVEAPKSRIVQQMTNGVFVRMAILESVLASRNAN

SEQ ID NO: 4521 - protein, 359 aa, Streptococcus pneumoniae
MTKRILVLEDGTVFEGKAFGADIDVTGEIVFNTGMTGYQESITDQSYNGQILTFTYPLVGNYGINRDDYESIIPTCKGVVVFEEARRASNWRNQMTLDEFLKAKKIPGISGIDTRALTKIIRKHGTMRATLTHVGDSMDHVTDQLQATVLPTDNIKQVSTKTSYPAPGVGLSVVLVDFGLKHSILRELSKRNCNVTVVPYSTTAEEILHLNPDGVMLSNGPGNPEDVPQALDMIRGVQGKIPIFGICMGHQLFAMANGAKTYKMKFGHRGFNHAVREIATGRVDFTSQNHGYAVSREDLPEHLIITHEEINDKSVEGVRHRYQPAFSVQYHPDAAPGPHDASYLFDEFIEMMEIFKQSN

SEQ ID NO: 4522 - protein, 1058 aa, Streptococcus pneumoniae
MPKRTDIQKIMVIGSGPIIIGQAAEFDYAGTQACLSLKEEGYEVVLVNSNPATIMTDKEIADKVYIEPITLEFVTRILRKERPDALLPTLGGQTGLNMAMELSKNGILDELGVELLGTKLSAIDQAEDRDLFKQLMEELEQPIPESEIVNTVEEAIAFAATIGYPVIVRPAFTLGGTGGGMCANEKELREITENGLKLSPVTQCLIERSIAGFKEIEYEVMRDSADNALVVCNMENFDPVGIHTGDSIVFAPAQTMSDYENQMLRDASLSIIRALKIEGGCNVQLALDPNSFKYYVIEVNPRVSRSSALASKATGYPIAKLAAKIAVGLTLDEVINPVTGSTYAMFEPALDYVVAKIPRFPFDKFEKGERRLGTQMKATGEVMAIGRNIEESLLKACRSLEIGVHHNEIPELAAVSDDALIEKVVKAQDDRLFYVSEAIRRGYTPEEIAELTKIDIFYLDKLLHIFEIEQELGAHPQDLEVLKTAKLNGFSDRKIAELWGTTDDQVRQLRLENKIIPVYKMVDTCAAEFDSETPYFYSTYGWENESIRSDKESVLVLGSGPIRIGQGVEFDYATVHSVKAIQAAGYEAIIMNSNPETVSTDFSVSDKLYFEPLTFEDVMNVIDLEQPKGVIVQFGGQTAINLAEPLAKAGVTILGTQVADLDRAEDRDLFEQALKELDIPQPPGQTATNEEEAALAARKIGFPVLVRPSYVLGGRAMEIVENEEDLRSYMRTAVKASPDHPVLVDSYIVGQECEVDAISDGKNVLIPGIMEHIERAGVHSGDSMAVYPPQTLSQKVQETIADYTKRLAIGLHCLGMMNIQFVIKDEKVYVIEVNPRASRTVPFLSKVTNISMAQVATKLILGQSLSELGYQNGLYPESTRVHIKAPVFSFTKLAKVDSLLGPEMKSTGEVMGSDATLEKALYKAFEASYLHLPTFGNVVFTIADDAKEEALNLARRFQNIGYGILATEGTAAFFASHGLQAQPVGKIGDDDKDIPSFVRKGRIQAIINTVGTKRTADEDGEQIRRSAIEHGVPLFTALDTANAMLKVLESRSFVTEAI

SEQ ID NO: 4523 - protein, 69 aa, Streptococcus pneumoniae
KKVFKIIKRIISSFFKNLDMMRFIVGIFISFSTKIMFLNNLYLSSLYNPPQSAFTISFNTMTIPFLHFF

SEQ ID NO: 4524 - protein, 280 aa, Streptococcus pneumoniae
MNFTLINWRIRMQYLEKKEIKEIQLALLDYIDETCKKYDIPYFLSYGTMLGAIRHKGMIPWDDDIDISLYREDYERLLKIIEEENHPRYKVLSYDTSSWYFHNFASILDTSTVIEDHVKYKRHDTSLFIDVFPIDRFTDLSIVDKSYKYVALRQLAYIKKSRAVHGDSKLKDFLRLCSWYALRFVNPRYFYKKIDQLVKNAVTNTPQYEGGVGIGKEGMKEIFPVDTFKELILTEFEGRMLPVPKKYDQFLTQMYGDYMTPPSKEMQEWYSHSIKAYRKS

SEQ ID NO: 4525 - protein, 267 aa, Streptococcus pneumoniae
MKQLTVEDAKQIELEILDYIDTLCKKHNINYIINYGTLIGAVRHEGFIPWDDDIDLSMPREDYQRFINIFQKEKSKYKLLSLETDKNYFNNFIKITDSTTKIIDTRNTKTYESGIFIDIFPIDRFDDPKVIDTCYKLESFKLLSFSKHKNIVYKDSLLKDWIRTAFWLLLRPVSPRYFANKIEKEIQKYSRENGQYMAFIPSKFKEKEVFPSGTFDKTIDLPFENLSLPAPEKFDTILTQFYGDYMTLPPEEKRFYSHEFHAYKLED

SEQ ID NO: 4526 - protein, 495 aa, Streptococcus pneumoniae
MKSIKLNALSYMGIRVLNIIFPILTGTYVARVLDRTDYGYFNSVDTILSFFLPFATYGVYSYGLRAISNVKDNKKDLNRTFSSLFYLCIACTILTTAVYILAYPLFFTDNPIVKKVYLVMGIQLIAQIFSIEWVNEALENYSFLFYKTAFIRILMLVSIFLFVKNEHDIVVYTLVMSLSTLINYLISYFWIKRDIKLVKIHLSDFKPLFLPLTAMLVFANANMLFTFLDRLFLVKTGIDVNVSYYTIAQRIVTVIAGVVTGAIGVSVPRLSYYLGKGDKEAYVSLVNRGSRIFNFFIIPLSFGLMVLGPNAILLYGSEKYIGGGILTSLFAFRTIILALDTILGSQILFTNGYEKRITVYTVFAGLLNLGLNSLLFFNHIVAPEYYLLTTMLSETSLLVFYIIFIHRKQLIHLGHIFSYTVRYSLFSLSFVAIYFLINFVYPVDMVINLPFLINTGLIVLLSAISYISLLVFTKDSIFYEFLNHVLALKNKFKKS

SEQ ID NO: 4527 - protein, 235 aa, Streptococcus pneumoniae
MIYAGILAGGTGTRMGISNLPKQFLELGDRPILIHTIEKFVLEPSIEKIVVGVHGDWVLHAEDLVDKYLPLHKERIIITKGGADRNTSIENIIEAIDAYRPLTPEDIVVTHDSVRPFITLRMIQDSIKLAQNHDAVDTVVEAVDTIVESTNGQFITGIPNRAHLYQGQTPQTFRCKDFMDLYGSLSDEEKEILTDACKIFVIKGKDVALAKGEYSNLKITTVTDLKIAKSMIEKD

SEQ ID NO: 4528 - protein, 346 aa, Streptococcus pneumoniae
LRKTSKMINQIYQLTKPKFINVKYQEEAIDQENHILIRPNYMAVCHADQRYYQGKRDPKILNKKLPMAMIHESCGIVISDPSGTYEVGQKVVMIPNQSPMQSDEEFYENYMTGTHFLSSGFDGFMREFVSLPKDRVVAYDAIEDTVAAITEFVSVGMHAMNRLLTLAHSKRERIAVIGDGSLAFVVANIINYTLPEAEIVVIGRHWEKLELFSFAKECYITDNIPEELAFDHAFECCGGDGTGPAINDLIRYIRPQGTILMMGVSEYKVNLNTRDALEKGLLLVGSSRSGRIDFENAIQMMKVKKFANRLKNILYLEEPVREIKDIHRVFATDLNTAFKTVFKWEV

SEQ ID NO: 4529 - protein, 289 aa, Streptococcus pneumoniae
VEKIIKEKISSLLSQEEEVLSVEQLGGMTNQNYLAKTTNKQYIVKFFGKGTEKLINRQDEKYNLELLKDLGLDVKNYLFDIEAGIKVNEYIESAITLDSTSIKTKFDKIAPILQTIHTSAKELRGEFAPFEEIKKYESLIEEQIPYANYESVRNAVFSLEKRLADLGVDRKSCHIDLVPENFIESPQGRLYLIDWEYSSMNDPMWDLAALFLESEFTSQEEETFLSHYESDQTPVSHEKIAIYKILQDTIWSLWTVYKEEQGADFGYYGVNRYQRAVKGLASYGGSDEK

SEQ ID NO: 4530 - protein, 292 aa, Streptococcus pneumoniae
MKSKNGVPFGLLSGIFWGLGLTVSAYIFSIFTDLSPFVVAAAHDFLSIFILLAFLLVKEGKVRLSIFLNIRNVSVIIGALLAGPIGMQANLYAVKYIGSSLASSVSAIYPAISVLLAFFFLKHKISKNTVFGIVLIIGGIIAQTYKVEQVNSFYIGILCALVCAIAWGSESVLSSFAMESELSEIEALLIRQVTSFLSYLVIVLFSHQSFTAVVNGQLLGLMIVFAAFDMISYLAYYIAINRLQPAKATGLNVSYVVWTVLFAVVFLGAPLDMLTIMTSLVVIAGVYIIIKE

SEQ ID NO: 4531 - protein, 229 aa, Streptococcus pneumoniae
VKAIILAAGLGTRLRPMTENTPKALVQVNQKPLIEYQIEFLKEKGINDIIIIVGYLKEQFDYLKEKYGVRLVFNDKYADYNNFYSLYLVKEELANSYVIDADNYLFKNMFRNDLTRSTYFSVYREDCTNEWFLVYGDDYKVQDIIVDSKAGRILSGVSFWDAPTAEKIVSFIDKAYASGEFVDLYWDNMVKDNIKELDVYVEELEGNSIYEIDSVQDYRKLEEILKNEN

SEQ ID NO: 4532 - protein, 282 aa, Streptococcus pneumoniae
MKITNYEIYKLKKSGLTNQQILKVLEYGENVDQELLLGDIADISGCRNPAVFMERYFQIDDAHLSKEFQKFPSFSILDDCYPWDLSEIYDAPVLLFYKGNLDLLKFPKVAVVGSRACSKQGAKSVEKVIQGLENELVIVSGLAKGIDTAAHMAALQNGGKTIAVIGTGLDVFYPKANKRLQDYIGNDHLVLSEYGPGEQPLKFHFPARNRIIAGLCRGVIVAEAKMRSGSLITCERAMEEGRDVFAIPGSILDGLSDGCHHLIQEGAKLVTSGQDVLAEFEF

SEQ ID NO: 4533 - protein, 170 aa, Streptococcus pneumoniae
LIICVFSKWISRVEDFSHIILFENLCKLRQLPSATSKQYFELTSSVLSATSKQYFELTSSVLSATSKQYFELTSSVLSATSKQYFELTSSVLSATSKQYFELTSSVLSATSKQYFELTSSVLSATSKQYFELTSSVLSTTSKQCFEQPVASFLVCALIFIEYKGKYSELK

SEQ ID NO: 4534 - protein, 151 aa, Streptococcus pneumoniae
LTFLIELFTSYFNSLYFPLYSMKIKAQTRKLATGCSKHCFEVVDKTDEVSSKYCFEVADKTDEVSSKYCFEVADKTDEVSSKYCFEVADKTDEVSSKYCFEVADKTDEVSSKYCFEVADKTDEVSSKYCFEVADKTDEVSSKYCFEVADGS

SEQ ID NO: 4535 - protein, 68 aa, Streptococcus pneumoniae
NGYYKKWSEIDDDTFRKSFYVSSALPCCVLSKLRLASEFDFHLLEMKLMRDISRHLSQDIMENDKKSS

SEQ ID NO: 4536 - protein, 347 aa, Streptococcus pneumoniae
VTNNKLYSLIEFRNKIYEELELSRSDLAILLCAMLIASIGLNMDSTPVIIGAMLISPLMTPILGVGLSLAIFDFKLLRKSFKILAIQILASLIASTLYFYLSPISYASSEIVARTSPTIWDVLIAFVGGIAGIIGARKKETNNIVPGVAIATALMPPLCTVGYAIASANLKFIIGSSYLFLINCSFIVIATYIGVRLMMVKKHYFKDNEEDSKMRRILLLVAVLLMIPSFISATTLVRETLKKESLKKFISEQFQGHNILKKTYSKKTHTLKLTISGNYLTEEELDMISSKRGDYGLSDVSVQVSQLSDSEQLSKEELVEYFFQYIKDKEAKEKEKANKFYTESEEQ

SEQ ID NO: 4537 - protein, 701 aa, Streptococcus pneumoniae
LKRCDTVATVTKKKKSTVKKNLVIVESPAKAKTIEKYLGRNYKVLASVGHIRDLKKSSMSVDIENNYEPQYINIRGKGPLINDLKKEAKKANKVFLASDPDREGEAISWHLAHILNLDENDANRVVFNEITKDAVKNAFKEPRKIDMDLVDAQQARRILDRLVGYSISPILWKKVKKGLSAGRVQSIALKLIIDRENEINAFQPEEYWTVDAVFKKGTKQFHASFYGVDGKKMKLTSNDEVKEVLSRLTSKDFSVDQVDKKERKRNAPLPYTTSSMQMDAANKINFRTRKTMMVAQQLYEGINIGSGVQGLITYMRTDSTRISPVAQNEAASFITDRFGSKYSKHGSKVKNASGAQDAHEAIRPSSVFNTPESIAKYLDKDQLKLYTLIWNRFVASQMTAAVFDTMAVKLSQKGVQFAANGSQVKFDGYLAIYNDSDKNKMLPDMVVGDVVKQVNSKPEQHFTQPPARYSEATLIKTLEENGVGRPSTYAPTIETIQKRYYVRLAAKRFEPTELGEIVNKLIVEYFPDIVNVTFTAEMEGKLDDVEVGKEQWRRVIDAFYKPFSKEVAKAEEEMEKIQIKDEPAGFDCEVCGSPMVIKLGRFGKFYACSNFPDCRHTQAIVKEIGVECPSCHQGQIIERKTKRNRLFYGCNRYPECEFTSWDKPVGRDCPKCGNFLMEKKVRGGGKQVVCSKGDYEEEKIK

SEQ ID NO: 4538 - protein, 119 aa, Streptococcus pneumoniae
MRLIYLIIGFLSLALAIVGVVLPLLPTTPFLLLSIACFSRSSKRFEDWLYHTKLYQTYVADFRETKSITRERKKKIIVSIYVLMGISIYFAPLLPVKIGLGALTIFITYYLFKVIPDKE

SEQ ID NO: 4539 - protein, 210 aa, Streptococcus pneumoniae
MIYEFCAENVTLLEKAMQAGARRIELCDNLAVGGTTPSYGVTKAAVELAANYDTTIMTMIRPRGGDFVYNDLEIAIMLEDICLTAQAGSQGVVFGALTADKKLDKPNLEKLIAASKGMEIVFHMAFDELSDEDQPEAIDWLSQAGVTRILTRAGVSGDSLEKRFVHYHRILEYAKGKIEILPGGGIDLDNRQTFIDQVGVTQLHGTKVVF

SEQ ID NO: 4540 - protein, 218 aa, Streptococcus pneumoniae
MFEIFKSYQFNQEKAHDYGFIENSEVWTYSCQILQGDFVMTVSITADNVNFQVFDQETGDLYPHVHMESMRGSFVGNVREACLEILYQIRKACFDVQDFICHQTKRIMTQVQEKYGNQLEYLWEKSPDTAVLRHEGNQKWYAVLMKISWNKLEKGREGQVEAVNLKHDQVANLLSQKGIYPAFHMSKRYWISVSLDDTLSDEEVLELIEKSWNLTSKK

SEQ ID NO: 4541 - protein, 210 aa, Streptococcus pneumoniae
MNFQLAKYSLLKKFLENIGFTTLEEYGAIFKYLIENVKTDRQIICSPHCHDDLGMAVANSLAAVKNGAGRVEGTINGIRERAENAALEEIAVALNIRQDYYQVETSIVLNETINTSEMVSRFSGIPVPKNKAVVGGNTFSHESGIHQDGVLKNPLTYEIITPELVGVKIPLGELSGRHAFVEKLRELALDFTEEDIKPLFAKFKALADKK

SEQ ID NO: 4542 - protein, 69 aa, Streptococcus pneumoniae
MVPATKARVSASVISYFLSASALNLAKSGLISSSVKSRANSLSFSTKAWRPDNSPSGILTPTNSGVMIS

SEQ ID NO: 4543 - protein, 144 aa, Streptococcus pneumoniae
LVAGTMVENPEGFHFDDLQLQTHADNDIEALVSLANMDGEKVEFNATGQGSVQAIFNAIDKFFNQSVRLVSYTINAVTDGIDAQDRVLVTVENRDTETIFNAAGLDFDVLKASAIAYINANTFVQKENAGEMGRSVSYHDMPSV

SEQ ID NO: 4544 - protein, 345 aa, Streptococcus pneumoniae
MAKKIVALVGDGIGPEIMEAGLEVLEALAEKTGFDYEIDRRPFGGADIDAAGPPLPDETLKASREADAILLAAIGSPQYDGAAVRPEQGLMALRKELNLYANIRPVKIFDSLKYLSPLKPERISGVDFVVVRELTGEIYFGDHILEERKARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLEVMPSASHSENGPSLYEPIHGSAPDIAGQGIANPISMILLVVMMLRDSFGRYEDTERIKRAVETSLAAGILTRDIGGQASTKEMMEAIIARL

SEQ ID NO: 4545 - protein, 89 aa, Streptococcus pneumoniae
MKLDEKITLVLLIWNVIIFLIYGIDKFKARRRAWRIPEKILLILALTCGGFGAWLAGITFHHKTRKWYFKTVWFLGMVTTLVALYFIWR

SEQ ID NO: 4546 - protein, 119 aa, Streptococcus pneumoniae
MVGSSREHAAWALADYGFKVVIAGSFGDIHYNNELNNGMLPIVQPREVREKLAQLKPTDQVTVDLEQQKIISPVEEFTFEIDSKWKHKLLNSLDDIGITLQYEELIAAYEKQRPAYWQD

SEQ ID NO: 4547 - protein, 78 aa, Streptococcus pneumoniae
NYDKTHSQEGYDILKGEGGCIVCPTKVGYIIMTSNKAGLERKFAAKERKRNKPGVVLCGSMDELRALAQLNPEIEAFY

SEQ ID NO: 4548 - protein, 88 aa, Streptococcus pneumoniae
LDEDILLGCILPWKPEAFEKLKAYGDGREELMTDVRGTSCFVIKFGKAGEQLAAKLWEEGKMVYASYASMTKRLKLAMRARCNGVYGR

SEQ ID NO: 4549 - protein, 644 aa, Streptococcus pneumoniae
LMNKRKVSLEDFYKWYSLNKEELLNKATVGEKFNDKLKEEFLQEWPLDRILTMSIDEYVIGKGQQNKSLCYALEKGKYKNLFLGISGGSASKFGIYWNKKTNKYKDQANNEISELDQRFSKLKSDLYEIIKEGIRFNFENPIFDMKRSTNEFIGRSAMVTKLLCIYTEGDPFFGVNINSQKEFWNHFVSQTNQGGPYLQNHKIIELVSKTYPELEPSKLGTMLFEYSKLFMENKEDNSTMDSSNNFSHQLTQSLLKSPNLILRGAPGTGKTYLAKEIAKELTDGNEDQIGFVQFHPSYDYTDFVEGLRPVSNGDGAIEFRLQDGIFKDFCQKAKETQLIGGQDNFDEAWDSYLEYINVAEEKEYITKTSYLSVNSRQNLSVNYDSGVPGWSLPSKYVYELYKDKNYNKQEYYKSGGKTVLETLRKRFGLKDYVSPTEIDTDKKFVFIIDEINRGEISKIFGELFFSIDPGYRGEKGSVSTQYANLHETDEKFYIPENVYIIGTMNDIDRSVDTFDFAMRRRFRFVEVTAEGQVGMLDKELNIHAEEAKIRLRNLNAAIENVQELNSHYHIGPSYFLKLKDVDFDYELLWSDYIKPLLEDYLRGSYDEVETLETLKKAFELTNNEQKDQAVADDNESDENDDADY

SEQ ID NO: 4550 - protein, 447 aa, Streptococcus pneumoniae
MTMKAMKTMMRITDNQHKIIKEKFVEEYPKLSNLLLDRTLESLSQDERIFIFPNDLTHTPDLDKKQKILETINQEIKTGNVIGFLGYGQERLTISSRFSDESNDHFLHYLLNKVLHINLTSLDVALSREERLYQLLMYLFPKYLQAAIRKGLYKEYHRFSHNDSHVKGVIDVRNHLKKNLPFTGNIAYTTREFTYDNPLMQLVRHTIEYIKNQKSIGQGVLDNLSTSRENVSEIVRVTPSYKLADRAKIIRGNQSKPIRHAYFHEYRNLQELCLMILNQEKHGLGYQDQKIYGILFDVAWLWEEYVYTLLPKGFVHPRNKDKTDGISVFSVGKRKVYPDFYDRERKIVLDAKYKKLELTEKGINREDLFQLISYSYILKAEKAGLIFPSMEQSVNSEIGKVAGYGAQLKKWSIRIPQNASSYSAFCKMMENSEENFKAIIDEEVGRK

SEQ ID NO: 4551 - protein, 328 aa, Streptococcus pneumoniae
MLNEFPIFDYEDIQLIPNKCVIKSRAEADTSVTLGNHTFKLPVVPANMQTILDENVAEQLAKGGYFYIMHRFDEAGRIPFIKRMHDQGLIASISVGVKDYEYDFVSQLKTDAPEYITIDIAHGHADSVISMIQHIKKELPDTFVIAGNVGTPEAVRELENAGADATKVGIGPGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 4552 - protein, 77 aa, Streptococcus pneumoniae
PPSAIIGLRAALAHQRRAANCQPPVPKPVLTLVIQTLPGPIPTLVASAPAFSNSRTASGVPTFPAMTKVSGNSFLMC

SEQ ID NO: 4553 - protein, 66 aa, Streptococcus pneumoniae
FFHTNLFLTDNSPFYYIKKSPLSHSKTGLESIWEFFRQRFSVLAANLGQDKEKSPIKGFLGCLHPP

SEQ ID NO: 4554 - protein, 232 aa, Streptococcus pneumoniae
MKELQTVLKNHFAIEFTDKKLLETAFTHTSYANEHRLLKISHNERLEFLGDAVLQLLISEYLYKKYPKKPEGDLSKLRAMIVREESLAGFARDCQFDQFIKLGKGEEKSGGRNRDTILGDAFEAFLGALLLDKDVAKVKEFIYQVMIPKVEAGEFEMITDYKTHLQELLQVNGDVAIRYQVISETGPAHDKVFDVEVLVEGKSIGQGQGRSKKLAEQEAAKNAVEKGLDSCI

SEQ ID NO: 4555 - protein, 736 aa, Streptococcus pneumoniae
MYLKEIEIQGFKSFADKTKVVFDQGVTAVVGPNGSGKSNITESLRWALGESSVKSLRGGKMPDVIFAGTESRKPLNYASVVVTLDNHDGFIKDAGQEIRVERHIYRSGDSEYKIDGKKVRLRDIHDLFLDTGLGRDSFSIISQGKVEEIFNSKPEERRAIFEEAAGVLKYKTRRKETESKLQQTQDNLDRLEDIIYELDNQIKPLEKQAENARKFLDLEGQRKAIYLDVLVAQIKENKAELESTEEELAQVQELLMSYYQKREKLEEENQTLKKQRQDLQAEMAKDQGSLMDLTSLISDLERKLALSKLESEQVALNQQEAQARLAALEDKRNSLSKEKYDKESSLALLEGNLVQNNQKLNRLEAELLAFSDDPDQMIELLRERFVALLQEEADVSNQLTRIENELENSRQLSQKQADQLEKLKEQLATAKEKASQQKDELETAKVQVQKLLADYQAIAKEQEEQKTSYQAQQSQLFDRLDSLKNKQARAQSLENILRNHSNFYAGVKSVLQEKDRLGGIIGAVSEHLTFDVYYQTALEIALGASSQHIIVEDEESATKAIDFLKRNRVGRATFLPLTTIKARTISSQNQDAIAVSPGFLGMADELVTFDTRLEAIFKNLLATTAIFDTVEHAREAARQVRYQVRMVTLDGTELRTGGSYAGGANRQNNSIFIKPELEQLQKEIAADEASLGSEEAALKTLQDQMAALTERLEAIKLSRRAGTYSGARLVPRLSAN

SEQ ID NO: 4556 - protein, 216 aa, Streptococcus pneumoniae
LSLAYQQTSQQVEELETLWKLQEEEIDRLSEGDWQADKEKCQESLATIASDKQNLEAEIEEIKSNKNAIQERYQNLQEEVAQARLLKTKLQGQKRYEVADIERLGKELDNLNIEQEEIQRMLQEKVDNLEKVDTELLSQQAEESKTQKTNLQQGLIRKQFELDDIEGQLDDIASHLDQARQQNEEWIRKQTRAEAKKEKVSERAPSTKSINRPVPD

SEQ ID NO: 4557 - protein, 101 aa, Streptococcus pneumoniae
MILPVTWIKLASRMRSGFASKHVLKPRKKRSASVRHLQNQLTDQYQISYTEALEKAHELENLNLAEQEVQDLEKAIRSLGPVNLEAIDQYEEVHNRSGLSK

SEQ ID NO: 4558 - protein, 195 aa, Streptococcus pneumoniae
LTSTKKFTTGLDFLNSQRDDILSAKNLLLETITEMNDEVKERFKSTFEAIRESFKVTFKQMFGGGQADLILTEGDLLTAGVEISVQPPGKKIQSLNLMSGGEKALSALALLFSIIRVKTIPFVILDEVEAALDEANVKRFGDYLNRFDKDSQFIVVTHRKGTMAAADSIYGVTMQESGVSKIVSVKLKDLESIEG

SEQ ID NO: 4559 - protein, 264 aa, Streptococcus pneumoniae
MTIKLVATDMDGTFLDGNGRFDMDRLKSLLASYKEKGIYFAVASGRGFLSLEKLFAGVRDDIIFIAENGSLVEYQGQDLYEATMSRDFYLATFEKLKTSPYVDINKLLLTGKKGSYVLDTVDETYLKVSQHYNENIQKVASLEDITDDIFKFTTNFTEETLEAGEAWVNDNVPGVKAMTTGFESIDIVLDYVDKGVAIVELVKKLGITMDQVMAFGDNLNDLHMMQVVGHPVAPENARPEILELAKTVIGHHKDQSVIACMEGL

SEQ ID NO: 4560 - protein, 272 aa, Streptococcus pneumoniae
MADIKLIALDLDGTLLTTDKRLTDRTKETLKAARDRGIKVVLTTGRPLKAMDFFLHELGTDGQEEEYTITFNGGLVQKNTGEILDKTVFSYDDVARLYEETEKLSLPLDAISEGTVYQIQSDQESLYAKFNPALTFVPVDFEDLSNQMTYNKCVTAFAQEPLDAAIQKISPELFDQYEIFKSREMLLEWSPKNVHKATGLAKLISHLGIDQSQVMACGDEANDLSMIEWAGLGVAMQNAVPEVKAVANVVTPMTNDEEAVAWAIEEYVLKEN

SEQ ID NO: 4561 - protein, 429 aa, Streptococcus pneumoniae
MGLFDRLFGKKEEPKIEEVVKEALENLDLSEDIEPAFTEAEEVSQEEAEVESSEESVFQEEDSQDTVEENLDLEPVVEVSQEEVEEFPNSQEVTEEEKLEHEGTVEENNFEVLEPEAPQTEETVQEKYDRSLKKTRTGFGARLNAFFANFRSVDEEFFEELEELLIMSDVGVQVASNLTEELRYEAKLENAKKPDALRRVIIEKLVELYEKDGSYDESIHFQDNLTVMLFVGVNGVGKTTSIGKLAHRYKRAGKKVMLVAADTFRAGAVAQLAEWGRRVDVPVVTGPEKADPASVVFDGMERAVAEGIDILMIDTAGRLQNKDNLMAELEKIGRIIKRVVPEAPHETFLALDASTGQNALVQAKEFSKITPLTGIVLTKIDGTARGGVVLAIREELNIPVKLIGFGEKIDDIGEFNSENFMKGLLEGLI

SEQ ID NO: 4562 - protein, 418 aa, Streptococcus pneumoniae; identical to SEQ ID NO: 2954

SEQ ID NO: 4563 - protein, 84 aa, Streptococcus pneumoniae
AQAETVSQTVSLPNAKIVLDRFHIVQHLSRAMSRVRVQIMNQFHRKSHEYKAIKRYWKLIQQDSRKLSDKRFYRPTFRMHLTNK

SEQ ID NO: 4564 - protein, 108 aa, Streptococcus pneumoniae
NSPGSDCFNREMEMSFIAQDFNNLNIITVLEGRTQAIIRNHFLRYDRAVRCRVKIITMDMFSPYYDLAKQLRFQISRLRLKQSPRLFHSRMLKSFLIAFTLYNILAVL

SEQ ID NO: 4565 - protein, 172 aa, Streptococcus pneumoniae
MEQLHFITKLLDIKDPNIQILDIINKDTHKEIIAKLDYEAPSCPECGSQMKKYDFQKPSKIPYLETIGMPSRILLRKRRFKCYHCSKMMVAETPLVKKNHQIPRIINQKIAQKLIEKISMTDIAHQLSISTSTVIRKLNDSHFEHDFSRLPEIMSWDVETVRGVTVSIGRWR

SEQ ID NO: 4566 - protein, 495 aa, Streptococcus pneumoniae
MSSKVIVTIFGASGDLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQPDIAYRQDGRFE

SEQ ID NO: 4567 - protein, 246 aa, Streptococcus pneumoniae
MAKLKIDVNDLHKHYGKNEVLKGITTKFYEGDVVCIIGPSGSGKSTFLRSLNLLEEVTSGHITVNGYDLTEKTTNVDHVRENIGMVFQHFNLFPHMSVLDNITFAPIEHKLMTKEEAEKLGMELLEKVGLADKANANPDSLSGGQKQRVAIARGLAMNPDIMLFDEPTSALDPEMVGDVLNVMKELAEQGMTMIIVTHEMGFARQVANRVIFTADGEFLEDGTPDQIFDNPQHPRLKEFLDKVLNV

SEQ ID NO: 4568 - protein, 492 aa, Streptococcus pneumoniae
MKKDGSLDKIIKKWTASSSSAVPTTTTLAGLKAIPVKAKYIIASDSSFAPFVFQNSSNQYTGIDMELIKAIAKDQGFEIEITNPGFDAAISAVQAGQADGIIAGMSVTDARKATFDFSESYYTANTILGVKESSNIASYEDLKGKTVGVKNGTASQTFLTENQSKYGYKIKTFADGSSMYDSLNTGAIDAVMDDEPVLKYSISQGQKLKTPISGTPIGETAFAVKKGANPELIEMFNNGLANLKANGEFQKILDKYLASESSTASTSTVDETTLWGLLQNNYKQLLSGLGITLALALISFAIAIVIGIIFGMFSVSPYKSLRVISEIFVDVIRGIPLMILAAFIFWGIPNFIESITGQQSPINDFVAGTIALSLNAAAYIAEIVRGGIQAVPVGQMEASRSLGISYGKTMRKIILPQATKLMLPNFVNQFVIALKDTTIVSAIGLVELFQTGKIIIARNYQSFKMYAILAIFYLVIITLLTRLAKRLEKRIR

SEQ ID NO: 4569 - protein, 236 aa, Streptococcus pneumoniae
MKNKRIFKDFQASKMNLNIYTSPLLAFVFVFIGEFVAYTLYGISLLALIGLARNFGEAGQNLASYLQTLHQSLTDKTSDFRLILGLLAFGFILNTVFRWTRKVEKRPIRTLGFYIENFLSNLLKGFSLGLALFLLTLLGLVVLGQYRLESIHLNPYSLAFVVFTIPFWILQGTAEEVVARAWLLPQLASRTNLKLAILISSLFFTLLHMGNSGLTPLSLVNLFLFGVCHGSLPSQN

SEQ ID NO: 4570 - protein, 89 aa, Streptococcus pneumoniae
MALYLLKTDTVWGVAGIHGAWNFAQGNLFGILVSGQPSGTSLMTFLPQGNQDWLSGGSFGIEGSIMTSLVLLLLIVYLANKLKKENERM

SEQ ID NO: 4571 - protein, 662 aa, Streptococcus pneumoniae
MINHITDNQFKLVSKYQPSGDQPQAIEQLVDNIEGGEKAQILMGATGTGKTYTMSQVISKVNKPTLVIAHNKTLAGQLYGEFKEFFPENAVEYFVSYYDYYQPEAYVPSSDTYIEKDSSVNDEIDKLRHSATSALLERNDVIVVASVSCIYGLGSPKEYADSVVSLRPGLEISRDKLLNDLVDIQFERNDIDFQRGRFRVRGDVVEIFPASRDEHAFRVEFFGDEIDRIREVEALTGQVLGEVDHLAIFPATHFVTNDDHMEVAIAKIQAELEEQLAVFEKEGKLLEAQRLKQRTEYDIEMLREMGYTNGVENYSRHMDGRSEGEPPYTLLDFFPDDFLIMIDESHMTIGQIKGMYNGDRSRKEMLVNYGFRLPSALDNRPLRREEFESHVHQIVYVSATPGDYENEQTETVIEQIIRPTGLLDPEVEVRPTMGQIDDLLGEINARVEKNERTFITTLTKKMAEDLTDYFKEMGIKVKYMHSDIKTLERTEIIRDLRLGVFDVLVGINLLREGIDVPEVSLVAILDADKEGFLRNERGLIQTIGRAARNSEGHVIMYADTVTQSMQRAIDETARRRKIQMAYNEEHGIVPQTIKKEIRDLIAVTKAVAKEEDKEVDINSLNKQERKELVKKLEKQMQEAVEVLDFELAAQIRDMMLEVKALD

SEQ ID NO: 4572 - protein, 187 aa, Streptococcus pneumoniae
MIYLRKLKREDLMSLWEMAYSQLNPVWKQYDAPYYDDYQYFSNFKEFELQKSESILSNSNRLGIFVDDKLVGTVSRYWVCKQTRWMELGIGIYDKKFWNTGIGKVAMLQWIDRTFQDYLELEHLGLTTWSGNLGMMKLAEKLRMKKEAHIPKVRYYQGKYFDSIKYGILREDWEKMNDGYYQINGNS

SEQ ID NO: 4573 - protein, 129 aa, Streptococcus pneumoniae
MTLERCRFFSQKYPENTLIAIGDLKVVGFISYGNFRDETIQAGEIIALYVLKDYYGKGIAQKLMKAALTALNHFSEIFLWVLKDNKRAIAFYQKMGFTFDGQEKILELGKPIKEKRMVFYSKIILKSRS

SEQ ID NO: 4574 - protein, 155 aa, Streptococcus pneumoniae
MSRSQLTILTNICLIEDLETQCVVMQYRAPETNRWSGYAFPGGHVENGEAFAESVIREIYEETGLTIQNPQLVGVKNWPLDTGGRYIVFCYKATEFTGTLQSSDEGEVSWVQKDQIPNLNLAYDMLPLMEMMEAPDKSEFFYPRRTEDDWEKKIF

SEQ ID NO: 4575 - protein, 171 aa, Streptococcus pneumoniae
MTKDRKQALLQLLKEAPKALNGQSLAEHFHVTRQVIVQDIAILRADGAPILSTNRGYIYKQIDTNPYVHKLFKVKHEVEEIGQELLAIVDNGGHVQNTLIDHPVYGEIETLLKLSCRRDVQHFLEQVEHSDFRPLSELTDGIHYHLVEAETQQDLHYIEEALDQLGYLVKD

SEQ ID NO: 4576 - protein, 193 aa, Streptococcus pneumoniae
LSGLLYHTSVYAVKKEILVNTRKKTQFMTMTALLTAIAILIPIVMPFKIVIPPASYTLGSHIAIFIAMFLSPLMAVFVILASSFGFLMAGYPMVIVFRAFSHISFGALGALYLQKFPDTLDKPKSSWVFNFVLAVVHALAEVLACVLFYATSGTNVENMFYVLFVLVGFGTIIHSMVDYTLALAVYKVLRKRR

SEQ ID NO: 4577 - protein, 166 aa, Streptococcus pneumoniae
MKKRSNIAPIAIFFATMLVIHFLSSVIFNLFPFPIKPTIVHIPVIIASIIYGPRVGVTLGFLMGLLSLTVNTITILPTSYLFSPFVPNGNIYSAIIAIVPRILIGLTPYLVYKLMKNKTGLILAGALGSLTNTIFVLGGIFFLFGNVYNGNIQLLLANRYLNKFNC

SEQ ID NO: 4578 - protein, 183 aa, Streptococcus pneumoniae
MANILLAVTGSIASYKSADLVSSLKKQGHQVTVLMTQAATEFIQPLTLQVLSQNPVHLDVMKEPYPDQVNHIELGKKADLFIVVPATANTIAKLAHGFADNMVTSTALALPSHIPKLIAPAMNTKMYDHPVTQNNLKTLETYGYQLIAPKESLLACGDHGRGALADLTIILERIKETLDEKTL

SEQ ID NO: 4579 - protein, 252 aa, Streptococcus pneumoniae
IFVFTKNLSLSFYLPLIFVYNSAMKILVTSGGTSEAIDSVRSITNHSTGHLGKIITETLLSAGHEVCLITTKRALKPEPHPNLSIREITNTKDLLIEMQERVQDYQVLIHSMAVSDYTPVYMTGLEEVQASSNLKEFLSKQNHQAKISSTDEVQVLFLKKTPKIISLVKEWNPTIHLIGFKLLVDVTEDHLVDIARKSLIKNQADLIIANDLTQISANQHRAIFVEKNQLQTVQTKEEIAELLLEKIQAYHS

SEQ ID NO: 4580 - protein, 180 aa, Streptococcus pneumoniae
MAERTVVQVHNAFPEDTTLINSQLIPLVQVVVNQGRKGIVGSCNSMHISSKVEVDVFHWQNLCIPTTSSTTLDPHDWTKRRFADSNHGFLANLVQGIRKTNGKRRLSFTCRCWVDGSNQDQFTDWIALNCPNFIKAEFSLVLSVQLQIVVRNTKFLYNINNWLQLNTLCDFNICFHSKFL

SEQ ID NO: 4581 - protein, 556 aa, Streptococcus pneumoniae
MKTDIEIAQSIELKPIVDVVEKLGISYDDLELYGKYKAKLSFDKIRAVESNPVGKLILVTAINPTPAGEGKSTLTIGLADALNKIGKKTMIAIREPSLGPVMGIKGGAAGGGYAQVLPMEDINLHFTGDMHAITTANNALSALIDNHLHQGNELGIDQRRILWKRVVDLNDRALRHVTVGLGGPLNGIPREDGFDITVASEIMAILCLATDIEDLKRRLANIVIGYRYDRTPVSVGDLQVEGALALILKDAIKPNLVQTIYGTPAFVHGGPFANIAHGCNSVLATTTALHLADYTVTEAGFGADLGAEKFLDIKTPNLPTSPDAVVIVATLRALKMNGGVAKDALTEENVEAVRAGFANLKRHVENIRKFGIPAVVAINEFVSDTEAEIAVLKELCASIDVPVELASVWADGAEGGVALAETVVKTIAENPANYKRLYDNDLSVQEKIEKIVTEIYRGSKVNFEKKSQTQIAQIVQNGWDKLPICMAKTQYSFSDNPNALGAPENFEITIRELVPKLGAGFIVALTGDVMTMPGLPKRPAALNMDVESDGTVLGLF

SEQ ID NO: 4582 - protein, 79 aa, Streptococcus pneumoniae
LKLTLSEFGNNIQAHFFSDCKQFINKIYTLRKSLQTTSASPCRRYMILTLSVLSTTSKQCFEQPAASFLVCSLIFIEYK

SEQ ID NO: 4583 - protein, 391 aa, Streptococcus pneumoniae
MLDLKEYGIVMWPEEKVISFREKLLAWYDENKRDLPWRRSKNPYHIWVSEIMLQQTRVDTVIPYYERFLDWFPTVESLATAPEESLLKAWEGLGYYSRVRNMQAAAQQIMTDFGGQFPNTYEGISSLKGIGPYTAGAISSIAFNLPEPAVDGNVMRVLARLFEVNHDIGIPSNRKIFQAMMEILINPDRPGDFNQALMDLGSDIESPVNPRPEESPVKDFSAAYQNGTMDRYPIKSPKKKPVPIYLKALVVKNSQGQFLLEKNESEKLLAGFWHFPFIEVDNFSQEEQFDLFHQVAEESVNFGPSPEESFQQDYDLDVDWLDVCFDTVQHVFSHRKWHVQIVAGQVSDFHDFSDREVRWLSPEEFKNYPLAKPQQKIWQAYAQANLDSSQD

SEQ ID NO: 4584 - protein, 234 aa, Streptococcus pneumoniae
MKKILIVDDEKPISDIIKFNMTKEGYEVVTAFNGREALEQFEAEQPDIIILDLMLPEIDGLEVAKTIRKTSSVPILMLSAKDSEFDKVIGLELGADDYVTKPFSNRELQARVKALLRRSQPMPVDGQEADSKPQPIQIGDLEIVPDAYVAKKYGEELDLTHREFELLYHLASHTGQVITREHLLETVWGYDYFGDVRTVDVTVRRLREKIEDTPSRPEYILTRRGVGYYMRNNA

SEQ ID NO: 4585 - protein, 451 aa, Streptococcus pneumoniae
EIMLDLLKQTIFTRDFIFILILLGFILVVTLLLLENRRDNIQLKQINQKVKDLIAGDYSKVLDMQGGSEITNITNNLNDLSEVIRLTQENLEQESKRLNSILFYMTDGVLATNRRGQIIMINDTAKKQLGLVKEDVLNRRILELLKIEENYELRDLITQSPELLLDSQDINGEYLNLRVRFALIRRESGFISGLVAVLHDTTEQEKEERERRLFVSNVSHELRTPLTSVKSYLEALDEGALCETVAPDFIKVSLDETNRMMRMVTDLLHLSRIDNATSHLDVELINFTAFITFILNRFDKMKGQEKEKKYELVRDYPINSIWMEIDTDKMTQVVDNILNNAIKYSPDGGKITVRMKTTEDQMILSISDHGLGIPKQDLPRIFDRFYRVDRARSRAQGGTGLGLSIAKEIIKQHKGFIWAKSEYGKGSTFTIVLPYDKDAVKEEVWEDEVED

SEQ ID NO: 4586 - protein, 269 aa, Streptococcus pneumoniae
MSEIGFKYSILASGSSGNSFYLETSKKKLLVDAGLSGKKITSLLAEINRKPEDLDAILITHEHSDHIHGVGVLARKYGMDLYANEKTWQAMENSKYLGKVDSSQKHIFEMGKTKTFGDIDIESFGVSHDAVAPQFYRFMKDDKSFVLLTDTGYVSDRMAGIVENADGYLIEANHDVEILRSGSYAWRLKQRILSDLGHLSNEDGAEAMIRTLGNRTKKIYLGHLSKENNIKELAHMTMVNQLAQADLGVGVDFKVYDTSPDTATPLTEI

SEQ ID NO: 4587 - protein, 80 aa, Streptococcus pneumoniae
MTTITLKVSEADKTFMKAMAKFEGVSLSELIRTKTLEALEDEYDARVADLAYQEYLEDLEKGVEPITWEEMMHDLGLKDE

SEQ ID NO: 4588 - protein, 87 aa, Streptococcus pneumoniae
MNNLYKLVPTRRFIKQLKKLDRYTQKLITNYLQTNVLEDPRRHGKALVGNRVGQWRYRIGNYRVIVQIVDDELVVATLEVGHRRDIY

SEQ ID NO: 4589 - protein, 257 aa, Streptococcus pneumoniae
LKKKWFFADYYDTTIILLALISVILVLLGFAEMIDLDNPPYSIIDLVIWGVFVIDYSWRFFTTKRKWRFILENIFDLLAILPLNAIFTVFRLGRIFRLAKLTKLLKLTRLLRIIGLTGKLERKISRFLRTNGLIYILYVNIFIVLVGSSILSVVEEKSFSDSLWWALVTVTTVGYGDIVPASIFGKWLAVLLMLVGIGTIGMLTSALTNFFVKDNPDEQIKLDKLKDELSSQRILLEKQSTKIEELHKMIQDLIEKT

SEQ ID NO: 4590 - protein, 169 aa, Streptococcus pneumoniae
LICSDFILFLYKTHSIKFLYLIICVLLCQNLLDFSSAQTLSHLYFYYVFSIKSCIILCSSSIFVDCFSSNILWLDNSSLSLSSFICSSGLSFTKKFVKALVNIPIVPIPTSISKTASHFPKMEAGTISPYPTVVTVTRAHQRLSEKDFSSTTDKIELPTRTIKILTYKI

SEQ ID NO: 4591 - protein, 332 aa, Streptococcus pneumoniae
MFKTMTSTKQHKKVILVGDGAVGSSYAFALVNQGIAQELGIIEIPQLHEKAVGDALDLSHALAFTSPKKIYAAQYSDCADADLVVITAGAPQKPGETRLDLVGKNLAINKSIVTQVVESGFKGIFLVAANPVDVLTYSTWKFSGFPKERVIGSGTSLDSARFRQALAEKLDVDARSVHAYIMGEHGDSEFAVWSHANIAGVNLEEFLKDTQNVQEAELIELFEGVRDAAYTIINKKGATYYGIAVALARITKAILDDENAVLPLSVFQEGQYGVENVFIGQPAVVGAHGIVRPVNIPLNDAETQKMQASAKELQAIIDEAWKNPEFQEASKN

SEQ ID NO: 4592 - protein, 315 aa, Streptococcus pneumoniae
MQDKNLVNVNLTKEMKASFIDYAMSVIVARALPDVRDGLKPVHRRILYGMNELGVTPDKPHKKSARITGDVMGKYHPHGDSSIYEAMVRMAQWWSYRYMLVDGHGNFGSMDGDSAAAQRYTEARMSKIALEMLRDINKNTVDFVDNYDANEREPLVLPARFPNLLVNGATGIAVGMATNIPPHNLGETIDAVKLVMDNPEVTTKDLMEVLPGPDFPTGALVMGKSGIHKAYETGKGSIVLRSRTEIETTKTGRERIVVTEFPYMVNKTKVHEHIVRLVQEKRIEGITAVRDESNREGVRFVIEVKRDASANVILI

SEQ ID NO: 4593 - protein, 118 aa, Streptococcus pneumoniae
QNFLTWSIKPRCMSILFAWFRKNALRVSQQYVMSQTVKVFDLLLKSSATPQPMLFSYNLFKMTQMQTNFGFNMLAIQNGIPKILSLRQILDAYIEHQKEWLFVVHVLIRKKRKRALIS

SEQ ID NO: 4594 - protein, 506 aa, Streptococcus pneumoniae
PLQNDPNANQFWFQYARYPKWYTENFVSSSDFGCLYRAPKRVVVRRTRFDKEKAEARAHILEGLLIALDHIDEVIRIIRASETDAEAQAELMSKFKLSERQSQAILDMRLRRLTGLERDKIQSEYDDLLALIADLADILAKPERVSQIIKDELDEVKRKFSDKRRTELMVGQILSLEDEDLIEESDVLITLSNRGYIKRLDQDEFTAQKRGGRGVQGTGVKDDDFVRELVSTSTHDHLLFFTNKGRVYRLKGYEIPEYGRTAKGLPVVNLLKLDEDESIQTVINVESDRSDDAYLFFTTRHGIVKRTSVKEFANIRQNGLKALNLKDEDELINVLLAEGDMDIIIGTKFGYAVRFNQSAVRGMSRIATGVKGVNLREGDTVVGASLITDQDEVLIITEKGYGKRTVATEYPTKGRGGKGMQTAKITEKNGLLAGLMTVQGDEDLMIITDTGVMIRTNLANISQTGRATMGVKVMRLDQDAQIVTFTTVAVAEKEEVGTENETEGEA

SEQ ID NO: 4595 - protein, 247 aa, Streptococcus pneumoniae
MSQKNNKKKNKRKNLLTNILAGFLILLSLALIFNTQIRNIFIVWNTNKYQVSQVSKEKLEENQDTEGNFDFDSVKAISSEAVLTSQWNAQKLPVIGGIAIPELEMNLPIFKGLDNVNLFYGAGTMKREQVMGEGNYSLASHHIFGVDNANKMLFSPLDNAKNGMKIYLTDKNKVYTYEIREVKRVTPDRVDEVDDRDGVNEITLVTCEDLAATERIIVKGDLKETKDYSQTSDEILTAFNQPYKQFY

SEQ ID NO: 4596 - protein, 265 aa, Streptococcus pneumoniae
MVSSEFISKIEFACNKKESLYSQSKFKYAIRSMFAGAFLTFSTAAGAVGADLINKIAPGSGRFLFPFVFAWGLAYIVFLNAELVTSNMMFLTAGSFLKKISWRKTAEILLYCTLFNLIGALIAGWGFAHSAAYANLTHDSFISGVVEMKLGRSNELVLLEAILANIFVNIAILSFILVKDGGAKLWLVLSAIYMFVFLTNEHIAANFASFAIVKFSVAADSIANFGVGNMLRHWGVTFIGNFIGGGLLMGLPYAFLNKNEDTYVD

SEQ ID NO: 4597 - protein, 371 aa, Streptococcus pneumoniae
LRKPGNIYTRITNPTTAALEGGVEALATASGMTAVTYTILALAHAGEHVVAASTIYGGTFNLLKEPLPRYGITTTFVDVDNLEEVEAAIKDNTKLVLIETLGNPLINIPDLEKLAEIAHKHQIPLVSDNTFATPYLINVFSHGVDIAIHSATKFIGGHGTTIGGIIVDSGRFDWTASGKFPQFVDESPSCHNLSYTHDVGAAAFIIAVRVQLRRDTGAALSPFNAFLLLQRLETLSLRVERHVQNAETIVDFLVNHPKVEKVNYPKLADSPYYALAEKYLPKGVGSIFTFHVKGDEEEARKVIDNLEIFSDLANAADAKSLVVHPATITHGQLSEKDLEAAGVTPNQIHLSIGLENVEDLIEDLRLALEKI

SEQ ID NO: 4598 - protein, 424 aa, Streptococcus pneumoniae
MNEIKCPNCGEVFTVNESQYAELLSQVRTAEFDKELHDRMRQELALAEQKAMNEQQTKLAQKDQEIAQLQSQIQNFDTEKELAKKEVEQTSHQALLAKDKEVQALENQLATLRLEHENQLQKTLSDLEKERNQVKNQLLLQEKENELSLASVKQNYEAQLKAASEQVEFYKNFKAQQSTKAIGESLEQYAESEFNKVRSFAFPNAYFEKDNKVSSRGSKGDFIFRECDENGVEIISIMFEMKNEADGTEKKHKNADFYKELDKDRREKNCEYAVLVTMLEADNDYFNTGIVDVSHEYEKMYVVRPQFFIQLIGLLRNAALNSLKYKQELALVREQNIDITHFEEDLDAFKLAFAKNYNSASTNFGKAIDEIDKAIKRMEEVKKFLTTSENQLRLANNKLEDVSVKKLTRKNPTMKAKFEALKGE

SEQ ID NO: 4599 - protein, 292 aa, Streptococcus pneumoniae
MNGIINLKKEAGMTSHDAVFKLRKILGTKKIGHGGTLDPDVVGVLPIAVGKATRMVEFMQDEGKIYEGEITLGYSTTTEDASGEVVAETPVLSPLDEKLVDEAIASLTGPITQIPPMYSAVKVNGRKLYEYARAGQEVERPERQVTIYQFERTSPISYDGQLARFTFRVKCSKGTYIRTLSVDLGEKLGYAAHMSHLTRTSAAGLQLEDALSLEEIAEKVEAGQLDFLHPLEIGTGDLVKVFLTPEEATEVRFGRFIELDQTDKELAAFEDDKLLAILEKRGNLYKPRKVFS

SEQ ID NO: 4600 - protein, 100 aa, Streptococcus pneumoniae
MMRNEFRERVEQLLQQKEINENSELSHLFRLAIQNLDRNEKYQSVMANLSQGLSLYLMTHHYQAPKSVIDFGLWIAKAPSQERGRLAFLQMLAQTLQGFR

SEQ ID NO: 4601 - protein, 238 aa, Streptococcus pneumoniae
VFFADETINFVKNVIKYTTDKITEDSMQNKPIIIGVTGGSGGGKTSVSTTILSHFPDEKISMIEHDSYYKDQSHLTFEERVKTNYDHPFAFDTDLMIEQIKELLAGRPVDIPTYDYTEHTRSSKTYRQEPQDVFIVEGILVLEDKRLRDLMDIKIFVDTDDDVRIIRRIKRDMEERGRSLDSVINQYLGVVKPMYHQFIESTKRYADIVIPEGVSNTVAIDLLTTKIAKILEEARNSK

SEQ ID NO: 4602 - protein, 446 aa, Streptococcus pneumoniae
MEKYLSVTTLTKYLKMKFDKDPYLERVYLTGQVSNFRKRPTHQYFSLKDDHAVIQATIWSGIYQKLGFDLEEGMKINVIGRVQVYEPSGSYSIIIEKAEPDGVGALAIQFEQLKKKLTEEGLFQERFKQALPQFSKRIGVVTSRSGAVIRDIITTVSRRFPGVDILLYPTKVQGEGAAEEIARNIARANQWDDLDLLIIGRGGGSIEDLWAFNEEIVVRAIFESRLPVISSVGHETDVTLADFVADRRAATPTAAAELATPVTKLDVLAHLQNQEKRMVTAVRNVLSKKQEALKKCSQSVIFRQPERLYDGYLQRLDQLQLRLKQSLRTRISDNKQLVQARTHQLVQLSPVTKIQRYQDRLGQLDKLLGSKMALVYDAKVAEVKRLSEALLMLDTSRIVARGYAIVKKEESVVDSVESLKRKDQVTLLMRDGQVELEVKDVKTKEI

SEQ ID NO: 4603 - protein, 70 aa, Streptococcus pneumoniae
MSKQKKFEENLAELETIVQSLENGEIALEDAITAFQKGMVLSKELQATLDKAEKTLVKVMQEDGTESDFE

SEQ ID NO: 4604 - protein, 291 aa, Streptococcus pneumoniae
MKKQEKLALVESALEDFYGDQQFASSLRESVLYSIHAGGKRIRPFLLLEVLEALQVTIKPAHAQVATALEMIHTGSLIHDDLPAMDDDDYRRGRLTNHKKFGEAMAILAGDALFLDSYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQIPFETESIVSVVESLRING

SEQ ID NO: 4605 - protein, 245 aa, Streptococcus pneumoniae
MAGLVVAVLNGERFDKPGEKIPDDTELKLKGEKLKYVSRGGLKLEKALQVFDLSVDGATTIDIGASTGGFTDVMLQNSAKLVFAVDVGTNQLAWKLRQDPRVVSMEQFNFRYAEKTDFEQEPSFASIDVSFISLSLILPALHRVLADQGQVVALVKPQFEAGREQIGKNGIIRDAKVHQNVLESVTAMAVEVGFSVLGLDFSPIQGGHGNIEFLAYLKKEKSASNQILAEIKEAVERAHSQFKNE

SEQ ID NO: 4606 - protein, 143 aa, Streptococcus pneumoniae
MNKKERLEKIRRLVTDYQIGTQEEIVEHLKEAGITATQATVSRDIKELGIVKIPLRDNTYVYELPKSIVKSLQLAEDNIESAELMDKMINLQVIPGNTAFVKAQLIDTFADKIFSCLTDDSSILVIARSGSLAEEIFEQVKNW

SEQ ID NO: 4607 - protein, 298 aa, Streptococcus pneumoniae
MLLEISIKNFAIIEAISLNFEKGMTVLTGETGAGKSIIIDAMNMMLGARATTDVIRHGAPKAEIEGLFSVENSRLLQEIFDEQGLELGDEIIIRREILQNGRSISRVNGQMVNLSVLRAIGQHLVDIHGQHDHEELMRPQLHIQMLDEFGDAAFWDLKETYQTSFDAYRKMRKQVLEVKKNQQEHKARIEMLEFQMAEIEAANLQAGEDLDLNQERDKLLNHKNIADTLTNAYSMLDNEDFSSLANVRSAMNDMESVEEYDPEYREISSSLSETYYVLEDISKRLEAIIEDLDFDGNR

SEQ ID NO: 4608 - protein, 260 aa, Streptococcus pneumoniae
WQSLMQVENRLDLLHTITRKYGGTVDDVLLYFAKITEEYNLLTGNNLSSEDMEAELKKLEVNLVNLAGQLASARHNLAQQLEAEIKQELQDLYMEKAQFQVRFSKGKFSREGNEMVEFYISTNPGEDFKPLVKVASGGELSRLMLAIKSAFSRKEGKTSIVFDEVDTGVSGRVAQAIAQKIHKIGQYGQVLAISHLPQVIAIADYQFFIEKISNDHSTVSTVRLLTVEERVEEVAKMLAGDDVTEAALTQARELLRNREK

SEQ ID NO: 4609 - protein, 242 aa, Streptococcus pneumoniae
MTDYYVIGDVHGKAGMLEDLLKTWDGQTQLLFLGDLIDRGEDSHRVLEMVKDLVDNQGAICLSGNHEYMFLTWLDYPEESYDHYRRNGGDTTINSILGRPLDAPVDGVEDAKRVAAEAADLVEFIRQMPFVVETDKYIFVHAGIDLTLDDWHETTDYKKVWLRKPFHGAENHTGKTIVFGHTPVYGLLQQERGTSELWTTEDGKIGMDGGAVYGGVLHGIVFTDQGMTEHHFIENDGFVAED

SEQ ID NO: 4610 - protein, 344 aa, Streptococcus pneumoniae
MVLSKYQKQFIINRYPERKRIMNLEELKKRQRKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEIMPIINKIDLPAADPERVRTEIEDVIGLDASEAVLASAKAGIGIEEILEQIVEKVPAPTGDVTAPLKALIFDSVYDAYRGVILQVRVMDGVVKPGDKIQLMSNSKTFDVAEVGIFTPKAVGRDFLATGDVGYIAASIKTVQDTRVGDTVTLATNPAAEPLHGYKQMNPMVFAGLYPIESNKYNDLREAA

SEQ ID NO: 4611 - protein, 303 aa, Streptococcus pneumoniae
LRVSTQSNQTNTMTCVKPLEKLQLNDASLQFEPETSQALGFGFRCGFLGLLHMDVIQERLEREFNIDLIMTAPSVIYKVNLTDGESMDVSNPSEFPDPTKIATIEEPYVKAQIMVPQEFVGAVMELAQRKRGDFVTMDYIDDNRVNVIYQIPLAEIVFDFFDKLKSSTRGYASFDYELSEYRPSKLVKMDILLNGDKVDALSFIVHKDFAYERGKLIVDKLKKIIPRQQFEVPIQAAIGHKIVARTDIKALRKNVLAKCYGGDVSRKRKLLEKQKAGKKRMKSIGSVEVPQEAFLSVLSMDEE

SEQ ID NO: 4612 - protein, 110 aa, Streptococcus pneumoniae
MKIKEQTRKLAAGCSKHSFEVVDETDEVSSKHGFEVVDETDEVSSKHGSEVVDETDEVSSKHGFEVVDETDEVSSKHGFEIVDETDEVSNHTYGKATLTWFEEIFEEYKN

SEQ ID NO: 4613 - protein, 111 aa, Streptococcus pneumoniae
LYSSKISSNHVSVALPYVWLLTSSVSSTISKPCFELTSSVSSTTSKPCFELTSSVSSTTSEPCFELTSSVSSTTSKPCFELTSSVSSTTSKLCFEQPAASFLVCSLIFIEY

SEQ ID NO: 4614 - protein, 95 aa, Streptococcus pneumoniae
GLGVKKQKACFSAIEEVIMYKHLFFLDSKTLDRLTPYILVLASDTIAFNVFVLTFVSAVVFNFLNSMLALMAIFIGAGYVVGFWLLILNENQRAN

SEQ ID NO: 4615 - protein, 229 aa, Streptococcus pneumoniae
MKKYQLLFKISAVFSYLFFVFGLSQLTLIVQNYWQFSSQIGNFVWIQNILSLLFSGVMIWILVKTGHGYLFRIPRKKWLWYSILTVLVVVLHISFNVQTAKHVQSTAEGWNVLIGYSGTNFAELGIYVTLFFLTPLMEELIYRGLLQHAFFKHSRFGLDLLLPSILFALPHFLSLPSLLDIFVFATFGIIFAGLTRYTKSIYPSYAVHVINNIVATFPFLLTFLHRVLG

SEQ ID NO: 4616 - protein, 59 aa, Streptococcus pneumoniae
MREDFYEKVSTSIQNKCSLLLLIFRIWSFSADAYRPKLLAIFFPDWQFRLDSKYLEFTI

SEQ ID NO: 4617 - protein, 81 aa, Streptococcus pneumoniae
VIYYMDTKMMSQFSVMDNEMLVRTEDGDVSDIYRGYANQRSPFASYPSILKNSGPFPVSGYCLRGYHDRGYIGAGFHLCGI

SEQ ID NO: 4618 - protein, 69 aa, Streptococcus pneumoniae
MKAIFFIILFAFQTYLIYLSISISDKKQKTIELTSLNCFVILFLIYDKLIFLFIAYVFLIIFILNLFRN

SEQ ID NO: 4619 - protein, 67 aa, Streptococcus pneumoniae
MNTYCNINETMLSEVYGGNSGGAAVVAALGCAAGGVKYGRLLGPWGAAIGGIGGAVVCGYLAYTATS

SEQ ID NO: 4620 - protein, 84 aa, Streptococcus pneumoniae
MDTKIMEQFHEMDITMLSSIEGGKNNWQTNVLEGGGAAFGGWGLGTAICAASGVGAPFMGACGYIGAKFGVALWAGVTGATSGF

SEQ ID NO: 4621 - protein, 55 aa, Streptococcus pneumoniae
MYPHAPINGAPTPLAAQIAVPNPQPPKAAPPPSKTLVCQLFLPPSILDNIVISIS

SEQ ID NO: 4622 - protein, 181 aa, Streptococcus pneumoniae
LMRRKYKSIALKKELANYSGKKKCHAMKAQAIVTSQGRIVSLDITVNYCHDMKLFKMSRRNIGQAGKILTDSDYQGPMKIYPQAQTPRKASKLKPLTAEDKACNHALSKDRSKVENILAKVKTFKMFSTTYRNHRKRFGLRMNLIAGIINHELGFWFRRKSNVIFAIQDVSMTIQDLDEKF

SEQ ID NO: 4623 - protein, 132 aa, Streptococcus pneumoniae
LIYPVLISFYYSSMNYEGSKQLTDARFKCLVGVQRTTFEEMLAVLKTAYQLKHAKGGRKPKLSLEDLLMATLHYVREYRTYEEIAADFGIHESNLLRRSQWVEVTLVQSGVTISRTPLSSEDTVMIIDATEV

SEQ ID NO: 4624 - protein, 54 aa, Streptococcus pneumoniae
MKKKILIIFILYLIMSIFLYPLRESIWYQLFYTIAYVIAVMIYFALTKKKGAKK

SEQ ID NO: 4625 - protein, 67 aa, Streptococcus pneumoniae
MEKIDYITLNEVELETISGGDDCFIGDIGCIGWGLLKSIGGMIKPAPYVPPVCIPKSSWNPAPPVPC

SEQ ID NO: 4626 - protein, 68 aa, Streptococcus pneumoniae
MLQVALLIQQLMILRINAGKILISGSVFVYRYSSVVLYKNLYNLMTYAVIETILLQTSRLFCYKFTCS

SEQ ID NO: 4627 - protein, 67 aa, Streptococcus pneumoniae
MNTKMMEQFSVMDNEMLDRIEGGIFGVDDALFWAGLGYVAGSIVDTAIDDFTNQCRKNPHQWFCVRV

SEQ ID NO: 4628 - protein, 72 aa, Streptococcus pneumoniae
LSCCNFDKFSISLFFNFFHPNLELASKRLELAFLFQATSKCLKKIISNHFFTIQEVLMTIQDFIKYELSFMA

SEQ ID NO: 4629 - protein, 717 aa, Streptococcus pneumoniae
MTSYKRTFVPQIDARDCGVAALASIAKFYGSDFSLAHLRELAKTNKEGTTALGIVKAADEMGFETRPVQADKTLFDMSDVPYPFIVHVNKEGKLQHYYVVYQTKKDYLIIGDPDPSVKITKMSKERFFSEWTGVAIFLAPKPSYQPHKDKKNGLLSFLPLIFKQKSLIAYIVLSSLLVTIINIGGSYYLQGILDEYIPNQMKSTLGIISVGLVITYILQQVMSFSRDYLLTVLSQRLSIDVILSYIRHIFELPMSFFATRRTGEIISRFTDANSIIDALASTILSLFLDVSILILVGGVLLAQNPNLFLLSLLSIPIYMFIIFSFMKPFEKMNHDVMQSNSMVSSAIIEDINGIETIKSLTSEENRYQNIDSEFVDYLEKSFKLSKYSILQTSLKQGTKLVLNILILWFGAQLVMSSKISIGQLITFNTLFSYFTTPMENIINLQTKLQSAKVANNRLNEVYLVESEFQVQENPVHSHFLMGDIEFDDLSYKYGFGRDTLTDINLTIKQGDKVSLVGVSGSGKTTLAKMIVNFFEPYKGHISINYQDIKNIDKKVLRRHINYLPQQAYIFNGSILENLTLGGNHMISQEDILRACELAEIRQDIERMPMGYQTQLSDGAGLSGGQKQRIALARALLTKAPVLILDEATSGLDVLTEKKVIDNLISLTDKTILFVAHRLSIAERTNRVIVLDQGKIIEVGSHQELMQAQGFYHHLFNK

SEQ ID NO: 4630 - protein, 82 aa, Streptococcus pneumoniae
MIFPWSRTMTRLVRSAILRRWATKRMVLSVRDIRLSITFFSVKTSRPLVASSSIKTGALVKRARARAIRCFCPPDRPAPSES

SEQ ID NO: 4631 - protein, 453 aa, Streptococcus pneumoniae
MNPNLFRSVEFYQRRYHNYATVFIIPLSLLFTFILIFSLVATKEITVTSQGEIAPTSVIASIQSTSDNPILANHLVANQVVEKGDLLIKYSETMEESQKTALATQLQRLEKQKEGLGILKQSLEKATDLFSSEDEFGYHNTFMNFTKQSHDIELGISKTNTEVSNQANLTNSSSSAIEQEITKVQQQIGEYQELRDAIINNRARLPTGNPHQSILNRYLIASQGQTQGTAEEPFLSQINQSIAGLESSIASLKIQQAGIGSVATYDNSLATKIEVLRTQFLQTASQQQLTVENQLTELKVQLDQATQRLENNTLTAPSKGIVHLNSEFEGKNRIPTGTEIAQIFPVITDTREVLITYYVSSDYLPLLDKGQTVRLKLEKIGNHGTTIIGQLQSIDQTPTRTEQGNLFKLTALAKLSNEDSKLIQYGLQGRVTSVTTKKTYFDYFKDKILTHSD

SEQ ID NO: 4632 - protein, 66 aa, Streptococcus pneumoniae
HSITIYYLIKKENHNMDKKQNLTSFQELTTTELNQIIGGGWWEDFLYRFNIIEQKNTKGFYQPIQL

SEQ ID NO: 4633 - protein, 109 aa, Streptococcus pneumoniae
LNKKIQKDFISQYNYKKTRPRERTLGLIFSSFYMYYSKYLTKNVILAGGIETGIGMTFHNFHNGIETNSSLLPFRTCSKGEDFRNIDSLFFDGIFNDKGLLCSIFKKGN

SEQ ID NO: 4634 - protein, 446 aa, Streptococcus pneumoniae
MNVAWILLYTLVTHGLKIVIFFKVDGISLTFERIFKAFLFKILLAVVFGMLGYMVGNVYLSYFMEPLYGIGLSFLLLRELPKKLLLFYGLFPMILVNLFYRGVSYFVLPFLGQGQVYDDYSFIWLCIIIFNFFISLAFLKWLDYDFTSLRKGILDKDFQKSLTQINWIMGAYYLVIQNLSYFEYEQGIQSTTVRHLILVFYLLFFMGIIKKLDTYLKDKLHERLNQEQDLRYREMERYSRHIEELYKEVRSFRHDYTNLLTSLRLGIEEEDMEQIKEIYDSVLKDSSEKLQDNKYDLGRLVNVRDRALKSLLAGKFIKARDKNIVFNVEVPEEIQVEGVSLLDFLTVVSILCDNAIEASVEACQPHVSIAFFKNGAQETFIIENSIKEEGIDISEIFSFGASSKGEERGVGLYTVMKIVESHPNTSLNTTCQDHVFRQVLTVIHIE

SEQ ID NO: 4635 - protein, 214 aa, Streptococcus pneumoniae
VLLKFLVSQINCWQRCMRRGAHQLFFLDIEIRNEEMKGLEVARKIRDRDPYALIVFVTTHSEFMPLSFRYQVSALDYIDKALSAEEFESRIETALLYANGQDSKSLAEDCFYFKSKFAQFQYPFKEVYYLETSTRPHRVILYTKTDRLEFTASLEEVLKQEPRFLQCHRSFLINPANVVHLDKKEKLLFFPNGGSCLIARYKVREVSEAINNLH

SEQ ID NO: 4636 - protein, 60 aa, Streptococcus pneumoniae
MRIFVLEDDFSQQTRIETTIEKLLKEHHITLSSFEVFGKPDQLLAEVHEKGGPSAILFGY

SEQ ID NO: 4637 - protein, 112 aa, Streptococcus pneumoniae
MKHMIIQTQKTVYKVNVDDVYYIQTHPTKAHTVKIVTEEASFNMVQNLSNLENQYGETLMRCHRNCLVNLDKVKSIDFQERILFLGEEGQYAVKYARRRYREIRQKWLKEGE

SEQ ID NO: 4638 - protein, 109 aa, Streptococcus pneumoniae
MTDTDPIKRAQTLITDLNKAYQACKQATADDVRFQEQLNSILGFLAKAETVDNRFLIELEKFYQTSSLLMGLSALDPDAPTRAAWRAYDRFHFDQVKTKLILNENQRAN

SEQ ID NO: 4639 - protein, 68 aa, Streptococcus pneumoniae
PQAVLEYGETTLTWFEEIFEEYKSLRTNHYPVVTKKKLRQTELNFFFSVVSAMLVLHLTFYLIRRIQD

SEQ ID NO: 4640 - protein, 323 aa, Streptococcus pneumoniae
PLCLVPACPVGLSSYQYSQLLQHFPENHWPILLFVGITSVLLLLWGGIATYMEAPDKLFLLVGEEEIKLHLKRQTGISLVFWLFVQTLFLLLFAPLFLAMGYGLPVFLLYVLLLGVGKYFHFRQKASKFFTETGLDWDYLISQESKRKQVLLRFFALFTQVKGISNSVKRRAYLDFILKAVQKVPGKIWQNLYLRSYLRNGDLFALSLRLLLLSVLAQVFIEQAWIATAVVVLFNYLLLFQLLALYHAFDYQYLTQLFPLDKGQKEKGLQEVVRGLTSFVLLVEVVVGLITSQEKLALLALLGAGLVLLVLYSPYQVKRQMQD

SEQ ID NO: 4641 - protein, 73 aa, Streptococcus pneumoniae
MIFTMAHDQRGGSMKDLFLKRKQAFRKECLGYLRYVLNDHFVLFLLVLLGFLATSTVNSYNIFLKIIGLSFCL

SEQ ID NO: 4642 - protein, 114 aa, Streptococcus pneumoniae
AKSGFRTSRALVKNVPFGQKLDWFPVHFSKGMKQKVMIICAFVVDPSLFIVDEPFLGLDPLAISDLIQLLEVEKQKGKSILMSTHVLDSAEKMCDAFVILHKGEVRANNSPATT

SEQ ID NO: 4643 - protein, 125 aa, Streptococcus pneumoniae
MLEIKNLTGGYVHVPVLKDVSFTVESGQLVGLIGLNGAGKSTTINEIIGLLAPYSGSININGLTLQGDATSYRKQIGYIPETPSLYEELTLREHIETVAMAYGIEQKVAFERVEPLLKMFRLDRN

SEQ ID NO: 4644 - protein, 136 aa, Streptococcus pneumoniae
MSDCIFCKIIAGEIPASKVYEDEQVLAFLDISQVTLGHTLVVPKEHYRNLLEMNATSASQLFAQVPKVAQKVMKVTKAAGMNIISNCEEVAGQTVFHTHVHLVPRYSADDDLKIDFIAHEPDFDKLAQVAETIKNA

SEQ ID NO: 4645 - protein, 95 aa, Streptococcus pneumoniae
MKLSNLLLFAGAAAGSYLVTKNRQTITDEVLNTTDRVQAIKDDVDIIQNSLQIIDQQKELIKEYQEDLTYKFKVLEKDIQTRLAVIKEMQGTEDK

SEQ ID NO: 4646 - protein, 84 aa, Streptococcus pneumoniae
LLEITLKSSYQFVHILFQSTIYIPSTMHHNLGNSYSIKIKKQTRKLGTDCSKHRFKVVDRTDEVSSKHCFEVVDTTHIYTTRQR

SEQ ID NO: 4647 - protein, 378 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGGLKVNPKKKGFFDHIKDAFDGE

SEQ ID NO: 4648 - protein, 46 aa, Streptococcus pneumoniae
LREEPPPPKKLEKISSKPPKPPAPLKPPKPPAPPKPPLAPAAPYWS

SEQ ID NO: 4649 - protein, 118 aa, Streptococcus pneumoniae
MSVLDEEYLKNTRKVYNDFCNQADNYRTSKDFIDNIPIEYLARYREIILAEHDSCVKNDEAVRNFVTSVLLSAFVSAMVSAMISLEIQTYKFVIPFIIGMIWTVVVFLMINWNYIGKY

SEQ ID NO: 4650 - protein, 85 aa, Streptococcus pneumoniae
LIIRNTTTVQIIPIMNGITNLYVCISNDIIADTIADTNADNNTEVTKFLTASSFLTQLSCSANIISLYLAKYSIGILSIKSFDVL

SEQ ID NO: 4651 - protein, 607 aa, Streptococcus pneumoniae
MSKIIGIDLGTTNSAVAVLEGTESKIIANPEGNRTTPSVVSFKNGEIIVGDAAKRQAVTNPDTVISIKSKMGTSEKVSANGKEYTPQEISAMILQYLKGYAEDYLGEKVTKAVITVPAYFNDAQRQATKDAGKIAGLEVERIVNEPTAAALAYGLDKTDKEEKILVFDLGGGTFDVSILELGDGVFDVLSTAGDNKLGGDDFDQKIIDHLVAEFKKENGIDLSTDKMAMQRLKDAAEKAKKDLSGVTSTQISLPFITAGEAGPLHLEMTLTRAKFDDLTRDLVERTKVPVRQALSDAGLSLSEIDEVILVGGSTRIPAVVEAVKAETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVSVKAKDLGTQKEQTIVIQSNSGLTDEEIDRMMKDAEANAESDKKRKEEVDLRNEVDQAIFATEKTIKETEGKGFDAERDAAQAALDDLKKAQEDNNLDDMKAKLEALNEKAQGLAVKLYEQAAAAQQAQEGAEGAQATGNAGDDVVDGEFTEK

SEQ ID NO: 4652 - protein, 119 aa, Streptococcus pneumoniae
RTWISTAGWLSAAVEKTCDLDVGIVVLRSISFVNTPPIVSIPSDNGVTSRRTTSLTSPVITPPWIAAPIATTSSGFTDLFGSLPVSALTASTTAGIRVEPPTRITSSISDKLKPASERA

SEQ ID NO: 4653 - protein, 217 aa, Streptococcus pneumoniae
LYLSYTPLPLLGVGCGHGVCSLFERLGRWYLLGVHRLLGEFGWPYGSYGQIRHLLRFLQFLLLSKRESSFLAPSPSPSSHHLSNLQLQVHAQGCQEMVRLLLPSPGYDNVASFDVLHWHGVGYFAFLHEREDICFRTHLHVHLPSPTQTFQELFLQLFPQLPLLELLLLLHFLYLGPCSPPLMISILMYFIMITAEVAVKICQLHGQNTVDHIDLID

SEQ ID NO: 4654 - protein, 182 aa, Streptococcus pneumoniae
LKSLKEANMAQDIKNEEVEEVQEEEVVETAEETTPEKSELDLANERADEFENKYLRAHAEMQNIQRRANEERQNLQRYRSQDLAKAILPSLDNLERALAVEGLTDDVKKGLGMVQESLIHALKEEGIEEIAADGEFDHNYHMAIQTLPADDEHPVDTIAQVFQKGYKLHDRILRPAMVVVYN

SEQ ID NO: 4655 - protein, 355 aa, Streptococcus pneumoniae
VLIDQTERSDEMVTERQQDILNLIIDIFTKTHEPVGSKALQESINSSSATIRNDMAELEKQGLLEKAHTSSGRMPSVAGFQYYVKHSLDFDRLAENEVYEIVKAFDQEFFKLEDILQEAANLLTDLSGCTVVALDVEPSRQRLTAFDIVVLGQHTALAVFTLDESRTVTSQFLIPRNFLQEDLLKLKSIIQERFLGHTVLDIHYKIRTEIPQIIQRYFTTTDNVIDLFEHIFKEMFNENIVMAGKVNLLNFANLAAYQFFDQPQKVALEIREGLREDQMQNVRVADGQESCLADLAVISSKFLIPYRGVGILAITGPVNLDYQQLINQVNVVNRVLTMKLTDFYRYLSSNHYEVH

SEQ ID NO: 4656 - protein, 169 aa, Streptococcus pneumoniae
MNSRVEFRIFTIVDLDKEEEYLHEMHLKGWRYRTSRFGLFYFDQCQPDDVIYRIYDSRFLKKYKHELQDFRDRGWELIGAGSCSILRKSSSDLLPEDQVYMSKGLKWEVMRSRLRSCTTTFLGGLVVCTSLFREDLSMSFFLIFVLYAFLISYLIHGYFRLKRKYRVDE

SEQ ID NO: 4657 - protein, 777 aa, Streptococcus pneumoniae
MVEFIKSKKEMSEEDIKANFITPAIVSKGWKNGEHIAYEEYFTDGRIEVRGDKARRKEGKKSDYSLYYQFGTRIAIVEAKDNKHSVRAGLQQAIEYGEILDVPFVYSSNGDGFIEHDRITREERELELDEFPTREELFSRMTKEKGLTYEITEAISTPYYTDAFSMKTPRYYQQIAINRTIETVARGQKRVMFVMATGTGKTFMAFQIIHRLRKAGLAKRVLFLADRNILVDQTMAEDFRPFEKVMTKITPKLLTAPEKLNSFEIYLGLYQQLTGEDGTETHYQKFDKDFFDLIVIDEAHRGSAKENSNWRKIIDYFSSATQIGMTATPKETKNASNTEYFGEPIYTYSLKQGIEDGFLAPYRVMRVNLDVDVDGYRPETGKVDANGQLIEDRYYGRKDFDKTIVIDDRTQRVAKFVSDYMKQNNARFDKTIVFCVDIDHAERMRAALVKENLDLVQEDYRYVMQVTGDNAEGKAQLDNFMDVNSNFPAIVTTSKLLTTGVNAKTCRLIVLDSNIQSMTEFKQIIGRGTRLYPQKGKEFFTIIDFRNVTNLFADPDFDGDPVKVLETGAKTVSGSTPGFVGEEGDPVEKYIVTDKQVTILNSTVQVLDENGKLITESLTDYTRKNILGSYATLNDFITVWHTADKKKLILDELYKKGVYLDAIRESEGISEQEIDDFDLLLKLAYGQKELTKTERINKLKQSGYLYKYSEEARAVLEILLNKYMDKGIGELESIETLKLPEFQIYGGTFKIINTYFGDKKRYLQAIKELEQELFTVA

SEQ ID NO: 4658 - protein, 487 aa, Streptococcus pneumoniae
MSITSFVKRIQDITRNDAGVNGDAQRIEQMSWLLFLKIYDSREMVWELEEDEYESIIPEELKWRNWAHAQNGERVLTGDELLDFVNNKLFKELKELEITSNMPIRKTIVKSAFEDANNYMKNGVLLRQVINVIDEVDFNSPEDRHSFNDIYEKILKDIQNAGNSGEFYTPRAATDFIAEVLDPKLGESMADLACGTGGFLTSTLNRLSSQRKTSEDTKKYNTAVFGIEKKAFPHLLAVTNLFLHEIDDPKIVHGNTLEKNVREYTDDEKFDIIMMNPPFGGSELETIKNNFPAELRSSETADLFMAVIMYRLKENGRVGVILPDGFLFGEGVKTRLKQKLVDEFNLHTIIRLPHSVFAPYTGIHTNILFFDKTKKTEETWFYRLDMPDGYKNFSKTKPMKSEHFNPVRDWWENREEILEGKFYKSKSFTPSELAELNYNLDQCGFPKEEEEILNPFELIQNYQAERATLNHKIDNVLADILQLLEDK

SEQ ID NO: 4659 - protein, 516 aa, Streptococcus pneumoniae
MTPEQLKASILQRAMEGKLVPQNPNDEPASELLKRIKAEKEKLISEGKIKRDKKETEIFRGDDGKHYGKFADGSTQEIDVPYDIPDTWEWVRIKSIYWNFGQNKPEKSFRYIDTSSIDRKKNIINYKNLQYLSPEQAPSRARKLVSQNSVLFSTVRPYLKNIAVVRELKEYLIASTAFIVLDTLLNETYLKYYLLSDNFINRVNNKSTGTSYPAINDYNFNLLLIALPPLSEQQRIVEAIESALEKVDEYAESYNRLEQLDKEFPDKLKKSILQYAMQGKLVEQDPNDESVEVLLEKIRAEKQKLFEEGKIKKKDLDISIVSQGDDNSYYGNKDETTSYPIYKIPEAWRYIKFASLVNFRIGKTPPRSEATFWGTEIPWVSISDMPISGYVTNTRESISKLALKSKKIDISPKGTLLMSFKLSIGKVAILDIPATHNEAIISIFPYANKENIIRDYLMIFLPLISTLGDSKDAITGKTLNSTSISELLIPISNHEEMKRIIFKVDLLFQKVSQLFE

SEQ ID NO: 4660 - protein, 429 aa, Streptococcus pneumoniae
VRFSTLVEIVRGGSPRPIKDYLTSEVDGINWIKIGDTEKGEKYINNVKEKIKKSGLNKTRFVKKGTFLLTNSMSFGRPYILNVDGAIHDGWLAISNYENSLNKDYLFYILSSNVVYSQFLSLISGAVVKNLNSDKVASILIPLPPLSEQQRIIEAIESALEKVDEYAESYNRLEQLDKEFPDKLKKSILQYAMQGKLVEQDPNDESVEVLLEKIRAEKQKLFEEGKIKKKDLDISIVSQGDDNSYYGNIPMNWVVIKIKDIFSMNTGLSYKKGDLSINNKGVRIIRGGNIKPLEFSLLDNDYYIDTQFISSEQVYLKHNQLITPVSTSLEHIGKFARIDKDYDGVVAGGFIFQLTPFESSEIISKFLLFNLSSPLFYKQLKAITKLSGQALYNIPKTTLSELLIPLAPFEEQELITQKVEKLFEKVNQL

SEQ ID NO: 4661 - protein, 73 aa, Streptococcus pneumoniae
SICLHLISIYYIISINDDGDCFVCACRFLNPDRAEEYFCRGCQGENPEDIEFYDEQLQAEKVEVLNIRLEVKN

SEQ ID NO: 4662 - protein, 448 aa, Streptococcus pneumoniae
MPITAADIRREVKEKNVTFIRLMFSDILGTMKNVEIPATDEQLDKVLSNKVMFDGSSIEGFVRINESDMYLYPDLDTWTVFPWGDENGSVAGLICDVYTTEGEPFAGDPRGNLKRALRHMEEVGFKSFNLGPEPEFFLFKLDENGDPTLEVNDKGGYFDLAPTDLADNTRREIVNVLTKMGFEVEASHHEVAVGQHEIDFKYDEVLRACDKIQIFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 4663 - protein, 118 aa, Streptococcus pneumoniae
MKEKEFRRNMAVFPIGSVMKLTDLSARQIRYYEDQELIKPDRNEGNRRMYSLNDMDRLLEIKDYISEGYNIAAIKKKYAEREAKSKKAVSQTEVRRALHNELLQQGRFASVQSPFGRG

SEQ ID NO: 4664 - protein, 175 aa, Streptococcus pneumoniae
MSYFKKYKFDKSQFKLGMRTFKTGIAVFLVLLIFGFFGWKGLQIGALTAVFSLRESFDESVHFGTSRILGNSIGGLYALVFFLLNTFFHEAFWVTLVVVPICTMLTIMTNVAMNNKAGVIGGVAAMLIITLSIPSGETILYVFVRVLETFMGVFVAIIVNYDIDRIRLFLEKKEK

SEQ ID NO: 4665 - protein, 125 aa, Streptococcus pneumoniae
LFIKSYFSVKAASPGRTLPSRSSIDAPPPVLIHENLSARPRLIAAAAESPPPMIDLTPGCFTIASITPIVPAWKSGFSNTPIGPFHTTVLAPVKASSNLAIDFGPMSRPRKPSETASPSVSRTSV

SEQ ID NO: 4666 - protein, 398 aa, Streptococcus pneumoniae
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 4667 - protein, 1646 aa, Streptococcus pneumoniae
MKNPFFERRCRCSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVQAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEFNFDVLVSPKAALNDEYLKQKLAEVEAAKNKVVYNFASPEVKAAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 4668 - protein, 170 aa, Streptococcus pneumoniae
LISFGFNVFSVFLGTSGWTSFSVLLASAAGLDSSPWLVASGFASVSLSDLGFASADGVSATTSLAFSSGLAALAASAVSDAVATPSAFSSLFSLVCSPSFCLSASLVECSLSPETSSVLAPLFSGTAVSSAKAGPANKTAPIISEQAPTDNLRILQRQRLSKNGFFIFSS

SEQ ID NO: 4669 - protein, 543 aa, Streptococcus pneumoniae
MSINWQEILFHFLGGLGLFLYSIKTMGDGLQQAAGDRLRFYIDKYTSNPFFGVLVGIGMTALIQSSSGVTVITVGLVSAGLLTLRQAIGIVMGANIGTTVTSFLIGFKLGNYALPMLFIGAVCLFFTKNRTVNNIGRILFGVGGIFFALNLMSGAMAPLKDLQVFKDYMIELSKNPVLGVFVGTGLTLLIQASSATIGILQNLYAGNLIDLQGALPVLFGDNIGTTITAIIASLGANIAAKRVAGAHVAFNVIGTVVCVIFLVPFTVLIHWFEATLNLAPEMTIAFAHGTFNITNTIVQFPFIGALAYFVTKIIPGEDEVVKYEPLYLDEHFIKQAPSIALGNAKKELLHLGNYAAKAFDLSYKYIIDLDEKVAEKGHKTEEAINTIDEQLTRYLIALSSEALSQKESEVLTNILDSSRDLERIGDHTEALLNLTDYLQRKNVEFSDAALKELEEVYRQTSDFIKDALDSVENNDIEKARSLVERHEAINKIERVLRKTHIKRLNKGECSTQAGVNFIDIISHYTRVSDHAMNLAEKVFAEQI

SEQ ID NO: 4670 - protein, 535 aa, Streptococcus pneumoniae
MSTKYIFVTGGVVSSIGKGIVAASLGRLLKNRGLKVTIQKFDPYINIDPGTMSPYQHGEVFVTDDGAETDLDLGHYERFIDINLNKYSNVTTGKIYSEVLRKERRGEYLGATVQVIPHITDALKEKIKRAALTTDSDVIITEVGGTVGDIESLPFLEALRQMKADVGADNVMYIHTTLLPYLKAAGEMKTKPTQHSVKELRGLGIQPNMLVIRTEEPAGQGIKNKLAQFCDVAPEAVIESLDVEHLYQIPLNLQAQGMDQIVCDHLKLDAPAADMTEWSAMVDKVMNLKKQVKISLVGKYVELQDAYISVVEALKHSGYVNDVEVKINWVNANDVTAENVAELLSDADGIIVPGGFGQRGTEGKIQAIRYARENDVPMLGVCLGMQLTCIEFARHVLGLEGANSAELAPETKYPIIDIMRDQIDIEDMGGTLRLGLYPSKLKRGSKAAAAYHNQEVVQRRHRHRYEFNNAFREQFEAAGFVFSGVSPDNRLVEIVEIPENKFFVACQYHPELSSRPNRPEELYTAFVTAAVENSN

SEQ ID NO: 4671 - protein, 43 aa, Streptococcus pneumoniae
VFLTLSVLSTTSKQCFEQPTASFLACSLIFIEYKIQEDNFLKK

SEQ ID NO: 4672 - protein, 195 aa, Streptococcus pneumoniae
LELEVFAGQEKSELSMIEVARAILELRGRDHEMHFSDLVNEIQNYLGTSNSDIREALPLFYTELNFDGSFISLGDNKWGLRSWYGVDEIDEEIIALEENDDDEVAPKAKKKRVNAFMDGDSDAIDYNADDPEDEDAYEADPALSYDDENPDDEKNEVEAYDAEINEIAPDDLGEDVDLNEDDDEFSDDDAETSEE

SEQ ID NO: 4673 - protein, 149 aa, Streptococcus pneumoniae
LCFVPYYKVNYCEEAFAWYQNVNLVYLVDGVKLPYSQATLKAMYSNLDRHGELFWIEVKEKGEWFPIGDITLSQDNLPIVIGNSAYQHRGLGKKILSALIELARVKGWKELRVKEIYTYNNASRRCFKSLGFVENGATEKGRSFILELV

SEQ ID NO: 4674 - protein, 129 aa, Streptococcus pneumoniae
MKVNIADLHPTQLYLSEKKLQDIQMLYQSAETIQVDPISILAFGDCLLITDGHHRAYQALLAGRDTISAEWDRDGGDELYHLYAQACEERKIYSVFDLEDRILAQDGYEAKWYNWCDGFNQAATLLLKR

SEQ ID NO: 4675 - protein, 216 aa, Streptococcus pneumoniae
MKDKQTFLMKGSFALLLFVILGYMVKFYPEMLVNFDQSIQTAIRGDLPDYLTILFRSLTRLIDIPVIITWVVITAFVFYRKRWKIESFFMLGNLALAGLLIVTFKNIYQRPRPAILHLVEEKGFSFPSGHSLAVTLMVGTLIVILSQRIKDPVWRKIVQIVLGLYLVSVLVSRVYLGVHYPSDVLASLCVGLGVLFIEFPFYDKLRFQWRFKGKQK

SEQ ID NO: 4676 - protein, 187 aa, Streptococcus pneumoniae
MTNTRRLSTIAILSAISFVLMYFDFPLLPAASFLKIEFSILPVLVGLVVMDLPAALGVLLLRSLLKLLLNSQGVNTYIGLPMNIVALGVFVIVFALIWKKERTTLRFLLGSLAGTVGLTLAMLVLNYVYAVPLYAKFANFDIGKILGLSNYLMTMVLPFNLIEGVIFSVSFWLLYVLLKPTLKHYER

SEQ ID NO: 4677 - protein, 72 aa, Streptococcus pneumoniae
LERIPLSILTFYIPKVPSYSIKEKQSKWLQSGYKSIKTDKAILSSSPIQTILSVVESHHISLRSRTSLKRRK

SEQ ID NO: 4678 - protein, 155 aa, Streptococcus pneumoniae
MTNHIVLFEPQIPQNTGNIARTCAATNSPLHIIKPMGFPIDDRKMKRAGLDYWDKLEIYFYESLEDFISQMKGKLYLISKFAEKVYSEVDLSTDEDHYFLFGREDKGLPEDFMREHSEKALRIPMNDEHCRSLNVSNTVCMIVYEALFQQNFCRS

SEQ ID NO: 4679 - protein, 276 aa, Streptococcus pneumoniae
MQAKLIGYQHRDTVIHRLSGAGKLLFFILVSLAAMISYDTRMLLLIAIFSVFLLYLSEIRFKDVSFVAVFATVFAVLNVLMVYRFSPEYGVGLYGERSVIWQGIGVYTLTSQELFYLLNLAIKYLCTIPLAIIFLMTTHPSQFASSLNQIGVPYKIAYSVSLTLRYIPDLQEEFFTIKMSQEARGMELSKKASLMQRIKGNLLIITPLIFSSLERIDTIATAMELRRFGKEKKRTWYSYQALKKGDYITLLLATLFLVVSLLLILQNQGRFYNPWK

SEQ ID NO: 4680 - protein, 415 aa, Streptococcus pneumoniae
LSGGQKQRVSLAGVLIDESPILLFDEPLANLDPKSGQDIIELIDQIHKEEGTTTLIIEHRLEDVLHRPVDRIILINDGRILFNGSPDQLLATDLLTQNGIREPLYLTTLRQLGVDLVKEEQLANLDNMSISKGQVQLQNELAKETPELQSLFKLEDVSFSYDDRPILKSLHLDIKKGEKIAIVGKNGAGKSTLAKAISSFIQTEGRYLWEKQDIKGDSVAERAERVGYVLQNPNQMISTNMIFDEVALGLRLRGVDEKEIETRVYETLKICGLYEFRNWPISALSFGQKKRVTIASILVLGAEIILLDEPTAGQDQKNYTEIMEFLEELHQKGHTIVMITHDMQLMLDYSDRVLVMVDGELIADTVPASLLSDPELLVKANLKETSIFNLAKKLDVDPLDLTAFYKERREGCKLN

SEQ ID NO: 4681 - protein, 127 aa, Streptococcus pneumoniae
MKEAIIEWKDFSFRYETQQEPTLQGIDLTIYKGEKVLIVGPSGSGKSTLGQCLNGIIPNIYKGQTYGEFLIKGQTAFDMSIYDKSHLVSTVLQDTDGQFIGLSVAEDLAFALENDVTALDEMKGSCL

SEQ ID NO: 4682 - protein, 70 aa, Streptococcus pneumoniae
DFLSLVNGQVYPLQGRFLLCFIPEREILPLNYSFFHLTLFIRFLDFYFIINQALLAVSSLKILAPKRFLS

SEQ ID NO: 4683 - protein, 85 aa, Streptococcus pneumoniae
MKIKEQTRKLAAGCSKQCFEVVDETDEVSSKQCFEVVDETDEVSNHTYGKAKLTWFEEIFEEYKMMGKAGQLVFFDVYRLVRQVS

SEQ ID NO: 4684 - protein, 182 aa, Streptococcus pneumoniae
MEIKFTIKQVVAVGIGAALFVVIGMINIPTPVPNTSIQLQYAVQALLSIIFGPIIGLLVGLIGHAIKDSLVGYGLWWTWIISSGLFGLVVGLFRKYVRVINSVFDWKDILIFNLIQLLANALVWGVLAPLGDVVIYQEAAEKVFAQGIVAGIANGVSVAIAGTLLLLAYAGTQTRAGSLKKD

SEQ ID NO: 4685 - protein, 291 aa, Streptococcus pneumoniae
MIKDIQGDKMNNNLLVLQSDFGLVDGAVSAMIGVALEESPTLKIHHLTHDITPYNIFEGSYRLFQTVDYWPEGTTFVSVVDPGVGSKRKSVVAKTAKNQYIVTPDNGTLSFIKKHVGIVAIREISEVANRRQNTEHSYTFHGRDVYAYTGAKLASGHITFEEVGPELSVEQIVELPVVATIIEDHLVKGAIDILDVRFGSLWTSITREEFYKLEPEFGDRFEVTIYHADMLVYQNQVVYGKSFADVRIGQPILYINSLYRLGLAINQGSFAKAYNVGVGSSWTIEIKKIEG

SEQ ID NO: 4686 - protein, 449 aa, Streptococcus pneumoniae
MKIILVGGGKVGFALCRSLVAEKHDVLLIEQDEAVLNHIVSRFDIIGILGNGADFAILEQASVQDCDIFIALTEHDEVNMIAAVLAKKMGAKETIVRVRNPEYSNSYFKEKNILGFSLIVNPELLAARAIANIIDFPNALSVERFAGGRVSLMEFVVKSTSGLCQMPISDFRKKFGNVIVCAIEREHQIIIPSGDMTVQDKDRIFVTGNRVDMILFHNYFKSRAVKSLLIVGAGRIAYYLLGILKDSRIDTKVIEINPEIASFFSEKFPNLYIVQGDGTAKDILLEESAQHYDAVATLTGVDEENLITSMFLDRVGVQKNITKVNRTSLLEIINAPDFSSIITPKSIAVDTIMHFIRGRVNAQYSDLQAMHHLANGQIETLQFHIKEANKMTAKPLSQLKLKKGVLIAAIIRKGKTIFPTGEDMLEVGDKLLVTTLLPNITKIYDLIAR

SEQ ID NO: 4687 - protein, 479 aa, Streptococcus pneumoniae
MNKSMIRYLLSKLLLIEAVLLLVPVAIAVYYRESSQVFTALFSTIGILVLLGGSGSLQKPKNQRIYAKEGVLIVALCWILWSFFGGLPFVFSGQIPSVIDAFFEISSGFTTTGASILNDVSVLSRSLLFWRSFTHLIGGMGVLVFALAIMDNAKNSHLEVMKAEVPGPVFGKVVSKLKNTAQILYLLYLALFSLFVIIYYLAGMPLYDSFVIAMGTAGTGGFTVYNDGIAHYGSSLITYLVSIGVLIFGVNFNLYYYLMLRRIKAFFGDEELRAYLVIVLVSTGLISLNTLYLYPGFSKSFEMTFFQVSNIITTTGFGYGDITNWPLFSQFILLFLMTIGGSAGSTAGGLKIIRGLILSKIAKNQILSILSPHRVLTLHVNKTVIDKDTQHKILKYFVIYAMILLSLIFIVSLDSNDFLIVTSAVFSCFNNIGPILGTTSSFSIFSPISKILLSFAMIAGRLEIYPILLLFMKRTWSKR

SEQ ID NO: 4688 - protein, 559 aa, Streptococcus pneumoniae
MDKLVAAIEKQQGKFEKISTNNYMMAIKDGFIATMPLIMFSSFLMIIIMIPKNFGVELPSPAIVWMRKVYMLTMGVLGIIVSGTVGKSLVGNVNRKMPHGKVINDTSAMLAAICSYLVLTVTLVVDEKTGSTSLSTNYLGSQGLITSFVSAFITVNVYRFCIKRDITIHLPKEVPGAISQAFRDIFPFSFVLLISGLLDIVSRFSLDVPFAQVFQQLLTPIFKGAESYPAMMLIWFMCALLWFVGIHGPSIVLPAVTALQLSNMEENAQLLANGQFPYHSLTPNFGNYIAAIGGTGATFVVPFILIFFMRSKQLKSVGKATITPVLFAVNEPLLFGMPVILNPYLFVPFLMTPPVNVFLGKVFIDFFGMNGFYIQLPWAFPGPLGLLIGTNFQPISFVLLSLMLVVDILIYLPFCRAYDRQLLMKEDVASSNDIILEEDTSEIMPGEIDVIKSKELKVLVLCAGSGTSAQLANAINEGAQLAEVRVIANSGAYGAHYDIMGVYDLIILAPQVRSYYREMKVDAERLGIQIVATRGMEYIHLTKSPSKSLQFVLEHYQAV

SEQ ID NO: 4689 - protein, 470 aa, Streptococcus pneumoniae
MENLQFKALPKEFLLGAATAAYQVEGATRVDGKGINMWDVYLQENSPFLPDPASDFYYRYEEDIALAAEHGLQALRLSISWVRIFPDIDGDANILAVRYYHRVFQSCLKHNVIPFVSLHHFDSPQKMLETGDWLDRENIDHFIRYARFCFQEFTEVKHWFTINELMSLAAGQYIGGQFPPNHHFQLSEAIQANHNMLLAHALAVLEFHQLGIEGEIGCIHALKPGYPIDGQKENILAAKRYDVYNNKFLLDGTFLGYYSEDTLFHLNQILEANNSSFIIEDGDLEIMKRAAPLNTMFGMNYYRSEFIREYKGENRQEFNSTGIKGQSSFKLNALGEFVKKTGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 4690 - protein, 64 aa, Streptococcus pneumoniae
DSLALKHEYNLSLPQFLIDEIRGLQEHAPTTYYDSLELLQIIENDDLEETDLLYIDLQQETSVH

SEQ ID NO: 4691 - protein, 114 aa, Streptococcus pneumoniae
MKSKEEINMLGFTIVAYAGDARSDLMDALAFARDGYFEQARELVESANDSIVSAHREQTNLLAEEASGDNFEVSFIMIHGQDTLMTTMLLYDQVKFFIDEYERIRKIEEHIGLQ

SEQ ID NO: 4692 - protein, 646 aa, Streptococcus pneumoniae
LQINAILKKKKLLLEGNKMVIRVFDQQKNTYSSFALEELSYYMNRVFKTNIELVEEKEADIFVGLVNKEDRKDHVLISLDKGKGRIESNTIVGLLIGIYRMFHEFGVVYTRPGRRHDFVPELRFEDFLDKELSIDETASYYHRGVCIEGADSFENILDFIDWLPKIGMNSFFIQFENPYSFLKRWYEHEFNPYLNKEKFSNELVQELSDRLDKELQKRGLIHHRVGHGWTGEVLGYSSKFGWESGLSISEEKKPYVAEINGKRELFNTAPILTSLDFSNPDVADKMVEIIKDYAKKRPDVNYLHVWLSDARNNICECENCRQELVSDQYIRILNQLDRALTSEGLDTKICFLLYHELLWAPQKEKLDNPERFTMMFAPITRTFEMSYADVDFDNSIPTPKPYLRNKIILPNSLEENLSYLFEWQKTFKGDSFVYDYPLGRAHYGDLGYMKISQTIYRDVSYLSNLHLNGYISCQELRAGFPHNFPNYVMGEMLWKKTRSYEELIEEYFSALYGENWQSVVEYLEKLSSYSSCDYFNAIGSRQNDVLANHYYIAYNLADNFLPIIEENISKLLNSQKDEWKQLSYHREYVVKMAKALYLQATGKTRQAQDEWRNVLNYIRGHELLFQSNLDVYRVIEVAKNYAGFHL

SEQ ID NO: 4693 - protein, 440 aa, Streptococcus pneumoniae
MNNILAFLETKVAPFGEKVGNQRHLKAIREGFMMAMPLILVGSLFLILISWPQEAFTNWLNSVGLLSILTTMNQSTVAIISLVACFGIAYRLSEGYGTDGPSAGIIALSSFVLMAPRFSSMVYDKNGEQVKQLFGGAIPFSSLNASSLFMAITIGLVTAEIYRMFIQRGITIKMPSGVPDVVSKSFSALLPGFTTFVLWALVLKGLEAAGVAGGLNGLLGAIVGTPLKLIAGTLPGMILCVIVNSFFWFCGVNGGQVLNAFVDPVWLQFTTENQEAVAAGQTLQHIITLPFKDLFVFIGGGGATIGLAICLFLFSKSRANKTLGKLAIIPSIFNINTAILFTFPTVLNPIMLIPFIATPTINALITYVSMAVGLVPYTTGVILPWTMPPIIGGFLATGASWRGALLQVVLILVSVAIYYPFFKIADKRNLEKEKATVGGK

(The sequence listing continues in the following parts.)

What is claimed is:

1. A method of making a *Streptococcus pneumoniae* polypeptide, comprising the step of culturing a host cell that includes a recombinant expression vector, wherein the recombinant expression vector includes a nucleic acid sequence encoding a polypeptide having the amino acid sequence as set forth in SEQ ID NO:5179.

2. The method of claim 1, further including the step of isolating the polypeptide from the host cell.

3. The method of claim 1, wherein the host cell is a prokaryotic host cell.

4. The method of claim 3, wherein the prokaryotic host cell is selected from the group consisting of *E. coli, B. subtilis* and *S. aureus*.

5. The method of claim 4, wherein the prokaryotic host cell is *E. coli*.

6. The method of claim 1, wherein the host cell is a eukaryotic host cell.

7. The method of claim 6, wherein the eukaryotic host cell is selected from the group consisting of an insect cell, a yeast cell and a mammalian cell.

8. The method of claim 7, wherein the eukaryotic host cell is the insect cell.

9. The method of claim 8, wherein the recombinant expression vector is a baculovirus expression vector.

10. The method of claim 7, wherein the mammalian cell is a Chinese hamster ovary cell.

11. The method of claim 1, wherein the polypeptide elicits an immune response when administered to a mammal.

12. The method of claim 1, wherein the polypeptide provides protective immunity against an infection by *S. pneumoniae* in a mammal.

13. A method of making a *S. pneumoniae* polypeptide, comprising the step of culturing a host cell that includes a recombinant expression vector, wherein the recombinant expression vector includes a nucleic acid sequence encoding a polypeptide having at least 95% identity to the an amino acid sequence as set forth in SEQ ID NO:5179, wherein the polypeptide elicits an immune response in a mammal.

14. The method of claim 13, further including the step of isolating the polypeptide from the host cell.

15. The method of claim 13, wherein the polypeptide has at least 98% identity to the amino acid sequence as set forth in SEQ ID NO:5179.

16. The method of claim 13, wherein the polypeptide has at least 99% identity to the amino acid sequence as set forth in SEQ ID NO:5179.

* * * * *

UNITED STATES PATENT AND TRADEMARK OFFICE
CERTIFICATE OF CORRECTION

PATENT NO. : 7,582,449 B2  Page 1 of 1
APPLICATION NO. : 11/801963
DATED : September 1, 2009
INVENTOR(S) : Lynn Doucette-Stamm et al.

It is certified that error appears in the above-identified patent and that said Letters Patent is hereby corrected as shown below:

Column 54, line 12 delete "an".

Signed and Sealed this

Fourth Day of May, 2010

David J. Kappos
*Director of the United States Patent and Trademark Office*